United States Patent 8,101,349 (GENE PRODUCTS DIFFERENTIALLY EXPRESSED IN CANCEROUS CELLS AND THEIR METHODS OF USE II) - sequence listing, part 3

SEQ ID NO: 6139 - DNA, 300 bp, Homo sapiens
  misc_feature 104, 107, 110, 122, 129, 132, 142, 147, 158, 169, 187, 197,207, 209, 216, 230, 235, 237, 239, 244, 251, 255, 261, 283,292: n = A,T,C or G
cttgaacctaggaggtggaggttgcattcaactgagatcataccacttcattccagcctgggtgacagagcaagactctgtctcaaaaaaaaaaaggaaaactntgnganggacatttgttnagtaaanccnttcagtattnatccntcctttccccncagcagctttntttcctgtcaactaaaanggaccaggangtaataaatncnttttggngggactaggccacnccaantntnaatcntctcccntttnccttanacatttaaattgcaaggcgggnccctctggngctcaaaa

SEQ ID NO: 6140 - DNA, 163 bp, Homo sapiens
ccgggccagggtaacagaatcaaccctgccctgccctgcctgagcctggcaccagatcacaagcaacagaagtcttctgccagctgaaaagctgagtgtgggacagcagcactgaggaagccctgacaccctagtccccactctaagcagcccaccactagag

SEQ ID NO: 6141 - DNA, 277 bp, Homo sapiens
  misc_feature 109, 130, 132, 139, 140, 150, 153, 155, 158, 159, 161, 177,179, 181, 182, 183, 184, 186, 187, 188, 191, 200, 212, 214,216, 222, 223, 226, 228, 240, 241, 242, 246, 250, 253, 255,257, 258, 264, 265, 266, 267: n = A,T,C or G
ctcaggcagggagaaaaggaggcagtgggcacagccgtggactatggctacttcagattcttccaggaccggaggattgcccgctgtcccttccacacgctgatgccancagagcgcgagacgctcctgncnccggaannctctcttggngtnantgnntnttgcttctatttttantngnnnnannnctnttggttggnccctatttttcncncngcctcnnggnancttttttttacnnngttntctnctncngnnccaatnnnntttccttttt

SEQ ID NO: 6142 - DNA, 293 bp, Homo sapiens
  misc_feature 146, 154, 166, 173, 179, 184, 185, 189, 191, 193, 194, 198,203, 208, 210, 212, 213, 217, 223, 224, 231, 237, 239, 243,252, 259, 262, 263, 264, 267, 270, 272, 275, 277, 280, 285,286: n = A,T,C or G
gaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaangccccagntttcctccccantgatganatgatnatgtnncttntnanntgcnttgtnttatntntnncttntatttnntatcttnttttcnantttntttttttgnttccgtnctnnnttnttntnggngnttntcttnnttgttgt

SEQ ID NO: 6143 - DNA, 258 bp, Homo sapiens
  misc_feature 162, 183, 186, 187, 190, 194, 216, 223, 225, 227, 233, 234,235, 237, 241, 243, 247, 248, 249: n = A,T,C or G
tttctaatatgattacatgagtctactttataaactggtataggctatgtaattagcccgtaagttacttaaaggaccaggggacctaatttttgtcagttttccagtcacattggtgccattcaggactccagctgtttacaggaaatatgtacttatcanaatagtatttttccttgaggnatnncangatntttgcctcattaccacttgggnattattngntngcaagnnngntaancngcannnccattgcta

SEQ ID NO: 6144 - DNA, 271 bp, Homo sapiens
  misc_feature 123, 133, 138, 140, 148, 149, 154, 156, 165, 169, 171, 173,176, 177, 182, 184, 195, 204, 208, 209, 216, 221, 226, 227,229, 231, 233, 234, 235, 239, 241, 242, 245, 246, 250, 251,254, 260, 262, 264: n = A,T,C or G
gagagagagggcctgctggagagcatagggtctggaacaccaggctgaggtcctgatcagcttcaaggagtatgcagggagctgggcttccagaaaatgaacacagcagttctgcagaggacnggaggctggnagctntnagggcttnntgctntntagatttcntatncncntcnnttctntnttttacctttntttctactncttnnttttttnttttntgctnntntntnnntttntnnttnncccnnttntttctntncntcatctt

SEQ ID NO: 6145 - DNA, 291 bp, Homo sapiens
  misc_feature 128, 134, 138, 150, 151, 158, 163, 166, 170, 172, 174, 175,189, 190, 191, 196, 198, 200, 202, 203, 205, 209, 220, 221,224, 229, 232, 237, 239, 241, 247, 250, 253, 254, 255, 262,264, 267, 279, 280, 282, 284: n = A,T,C or G
aattcggcctctctagagtcttccccaggccactccttcacactccttactagcagcccctgcttagcctccacactacggcctggtgacctggtccatggtgctcgccctggtgcttgaagcctggnaagcgnccanggctgtggttcnnggatgtngcttnagntaanangnnggtaacccgggaannnaattnanantnnanaagnggggggctttnnttntattnccnaaccntntnctttanccntannntttggcngntgnaaaaggtattcnnantncctttcc

SEQ ID NO: 6146 - DNA, 300 bp, Homo sapiens
gagttctacaggtggagtgtggggcccagaaggggctcaggtcttaggggtgtcatctgaaaaaacagagatggtgatgggacaccagttctaggagccctctgcatggccactttctgcctcagctcttctaaagcatttcttctgttcccttccattggggtaaccactgatctgtcttcccaaaaactgagtcagaagttggactttgttacttggctcatctacatttaagatatagtcagaaaaaaaatgcagtctttacatcttaagaaagcttacatgggccaggcgcagtgg

SEQ ID NO: 6147 - DNA, 300 bp, Homo sapiens
  misc_feature 129, 133, 134, 155, 160, 167, 169, 191, 192, 197, 205, 208,210, 214, 217, 220, 227, 232, 237, 240, 241, 244, 245, 249,250, 254, 255, 258, 259, 267, 272, 277, 278, 283, 286, 289: n = A,T,C or G
gttgttgttaccgtgtgccaatgtgtcccatgtgggttgtgccaggtagagaaacaggaagtcaatcatctgtgacagtctctattctgtcgttttgctccttggtatttgatttgcactatatttacntganncctgttcactgtttaaaaccngaggncatcttnanaggcattggagacctggcttcnnaatgntgtcccancantnctgnctnaanctcctgntcatntcccnttnntgnngtgnnccannacnnttattttnaattngtatnntaatntanacntgtttctcccc

SEQ ID NO: 6148 - DNA, 294 bp, Homo sapiens
  misc_feature 109, 116, 131, 143, 147, 149, 152, 153, 154, 155, 157, 161,165, 166, 168, 178, 190, 191, 194, 196, 198, 201, 205, 206,211, 213, 215, 216, 217, 218, 219, 229, 232, 236, 238, 239,241, 247, 250, 251, 257, 258, 259, 260, 261, 262, 263: n = A,T,C or G
  misc_feature 269, 271, 277, 284, 285, 287: n = A,T,C or G
agaacacaaaacttgaaagaagttttatgcgtgtgacagtgtatggggctgcagttggtctccctggaggggacttccacacctcctgcctttaggccatgggtggaangtgctcnttgttgtctcctttnttcccttttgtngcgntntgnnnntnttgntttnntnttttagtttntgttttcttctnnttntntngancttnngtttntntnnnnncttttttctngcntgtngnntntctttngtnnatattnnnnnnngttgcntnttgggntcgtctnntnttttcta

SEQ ID NO: 6149 - DNA, 165 bp, Homo sapiens
gtggcttttatcatgcatgacaaacccctggctttcctgccagatggtaggacatggaccttgacctgggaaagccattactcttgtgtctgctactgccctcccacagtcaccccaatattacaagcactgccccagcggcttgattttccctctgccttcctt

SEQ ID NO: 6150 - DNA, 300 bp, Homo sapiens
ctttgggacagtgtgagtggagcttgtgtccagttgtgcacacggacacccggaaacctctcattaggagaagccactgctgcgcaccctggagatgggttttgaccctgggctcccgttaatgttgttgtggctccagatgcctcagaaataacttccagagtcaacaccatctgcggaagtgccgtgagacggtgcatgggctggagacagagacagccggcgccgaacatacctggggctgcccgtgcaaactggggcaagcccttcagcctccatgtggctgctttactatggaga

SEQ ID NO: 6151 - DNA, 264 bp, Homo sapiens
  misc_feature 108, 115, 127, 131, 145, 150, 156, 161, 162, 164, 166, 171,172, 176, 177, 178, 179, 183, 185, 192, 195, 196, 198, 200,202, 203, 211, 213, 215, 216, 222, 226, 230, 236, 237, 238,242, 243, 244, 245, 247, 250, 253, 258, 261: n = A,T,C or G
ctgtgactggctgagctgctgtggccgggctgggcagtgtgccccaacagctcagtgctttcctgacactccagtgtctggggtggttgaggagcgagtactctcttncttccanaccaagttcctncctngggtttgccttganacgtnttatgnttttnnancntattnntctnnnntatnantttttanatnntntntnncttattanantnnattttnttantatntatagnnntatnnnntnttnaanatatnatnata

SEQ ID NO: 6152 - DNA, 300 bp, Homo sapiens
  misc_feature 144, 152, 156, 161, 162, 165, 166, 170, 172, 189, 195, 197,206, 211, 242, 246, 253, 266, 275, 278: n = A,T,C or G
ccccagattcccaatcccaccgcaatgtttggcaagcctaggactgataagtagctctgatagaggagctggtggcttttatacttcttcctgggtttttgttggggtttgttgtttcgttgttttttgtttttttttttgttnggttgggnaagnattgnnttnnacgngngctattttcagtaccanagtaancncaaggtttnaatcnagttgcataaaacacctttgcatagctattnaatngcccaangtaaaactttaangccatttcnaangctttaattcatttttgaagta

SEQ ID NO: 6153 - DNA, 278 bp, Homo sapiens
  misc_feature 140, 144, 147, 148, 150, 153, 154, 155, 159, 161, 163, 164,165, 173, 174, 175, 177, 185, 186, 191, 194, 195, 196, 198,200, 202, 204, 205, 209, 211, 215, 216, 221, 225, 227, 234,235, 237, 238, 239, 242, 244, 251, 253, 254, 257: n = A,T,C or G
gtgtcccaagtgtccggagcaggcggcagaggcctcagtgcggcaaacacaggcccagagcctgtgtggcaccagcagcatcttagagccccaggtatatgctgagatcttatctcacgctgtctccagttgtctgttgngacnaanngntgnnnctantncnnnacaccttnnnantttgtatnnttgcnttnnntntntncnncttnantctnngtttnaccngntatgctnngnnnttntnttacttnannganatagtccacattcgctactct

SEQ ID NO: 6154 - DNA, 300 bp, Homo sapiens
  misc_feature 163, 168, 170, 173, 174, 179, 181, 182, 184, 195, 196, 201,202, 207, 210, 217, 220, 224, 227, 229, 233, 234, 235, 238,240, 243, 248, 251, 259, 269, 271, 278, 280, 282, 284, 285,289, 292: n = A,T,C or G
gctaagccttacacacttgtcctgtgcctttgttgtcgtatccctatgtaaataccttctccaccttcccattccttcatggatgacttcccagaccttcccactcatcttttgaatgtgtttattgctgacttggcaatgcatcaaaatctttttttttttnggccncnggnntaacngnntnacagggggaannccccnngaaancgnaaaactnttngcanctnangtcnnnccngnatnttcanggncagggatnattggtggcnanagttttnangncnntaangancctttaag

SEQ ID NO: 6155 - DNA, 262 bp, Homo sapiens
  misc_feature 139, 160, 168, 170, 173, 174, 175, 181, 185, 188, 194, 201,206, 211, 213, 216, 221, 225, 228, 235, 237, 240, 241, 243,244, 245, 247, 250: n = A,T,C or G
aaaaagaagccagtaaaagatcctgagatggattggtttgctgatatgatcccagaaattaagccttctgctgcttttcttatattacctgaactgaggacagaaatggtcccaaaaaaggatgatgtctccccagtgntgcagtttttctcactatttnctgcttantntannntactgngggngangcttantgctggntttantgagngntantattnctgnttntttgcgncntgnntnnnanttnttttcagtttcc

SEQ ID NO: 6156 - DNA, 274 bp, Homo sapiens
  misc_feature 235, 242, 249: n = A,T,C or G
aaccggacggacttgcccatcggccctcacgacacgcgtgcagtgggactctagccaaggcggtggccgagccatcattacaatttttctggagtaaaggatccacggtgggacatcaactggcacttactctgtttaggaacttgagttgaatcatttctaaacttgtcctttagaccacgcctagggcagcaaattccacttcctagaactgcaaaccgggagaggatgtagntagattntggcatnctgccccggctctttgagggaaaag

SEQ ID NO: 6157 - DNA, 268 bp, Homo sapiens
  misc_feature 172, 177, 182, 183, 184, 192, 193, 198, 200, 204, 209, 210,211, 222, 223, 225, 228, 229, 230, 231, 232, 233, 235, 236,238, 239, 241, 245, 251, 260: n = A,T,C or G
gaaggatctccttggttaccaaagacactcacatctttaattttggtgtttcgatggaagcacaggatataattctctgcctccttaaattgttgaacgtgctgcaaagtttgacatttagaaatagaactagggctgtggggctttgttccgctttagcggctttgttctntgtcnttgcnnnctcacttnngtgcntngagntcagnnnatattatacannantgnnnnnncnnanncnttangcagtnttgcagggngcgacact

SEQ ID NO: 6158 - DNA, 289 bp, Homo sapiens
  misc_feature 189, 190, 197, 204, 211, 213, 220, 223, 226, 227, 229, 234,235, 238, 239, 242, 243, 248, 249, 253, 254, 256, 260, 261,263, 264, 270, 271, 272, 274, 278, 282: n = A,T,C or G
ggagaccgtcactccaggtgcattctggaagcattagaccccaggatggagcgaccagcatgtcatccatgtggaatcttggtggctttgaggacattctggaaaatgccactgaccagtgtgaacaaaagggatgtgttatggggctggaggtgtgattaggtaggagggaaactgttggaccgactnntgccccntgctcancactgancnctctgantgnttnnangcttnnttnnttnnatacnntatnncnattnncnntttttnnntntttntttnttttttt

SEQ ID NO: 6159 - DNA, 270 bp, Homo sapiens
  misc_feature 132, 136, 139, 146, 158, 164, 166, 167, 206, 220, 223, 229,231, 232, 244, 249, 250, 257, 258: n = A,T,C or G
aacactttctaccacactgtgggaagcatcgataaacagtcataataattatcattctgagtcactgcaagcgtggggttggatgctggctctcacagtatcctgtgtagggaccatgagcagccatgcgcncctncangcacggncgagctcaaccngaagancnngcgtgctccctggcaggagcaggatgcctgaccacagantgataattattatnacnggtatngnngcttgccacagngtggnngaaaggnntgaatttcactt

SEQ ID NO: 6160 - DNA, 291 bp, Homo sapiens
  misc_feature 174, 191, 207, 215, 237, 239, 240, 246, 247, 252, 253, 260,262, 269, 272, 280, 281: n = A,T,C or G
gaataagggaaggtttggagtcctgggtgattgcttgggatgccagcagcatttgagaccaaacaggggtgtgaagatgggtgggtcagctcaccttgcagagtgtagcataaatgggcacagccagaaaattgcttcttcctccaaagctctctgattcaggaatttggggcntattgtggaacgttatnacattcttgtctctgngcttactnttcccgccattcattacgaacnannagtttnnaacgnngttctgntntcaaagncantgcatctnnttatcatact

SEQ ID NO: 6161 - DNA, 300 bp, Homo sapiens
  misc_feature 171, 179, 183, 188, 189, 196, 197, 201, 203, 206, 208, 212,216, 217, 225, 227, 237, 238, 239, 240, 243, 245, 247, 248,252, 253, 257, 258, 260, 261, 262, 263, 268, 269, 272, 273,275, 276, 279, 280, 281, 287, 290: n = A,T,C or G
attgtgttgagatccaccgctcacacgccgtacaccacccagtggcttcattctggcttagccgcagaggcaagaaagggaccccacttgctcccatgcccacctcaagaaaaaacataaaacaattttttttaaaaaagaaaagaaatctacctcagttgacaggattcnacctttanggtntcttnntcttttnngttntngcngncttntctnnttttcttntnatattctttnnnnttntntnntttnntgcnntnnnncttgnnttnntnnttnnngcttcntcntttttatttt

SEQ ID NO: 6162 - DNA, 300 bp, Homo sapiens
gcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgac

SEQ ID NO: 6163 - DNA, 300 bp, Homo sapiens
atcatgctgctagtgttcccgctactagtgctccgttagttttaaatcatgttccaacttgaatttgaggtcttttgactttcgttggctttttgtcagggaaaaaaacctgttagggacagggtttcacaattccttttatatttccattcacatgtatttacaaacgtgtgcctggagtagtaagtacacaataagtgagtttccagctgtttttgtttcggaaacaaaaaaaacaaaacaaaacaaaacaaaaaaacaacggaaggtgaatggaattgtgtttgtaacattaaactg

SEQ ID NO: 6164 - DNA, 300 bp, Homo sapiens
ggcagacttctcatccgtaaaatcaggaagataacatgattccaagggcgttcatgaggattaaaggaagtcatgctcctaatttactgcctggcacacagacagtaaaatgctcaatacatttatggaaggaatgaaggactctggcagaaaaacaggtcagatgtgtctgctgtggacaggtggctctgtcggtgcccggtgagtgccctgggagtctggcagtcacctcctccgcagccgtgtccccaggctcacaggagccacctcaggtgggaagctctctgccagccttggaag

SEQ ID NO: 6165 - DNA, 255 bp, Homo sapiens
gctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctac

SEQ ID NO: 6166 - DNA, 300 bp, Homo sapiens
attgtgcacctctaaccctctctagcaaccttattgataccattcagtgccaatattcttccaaccaggttgaggacttttgatttgctgagaatgaaattctgcatatctttgcttgtcactaatgcctgtctgctctctgcctcaccttcttgtccattggtatatgtttggcactctgagagtatacagcatcaattcattcatatctccaatactctttcattaagtctcagttgcttgccagcacagacaaggtactgcccaaagaagtccttggaaaacaggcaagatatatac

SEQ ID NO: 6167 - DNA, 300 bp, Homo sapiens
agatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaag

SEQ ID NO: 6168 - DNA, 261 bp, Homo sapiens
  misc_feature 212, 220, 225, 227, 229, 236, 244, 247, 253, 256: n = A,T,C or G
ggcaaaaggcatctgctggagctggtgaccccagcttggtgccccccaaagccagagtacgaggctgagaggatgcaggtgtcctcctaggaggtttgagtcagaaggcacgaggcagaagcagtgggggaggactccctcagtagagcgaggaggaggcccctcatccaagaggaggttggagcacaggggggtctaggtttgcagtttcnggaccggnagctnangngtcccanggcctttnttntgtttnganaattt

SEQ ID NO: 6169 - DNA, 300 bp, Homo sapiens
  misc_feature 154, 160, 169, 175, 176, 179, 184, 186, 194, 196, 200, 201,203, 214, 219, 223, 225, 227, 229, 230, 232, 238, 240, 242,249, 251, 254, 255, 256, 258, 262, 265, 269, 274, 275, 284,286, 287, 292, 293: n = A,T,C or G
gtgcccccagccagggtgagcccctttcccagaactgcctcaccacccagcccttgtgtgatcctcatgtctcctgccccaggaccacatcctgagcttgggtgccgacttcaccttgatctccctcggcagcatcaggagaaagtggagcggntgttanaggtgtcangtgaannttncttgngntttcttgntncttnncntattatttttngttantatncntngnntntttaantntntttttantnttnnntntttnttntttnttctnntttattgtntnntattnnttttttt

SEQ ID NO: 6170 - DNA, 300 bp, Homo sapiens
agacgttgcagcaagtggacaagtggccgctgtgcgggcccctcgcttgtagtgagctgttgcagcttacggtccgttccctggagggggggaggagtgagaggttgtgcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaa

SEQ ID NO: 6171 - DNA, 247 bp, Homo sapiens
ccgtgcctcgctttccctgtcccccgccctatggacacccctggctcaggccagtgtgcttgtcccagcatcgcgctcatctcctgtttttatttgatgttacagatttcatttcattaggaatgagtgtttcctccccgacttttgcctgcattattttgccagctcctccctggaaaagggcaggggcggacactttcccagcctcccaccgtgctctgttcctagtggcacctgccccagggtc

SEQ ID NO: 6172 - DNA, 300 bp, Homo sapiens
  misc_feature 267: n = A,T,C or G
tgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaaggngtgtgtgtctgcaatcaaggcctctgcagctca

SEQ ID NO: 6173 - DNA, 292 bp, Homo sapiens
  misc_feature 266, 269, 282, 283: n = A,T,C or G
gcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctatnaanggaagtcatatgnnaggtgtgtg

SEQ ID NO: 6174 - DNA, 277 bp, Homo sapiens
  misc_feature 163, 197, 198, 209, 211, 215, 216, 224, 225, 226, 235, 240,242, 254, 255, 256, 268: n = A,T,C or G
gctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctgnaactcctcaggcttacccatgatcgagagaagcnntgtggtttggntngaanncgactcgnnntcattgctnagggngngaggcgtttcgnnnttaggcttaagntattgtggg

SEQ ID NO: 6175 - DNA, 300 bp, Homo sapiens
  misc_feature 226, 228, 239, 240, 246, 250, 253, 254, 258, 259, 260, 264,272, 274, 275, 281, 287: n = A,T,C or G
gccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagnancgggagggacnncagcancagnatnncgannngctnagtgcgancnncacccncttggngctgcaggatacc

SEQ ID NO: 6176 - DNA, 300 bp, Homo sapiens
gagcgacgaacttctgagacaggtgtgggtgcgagggtcggtagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctaga

SEQ ID NO: 6177 - DNA, 300 bp, Homo sapiens
aattcggcgcggtgagtggtgagactgccttgggcgggttaccgggcatgactcttcgtgacgattctgagacccccccttccccccgaactcctccagcccgcagagttctatctccaggtggaccgcttcagcctgctgcccacggagcagccccggctacgggtgcctggttggtaagtgatgcctccgcccaggagccctgctctgtctgggtgagcatagcccctctgcagctggagggtagaacaaggaaggcctgaggtagagctgggagggagcatgggtagccttggatgg

SEQ ID NO: 6178 - DNA, 300 bp, Homo sapiens
ggaggatgttggcaagcaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggt

SEQ ID NO: 6179 - DNA, 300 bp, Homo sapiens
aggcgcggtgccccagagtggggtgcctgcactctcagcttccacaccctcaccctacccctacatcggacacccccaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagcccccgagacaccttgaggaggccgctccttcccagacacacccccacgcccccactgga

SEQ ID NO: 6180 - DNA, 300 bp, Homo sapiens
  misc_feature 135, 149, 156, 157, 163, 167, 168, 171, 177, 181, 186, 188,190, 192, 198, 203, 208, 212, 216, 219, 220, 226, 232, 236,242, 243, 245, 252, 253, 254, 255, 256, 257, 258, 260, 261,266, 267, 269, 270, 271, 272, 277, 280, 283, 287, 288: n = A,T,C or G
gtgacttctgctatccatgttgaggttgcagaacttgaagctaatttaccttgtacatgtaaagtgcattttcctgatccaaacaagcttcattgttttcagctaacagtaaccccagatgagggttactaccanggtggaatatttcnttttganncttttnttcnntanagtatncatnttatncntncnaatctncattnctganctanttanatnncacttnaatacnttcncttganncntctcttnnnnnnntnnttctnntnnnnccttntantanatcnntttatatctctc

SEQ ID NO: 6181 - DNA, 300 bp, Homo sapiens
cgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaag

SEQ ID NO: 6182 - DNA, 300 bp, Homo sapiens
ctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggtgattttggttttcctccattcttccagtgtg

SEQ ID NO: 6183 - DNA, 295 bp, Homo sapiens
  misc_feature 214, 216, 219, 231, 265: n = A,T,C or G
tggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatnancangacggacctcanggccttcgtacagttctgcatccagcgcttccancttcctgccctgctgagtttctgttggacc

SEQ ID NO: 6184 - DNA, 300 bp, Homo sapiens
atccaccgtcattccccaataccttagttgtagtcaactaactagataggctgccgaagatggtttaactgtgtccagcttaactacagccaggctttggaatgcctggcctatgtctgtaaatgaaatctaacaatttattgtataacgttgttaaacatgaagcatgatgttggccctggataaaacattttaaattctcgtcgttcataccagaggctcagtaactgaccggttgaaagaaaactgttcattgtaacctaatgatgctagttagatagcattagattatgttagaga

SEQ ID NO: 6185 - DNA, 300 bp, Homo sapiens
  misc_feature 261, 266, 274, 278, 288: n = A,T,C or G
gccttttgttgtgaagttgctcatcatttaggagtgtttaattctaaaaagccttcagcctaagaaagcttcatctgtggggaccagagacttgttgctcagggagttagtgatgggacttgggcatctgatctgcaggtgacaagtttagttcaactgaagttgtagggaatttagacagttgcacatcattgccgttctaggggccttgtagaaagatgaaacagttgtttttcatttaccagcacctctcagttatanaggtnatggaacnttcncttactttgnatcatcattcct

SEQ ID NO: 6186 - DNA, 300 bp, Homo sapiens
acctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatattcatcgctacttgtgcctggacaagtcggtcattgagctcagccgacagggcaaagaggggagcatgattgatgccaacctgaaattgctgcaggaagctgagcaacgtctcaaagccatt

SEQ ID NO: 6187 - DNA, 300 bp, Homo sapiens
ggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaattcctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaga

SEQ ID NO: 6188 - DNA, 300 bp, Homo sapiens
ataagcagtggctttcaaaccgtgtgctctaggactggctgggccttggagaggcgtcagtggcgccctggggaaacagggcaccagagcaatgggtgaggtccagcctgtcctgctcacgtcagccagggcacatccaagtctgttgtcagttgactgttgggttcctggattagagtttgtgagggacgagggaggtttttaaacccacacaaacacagcatttattttactgcagatactgtttgaagtgctgtattagttcgttttcacgttgctgataaagacataccagagcct

SEQ ID NO: 6189 - DNA, 300 bp, Homo sapiens
ccctttgagatttctggctttttgtagggacctcagttccattttcccaactcatgggttctcaataccttaactatcttttatttgtcaaattccaagtcctcaactcacccaccactacctgacccactgcagtcaccacaccaccctacccactttcccagggatgctttatgattagcttaaatactcaccattctgatttgtaatgccgcccccaccccctttttttgacacctgggagtttccttttctttcttgtaagatcagcattacacaaacaagcacatttttcttatt

SEQ ID NO: 6190 - DNA, 300 bp, Homo sapiens; identical to SEQ ID NO: 981

SEQ ID NO: 6191 - DNA, 300 bp, Homo sapiens
gtgaggaaagaaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggttt

SEQ ID NO: 6192 - DNA, 300 bp, Homo sapiens
gcttagataagtcaaatgcagtagacaatggatagtcatcacagatttttgtacatgggacttcacataccttaattgaatatccatcgtgtacaaaatattgctcaagcaatgtaggaatcaagggaataaaagcttattctgatattatagagcatataacagccatgtaaatatgcatggtatagagaaatcagttctatgatggatgtaccagcaaagttgcagagcattatatagagttgcttttgatatgagccctagaataaattgggatagagagggagttggggaatttga

SEQ ID NO: 6193 - DNA, 286 bp, Homo sapiens
  misc_feature 143, 152, 163, 165, 166, 167, 168, 169, 171, 173, 174, 178,179, 180, 181, 185, 186, 187, 188, 190, 192, 193, 194, 200,202, 206, 207, 209, 212, 213, 214, 217, 226, 231, 234, 235,236, 238, 239, 240, 241, 242, 243, 245, 246, 254, 255: n = A,T,C or G
  misc_feature 259, 262, 263, 264, 266, 267, 275: n = A,T,C or G
ttttcttggagacattccagattgccatattactttattttaaacagcgctatgactttaaatccaaggctgctcggaagatttttttaggtctctcataagcctattcttccctgatcacatgagtgggagaggtaagcctnattttgaangccctttctgngnnnnnanannttcnnnnccannnntntnnngaagantntttnngngtnnncanttgccattnttccntgnnncnnnnnngnnacaggggnncaanttnnnanncccttttnggggttcccaa

SEQ ID NO: 6194 - DNA, 300 bp, Homo sapiens
atctctcaggaaggctttgaacaaatgaaagcagcagccatttcagcaagcgggggccacacctaaggttactcgagagtgaagattatctcagaagtttagaatcatgacacttcggggaagataggatcagggatgaatgggagacgggggcttaagggagagcttagaagtttagaatctaagagagaaagggtttgtttttggggagagggattatgtatgatatttaatagcacctgcaaactttaagatagctggggggttctcagtaactaaggagggtcctgaccctaaaag

SEQ ID NO: 6195 - DNA, 287 bp, Homo sapiens
  misc_feature 175, 176, 178, 190, 198, 200, 213, 215, 216, 220, 222, 223,224, 229, 230, 231, 232, 237, 242, 246, 249, 252, 258, 264,265, 266, 267, 268, 269, 271, 273, 276, 279: n = A,T,C or G
ctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagttagatctctaacatactnnantgcaagataagncaagagantnaccgagattttgncnncganannntactnnnnttgantttgntgcnatntantaactnctggannnnnnantntcnatncatccccc

SEQ ID NO: 6196 - DNA, 263 bp, Homo sapiens
  misc_feature 148, 156, 159, 165, 177, 185, 188, 192, 193, 194, 195, 198,201, 205, 207, 209, 210, 211, 213, 217, 221, 226, 228, 230,231, 232, 235, 236, 238, 243, 244, 247, 253, 256, 257, 259: n = A,T,C or G
cttccttctctatacccttctctatgttttattgcataaataggaaacattgttgaaaagactttcctggtaaactgttctgaattttacgtttatcgaaatatctccaaagactcaatttagaactttattatgcccttatttattnaacatttnttnggaacnaacatgtatatngcccttangtnggcnnnngcnagnggtnanannngngagntctnaatgngngnnnaanngngcggnnggntcggtnggnngnatgt

SEQ ID NO: 6197 - DNA, 300 bp, Homo sapiens
gtggccaagggtggggccaagactccacatagatccaggggctcattccatgatgctctcatttcctagagtcctccaggtgtacagggaattgtttcactgacagacaggccaggatatctcataagcttcttgggcacaagttggagtggtatgggtggaattccagcacaattaggcatatcgtggttgggtgaacacaaccatacaagggggagaggtctctaccagtggcctgtgcagtcctgccatgttctttcctggtcaatgttttaaatgataacttggaatactactaaa

SEQ ID NO: 6198 - DNA, 290 bp, Homo sapiens
  misc_feature 249, 251, 261: n = A,T,C or G
gtgcgtctagaggaaatgtactgttttgcagataataagtattgatcagacatgcatttttacctctgctgtgggattttagtctcattactttgttgatctactttgtagttaacctagagaagttaacacagccattgctacagagctttctgccacttgagttccagaattccagaatccagtttcctagggattgtggggagtaaaaagaggtatagggtatggtccctgtatgggagcaatacngnctttattgantagtgtctatattgtcttgtgactcaggt

SEQ ID NO: 6199 - DNA, 293 bp, Homo sapiens
  misc_feature 139, 140, 142, 143, 150, 156, 159, 165, 169, 173, 176, 180,183, 189, 192, 195, 197, 199, 200, 201, 202, 204, 207, 211,214, 218, 219, 220, 221, 227, 229, 232, 238, 239, 241, 243,249, 252, 255, 256, 257, 258, 259, 260, 262, 263, 267: n = A,T,C or G
  misc_feature 269, 270, 275, 280, 282, 283, 286: n = A,T,C or G
attttttgacaggattttattttgtgtgcatgcattctgctccaagtgtcacaattctggttacaataattataatatttggagttactactaagactttcctgaaagaggtgtattgtaccaaattttgtaacatatnntnntactaantgatcntanagcttnctanattntgnatanggnatgtgntancancncnnnncnttnaacnggntttnnnngtcggntntgntttctnntngntggtgnccnatnnnnnntnntttntnngttcnttttngnnctnttgtttc

SEQ ID NO: 6200 - DNA, 299 bp, Homo sapiens
  misc_feature 155, 161, 177, 183, 193, 198, 200, 204, 205, 207, 209, 210,234, 247, 280: n = A,T,C or G
ggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggngtgctnaattaatacgagcacnagcaanaaattggacnggcangnaagnntntnnagacacctaagataaagtccggancccaaggctttancttaaccatgtatggtaccccattcattcatcnagaaaaccctcaacagctg

SEQ ID NO: 6201 - DNA, 300 bp, Homo sapiens
cccgcctcggcctccaaaagtgctgggattacaggcgtgagccactgtgcccggccttcaattttatttaataattatgcatgtgtgggatgcaatgtgatattttgatacgtgtatacaatgtgtaatgatcaaattagggtacttagcatacctgtcacctcaagaatgtttttcataatattttatttgtaagataagcattcttcccatgtgcacaacattgctgggtattgttaagagatcatgaaaacacacaatccttattgagaaggtggccaggtgtggtggctcatgcct

SEQ ID NO: 6202 - DNA, 300 bp, Homo sapiens
gactcttttttcctttgtattttctttctcagtctgatctgcttcctgacttcctggaaaccctccaaatttcttgatttctaatggcactctttctagatttctagccctgtacgataatattctttcatcatttcagtgggcttttggagggaggcggagatccaggtgatctgtctacactattcagtcagaaagctggatggtttttctcactgtttagctgtgactcatacttagaaagtggtttaaatgtgaatatcttagttctggttgtacaattgaggtaatcctcaattc

SEQ ID NO: 6203 - DNA, 289 bp, Homo sapiens
  misc_feature 146, 151, 153, 155, 156, 161, 164, 176, 178, 180, 183, 184,190, 192, 195, 201, 202, 206, 208, 216, 218, 221, 222, 225,226, 231, 233, 234, 243, 247, 249, 252, 254, 255, 257, 261,264, 273, 277, 278, 279, 282: n = A,T,C or G
tagaggttggaaaggagtcatgaggggtgggaaactagcaggggcacatggaagctagggaaagaattttgcttgagatcgtcaaagtgaggggaagagggtagtaagcaaaggagaaatgttatatggggttcggaggttttagntctantntnnccctnttnatctgttctttntntngtnngctctntnttnctgcgnnagcntncttctctntnctnnatnnttatntnngtcctcgtntgtncntcncnncnttcnctntcttctttntctnnnctntccctat

SEQ ID NO: 6204 - DNA, 295 bp, Homo sapiens
  misc_feature 102, 106, 111, 113, 119, 120, 127, 133, 134, 135, 137, 138,140, 156, 157, 158, 159, 164, 174, 175, 180, 181, 182, 183,185, 187, 193, 196, 197, 200, 202, 206, 210, 216, 225, 227,228, 232, 235, 240, 252, 260, 263, 271, 274, 283: n = A,T,C or G
ggtagaaggagcctcctcaaaggcagtgctgggcacccacgggtgtgctggatactggagtttgagaggagggaggtgctgtggccttggatactctaaaanagtngtaantntcactnntttgtgnctatannntnntngtacttctgctcaacnnnncttantttactgagnntattnnnncngnactttnatnntantnattntccntttatncctttactntnncacnttntgctnctttattgatanctggtctnatnactttctnccntcattgttnttcttacttttc

SEQ ID NO: 6205 - DNA, 300 bp, Homo sapiens
gtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgac

SEQ ID NO: 6206 - DNA, 286 bp, Homo sapiens
  misc_feature 144, 146, 150, 154, 170, 171, 172, 174, 180, 181, 183, 185,194, 195, 196, 198, 202, 215, 224, 229, 237, 244, 246, 253,255, 256, 257, 259, 262, 264, 268: n = A,T,C or G
tgtttttacctaaatgggcccacgtggcagcatgatttttgtcctttagcgccctgctttggggacctctctgtgctgtgccgtatagcttcaattcattcttccaacccggtgccttttggtctataatggagatggtgcagntnattncttngcacttgtcacaacgnnncncctaanncncnctgggaatnnnancccnctaatacctttanacatttaanaaatncatatttncgcatgncnaaacgancnnnanacncnatgnaaatctcgcaatatcata

SEQ ID NO: 6207 - DNA, 269 bp, Homo sapiens
  misc_feature 145, 159, 160, 162, 163, 165, 166, 175, 176, 177, 183, 184,188, 189, 190, 200, 203, 204, 206, 207, 208, 209, 210, 211,213, 215, 221, 226, 227, 230, 233, 234, 236, 237, 239, 241,242, 245, 248, 254, 256, 261, 264, 265, 266: n = A,T,C or G
gggcaaccctggctctatcattttccttttttgccaaaaggaccagtagcataggtgagccctgagcactaaaaggaggggtccctgaagctttcccactatagtgtggagttctgtccctgaggtgggtacagcagccttggtncctctgggggttgnnannannaaccatggnnncgtgannactnnntccagatggnttnnannnnnngncntcttcnttccnnatnctnntnntngnnttnagnctgtangntcttnctnnntcg

SEQ ID NO: 6208 - DNA, 300 bp, Homo sapiens
cccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgccatcttgctgtggaagcactacagaaaactgtggatgaacacaagaaaacgatgg

SEQ ID NO: 6209 - DNA, 300 bp, Homo sapiens
gaactgtcccccgttatctctgtccatacagcaacagcccccaatggccctgaccacctccctccccagcagaacgccccttcgtgggtgtgaaaatactttctattctggtcagcaccaagaatgcctttttcccttctgcaggtcctccagtgattccccttaagaatgcccctttcaaagccacccccccatcgcagcggcacagctccctctagagttccttcacactcacatcctctcccgcctcaggtagaaatatccgcctgcttagctccaggctcccatgacatactcccg

SEQ ID NO: 6210 - DNA, 300 bp, Homo sapiens
cctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaa

SEQ ID NO: 6211 - DNA, 295 bp, Homo sapiens
  misc_feature 198, 206, 207, 211, 215, 219, 226, 232, 236, 237, 242, 254,261, 271, 272, 273, 274, 275, 276, 278, 279, 281: n = A,T,C or G
gctccagacagctcttctgtcatttcaccaggtccaaacaccagcaccaaggctcccatgaaatatcccctttattccatctcaaatccttacctatcaactccttgcccagagaacctggaataacatatttacttctagtccttttcaatgcattttccccttgggggaggtgtgggagggttgtgagtgagtacntgaaagannatcntacngatngaccatntttganggtnnctcanagggataaatanatatagntaaccgatgnnnnnncnncnggagaaaccatgat

SEQ ID NO: 6212 - DNA, 269 bp, Homo sapiens
  misc_feature 129, 140, 142, 186, 188, 191, 198, 200, 202, 208, 216, 242,249, 257, 258, 259: n = A,T,C or G
ccccccgcgtctcccgggagcgtcgccgccacctgcacgcgtctggcacacaaacgtcggtctcaccccttagtttctggaagagaaaaaggaaaagccaccgagaggcctgaccctgaggggtcggtnggagatgcggncncgtattatagggaagcgattgatgagcgttgactgttcatcatntnaantgtatgntntnattttntttttttnttattatttctttttttatttttttnttttttntttatatnnnttttaattta

SEQ ID NO: 6213 - DNA, 266 bp, Homo sapiens
  misc_feature 207, 210, 226, 227, 230, 236, 239, 244, 245: n = A,T,C or G
gtttacccttggtttattgtgattatcatggccattcccgaaagaagaatgtatttatgtatggttgcagcatcaaagagacagtgtggcataccaatgataatgcaacttcatgtgatgttgtggaggataccggatacaggacattgcctaagatactgagccatatcgccccaccattttgcatgagcagctgtagcttcgtantgnaaaaatctttgactcnncgntctgtnttnctcanntataggacccacttgaacaaa

SEQ ID NO: 6214 - DNA, 300 bp, Homo sapiens; identical to SEQ ID NO: 2932

SEQ ID NO: 6215 - DNA, 283 bp, Homo sapiens
  misc_feature 160, 161, 165, 168, 169, 170, 172, 174, 176, 178, 185, 188,191, 192, 197, 198, 199, 202, 205, 206, 207, 210, 213, 218,226, 230, 231, 243, 245, 246, 248, 253, 260, 264, 265, 267,269, 272, 273: n = A,T,C or G
cctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgtnntctngtnnntnantntnttggggnttnagnnctaannnagntcnnnggnctnttttnagagatangggnntctttgcttctngnngntcccnttttttnttgnncncnagnngtgttgtttt

SEQ ID NO: 6216 - DNA, 300 bp, Homo sapiens
ttcagtaccaggggccggccgtggctcccatcctccggaatctgcaaaatggctacttcttcagaaataatggggagagggatggcaagaggccagagatcaaggccctcgagtattaacttgagcatttgggcacaaaatagacacttttggattttcccgtcttttccaacaccaaggatgagattatcaaaagatgtgttaaattaatttgtaccggccgggcgcggtggcttacgcctgtaatcccaacactttgggaggccgaggcgggccgaatcacaaggtcatgagttcgaa

SEQ ID NO: 6217 - DNA, 300 bp, Homo sapiens
cacattattccttttccatcggaagtggcgctcgtgcattcaactcgttcccgctcatggaacccctctttaaaaagacgcagggcacctgtgagcgcaggagcgagcctaaggcctcccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagact

SEQ ID NO: 6218 - DNA, 299 bp, Homo sapiens
  misc_feature 249, 253, 260, 264, 269, 270, 279, 283, 286, 290: n = A,T,C or G
aataaacccaagggcaagcctttgaatgggtccacagcttggtacaagttcccatgctatgtgcagaacgaggtgccccatgcagaagcctggattaatgggaccaacctagctgggcagtcttttgtggctgagcagttgcagattgaatatagctatccttttacttttccacctgggttgtttgcacgctacagtgtccagatcaacagccatgtggtgcacaggtcggatggaaaatttcagatncttncctatanaggnaaagnngctgtggtntggnagnatanatgacctag

SEQ ID NO: 6219 - DNA, 293 bp, Homo sapiens
ggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcatcttctctgagggctccgaggcatctggacggagagtggatgggctggcatttgtgaatgaggacatcgtggcctccaaggggagcggcctggtcaccatctgcctgtggagctggaggcagacgt

SEQ ID NO: 6220 - DNA, 208 bp, Homo sapiens
aggccagtgtgggacagggttgtgtaggtgtgcatttcaaacacatttattattcagaagtggtgcagataacgcttagattacaccgaagaatttagggagggtgggggatgaaggtctgttagtaaccagaaacacattagttgggcatcagtaaggggcaacataaaggaatggttcccctcaaaaacgaacaaaccaaatttta

SEQ ID NO: 6221 - DNA, 300 bp, Homo sapiens
gtgaactctgcacagtccttgtatattcattggaaaacagcagtgctctggaatagttattttttgaaatgccctgagcagttaggaaagtgatgaagggtgaagtgcggagagggaagaggtggggcctgatgcagtttgctggggttgcaaccacacactccctgtaaggcctgaagcagccagttgcatgtttctagttggaaggcagatagagctgtggaggtggtggcatgattaggtctggctgggaataaggttgcttggcagtgtattatttattcgctaactttggtggcc

SEQ ID NO: 6222 - DNA, 300 bp, Homo sapiens
gtttatgggtttacattgtcatgtctccacaggacaatgcacatggtatgtttgtcagaacccagttggagttttgtttcccagcatccaaaggaaatccctaactttcattttttcttcccgtaagcagccccgaacacttacttataagccatctctacctgaattagcaatcatggataagctcaataactgatcatttccttatcagtttaaaccatatatattttaacactgtctctttttcacacacactagttagctaagaatgagctggggggctgggcgtggtagttcacg

SEQ ID NO: 6223 - DNA, 300 bp, Homo sapiens
gtaaggtagaaaaattcctcacatgggttaataaaccaatggatgaagaagcatcacaggaatcatcttctcatgacaatgtgcacgacgcttccacaagtagcgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaagtgccagactcccgccagg

SEQ ID NO: 6224 - DNA, 300 bp, Homo sapiens
gtgtggagtgtcccaagcacagcaggcagtcagggtggccaatacaaggtgctggcagtgaagtgggggcagactgagcctgtgtagtgaagtgtcttgaggaacgtcagctgtatcttttaggaaaccaaaactgcatagacattgaacccaggcagaaggtcatgaagtcagagctaagaaatgctagtggggatagggggtgagatagagttgggaaatgtttcagagctacaggtgacagttgttggtgtccagttggatatgtaccatgaagggaagaagcagtcagagtgggca

SEQ ID NO: 6225 - DNA, 300 bp, Homo sapiens
atccctctttgcagaaaaggttatagaatgctgttctttataaccaaagaacttacataagacaacatttttgctgtccactcttttgtgtgaacatgtatgtttgactgcaagtttggtgccataattcccttggctaccaagccacgtgctgccattctctgtcctttgtttcataagcacactgagaaatctcacagctatattctttggtcttccacctgcccctccacctgctgacttgacattgtattataactgttgacaatgactggggtcctgactccacagttgcctgga

SEQ ID NO: 6226 - DNA, 300 bp, Homo sapiens
ttcgtcacgggtaattatgtgctggatcgagatgacctggtggaggcccaaacacctgagtatgatgtggtgctctgccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaag

SEQ ID NO: 6227 - DNA, 300 bp, Homo sapiens
ggtggagggaggcagccggcatggcatggtgaggaagggccatggaagaggacagaacctgtccacggagtcaatgctgaggaaggaagacggaggatgaggccagtcaggtttttcgtggtggcagtgccttatgtttttatcgaagtgtatattcacacagaaaagcacatctcccaggatcctgagagagcttgaaccagaccactgtggacacggtggccacccgtcaccactacccttcccaaggggagacgaggagcaagtaggcttgagggaaaagctgcacaggactcgtgt

SEQ ID NO: 6228 - DNA, 300 bp, Homo sapiens
atttgaggatctcgaccttgtccttccagcaggtgctcccaagccacctctgggcctgagaataggcatcacatgactctgtttaatcctccgacacagcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcga

SEQ ID NO: 6229 - DNA, 300 bp, Homo sapiens
cccgctgagtggcagtggcaggaagtcggtggaagcagatccctgtgcagaagttgaattaccagggcggccacacacgggctgcacaacctttgcagtcgtgcacggcaagtgggatgtggcctccgcccatgattgggcacctggtcaggctgggagatccaaatagcacccagtgggcagctgtccgacccctggaggggcaagccaggaaagaaacttagggcccgctgtgaccagatgtcccttccagttgggaagactaaactggtttggccaatatctcccaggattcccctg

SEQ ID NO: 6230 - DNA, 300 bp, Homo sapiens
ggtacctggtgcctctgactgcgcctctgcctttgccgcctggctcctggtggttcaagttccagaaaggtccgagggctgtaaggtccttagagaacctagaggctcctcctaggaacctttaaaaatgataccctgccctgcgttggagcctgtgaatttctttgcatgtgaggggccagctgtcaggtggtcggctgagccagggcagacccaggagcccagcacgccatcgcggaggcctttctgatggcacagtgctagccgttcctcctgcttctccgcccacttggccatgtc

SEQ ID NO: 6231 - DNA, 282 bp, Homo sapiens
aaaaagcctgccttctgctccccagggttgcttttcccaggaggtgtgagcctacctggaggaggcttaggcacagggatacctgctggaggtctgagcgttggttgagcacctcctgtttgtaggatcctgtgccagagcctgtggggaggtggagagaggctaggagacatagcccccacccctgagggatgagacagctccctgcaggcaggctgtgcccagtcatctcaagcctacagctgggctgctggctgcatggtctggagggcggtggggagg

SEQ ID NO: 6232 - DNA, 260 bp, Homo sapiens
  misc_feature 180, 188, 219, 220, 221, 223, 234, 244, 245, 251, 252, 253,254, 255, 256, 257, 258: n = A,T,C or G
agatacattgaactcttcaggagcacagcagctgaagttcagcaggtgctgaatcgattctcctcggcccctctcattccacttccaacccctcccattattccaggtactacctcagcaatttggtggcccctacaaatggttaaaactggattacgcccttcaaggctttccttatgnagccccanttgaggacatcctggatttcctgggggagtnnncncagatattcgnctcatggggnnccctgnnnnnnnntc

SEQ ID NO: 6233 - DNA, 300 bp, Homo sapiens
ctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatc

SEQ ID NO: 6234 - DNA, 300 bp, Homo sapiens
gacggcagtggggaagttggcacaaccttacaaggccacactcgtgtcatcagcgacttggactgggcggtgtttgagcctgacctcctggttaccagctctgtggacacctacatctacattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccc

SEQ ID NO: 6235 - DNA, 300 bp, Homo sapiens
gatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtga

SEQ ID NO: 6236 - DNA, 300 bp, Homo sapiens
tgtaggcacaagattttcttgctagcggaatgtgaaccaaaaagtgtagaggccaatcagtaaaaatattcaaagccagttttgttgttttcagcagttagtaactatcagtagatgaatatttactaggaaacattggtcttttaaccactttgggcatgcttcttatttagtatgttcatcatgatttagtatcatgacattcagcgaacatttattgagtgcctactgtgcactagggactagtaagcatgttaagtttgtaagctttgttgatttccaccacaaacccataggacc

SEQ ID NO: 6237 - DNA, 234 bp, Homo sapiens
ccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatg

SEQ ID NO: 6238 - DNA, 300 bp, Homo sapiens
ggaatatctaagcagacataaatagtaacatcagggcacttcagaatcttcatccgatttatatcttcataggtccatgtttctattttcaaatgtcctttatttcaaagcagcatgtcactaaaaaaaagaaatgggcaatcatcattcctcaaaagatacgtgcatttggttgggcaaaatcatccaggctaccagttggataataaaagtcgaaatgtactatttgattttttcctatgtttccaagcaagtatttctcaccagacactgcccccatcatatcccctttcctcttct

SEQ ID NO: 6239 - DNA, 300 bp, Homo sapiens
aatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgag

SEQ ID NO: 6240 - DNA, 300 bp, Homo sapiens
ccaaaaggcataaagataagtgagggatggagttctggaagttgtgtattcacgtaagatttactttcaggtattggcaaaaatcacagctggagtgcagattaagcatggtaggagggtggtgattggagaaggaatggaggggaaaaaggaaaaactacaaatcatgttaaaactgtcctcattgagttttacaagtaatatactggtcttatataccctttcctcctaccgtgggaaaatatcactaacttgtaataggattaaatgaggcaatacgtaagctttttagacattttc

SEQ ID NO: 6241 - DNA, 300 bp, Homo sapiens
gagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggaattaaaagccttag

SEQ ID NO: 6242 - DNA, 299 bp, Homo sapiens
gcacgcccccttttctccgccacttcaccagtttctgaaatccaacctcccagacttcacaggaagatagatattcttgagataatgaaaagtgatatcttcgcataccataggagaaaaggctgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagtt

SEQ ID NO: 6243 - DNA, 300 bp, Homo sapiens
gcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggt

SEQ ID NO: 6244 - DNA, 300 bp, Homo sapiens
ccggctaattttttgtatttttagtagagatggggtttcaccatgttacccaggatggtctcaatatcctgagttcatgatccacccaccttggcctcccaaagtgctgggattacaggcgtgagccaccacacccagccagttttcctattttctgaattcagaattgacttctctgggaaaactggagatgagaatctgcccagtgctctgctgtccagtcaccgccttttgaattttagttttggcaccaggagtaccgttagctttccccttcttctggcccatttgcgtcatttc

SEQ ID NO: 6245 - DNA, 296 bp, Homo sapiens
  misc_feature 194, 198, 200, 202, 203, 208, 211, 215, 218, 219, 225, 236,242, 245, 248, 258, 267, 268, 275: n = A,T,C or G
ctcgcagctgtcagagttggtcctggctgtggcgtccaaacagcttgagggaaaaagattctggctaaccacctcatctactactcaagttctttctgaaggagggatttcttcagttaaccatggacagtgaggtttctcaccacagtaacttgagtccaggttgagggggagacagatctgtggtaaatctntgantngnncatcntantgantgnngaaccnctcaggactcnttatgnaangancttgtgtgtnaaagaaccnntggagcngatctggagacctatatgtgt

SEQ ID NO: 6246 - DNA, 141 bp, Homo sapiens
ggaaggactacggatccgcaggaagaggcagttgggggccaggggcccagtagaggaggctgagctccttccaactcctcagaacctccactctatggatctggacctctggattcggctttctccctgggcactgccttc

SEQ ID NO: 6247 - DNA, 300 bp, Homo sapiens
ccgagatggtgacactgcactccagcctggctgatagagcgagactccatctataaaaagtaaaaaagaaagtcttcagtgaaaggagattcgccctatcagctatgaaagcacagaggggaggaacatggagtaggggctgcctgcagtcagatcctgccctcacaaccttgccagggaaacaggctcgtgggtacaaaggttgtgtgcctcaacttcctcatggaagcacgtgagattattttataaccatagagtggagacagtcagtatgaccaccaaacccaggagccatatatt

SEQ ID NO: 6248 - DNA, 300 bp, Homo sapiens
gtggttgtgccttttcccagctcgaacccctcaggcttctgcctggtgtgaagttcagattcctcaggctgagctgctcttgcctcagtttcccagcctgaccaaaggaagcaggtggggcctctgggataaagagcgtgtgctggcccttccctgtgtgccccgcagacacacactccaccccactccccatgccccagggcccaccaggctgacttctccgctgcttctgacgggctcccttgccctctgggttccagtcagccagcaggaggcaccagcaggaatcggagggtgaga

SEQ ID NO: 6249 - DNA, 257 bp, Homo sapiens
cccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttcccctttagctttagacccctt

SEQ ID NO: 6250 - DNA, 300 bp, Homo sapiens
gttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctc

SEQ ID NO: 6251 - DNA, 300 bp, Homo sapiens
aaagaaagcagcagagaaaaaagggagtggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaaactccagagctcccagaaccttcagtgaaagtaaaagaaccttcagtacaagaggctacttctactagtgacattctgaaagttcccaaacctgaacctataccagagcctaaaga

SEQ ID NO: 6252 - DNA, 274 bp, Homo sapiens
  misc_feature 155, 161, 163, 164, 167, 176, 188, 189, 190, 193, 194, 198,199, 200, 202, 206, 208, 212, 214, 224, 230, 231, 234, 238,245, 247, 248, 252, 253, 255, 265: n = A,T,C or G
catcacggttttacccagtggtgaaagaaggacggacactggatgccaagatgcctcgaaaaagaaagacaagacacagttcaaacccacccttggagagccatgtgggctgggtgatggattcccgtgagcacaggcccagtactgcttccatnatctcnannctnttatatggnatgcttactttnnnaannattnnntngttntntttngnatagctcttnggcttnnttntggnattgctntnntttnntnggttttgttntgttttttt

SEQ ID NO: 6253 - DNA, 300 bp, Homo sapiens
gcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacct

SEQ ID NO: 6254 - DNA, 300 bp, Homo sapiens
  misc_feature 287, 292, 293: n = A,T,C or G
cctacccatgtgttcccgaaggctgggcactgagctcccacacccagcatacagctcattactcacacaccctctgccgtctacagagtaattagtagaggaacacgcccttttctctggagatttccgccccagtcgtaccaactctttaacaaggaacaaaagtcaacaacttcaagtttcctgtgaggatgaaatccagagtttctaatgactaatctccatcgtcaaaagaaaaggcaaacctcagccccttcagacagctaatgccaggagaagttcatgantattnnaagaaag

SEQ ID NO: 6255 - DNA, 300 bp, Homo sapiens
  misc_feature 186, 188, 192, 194, 195, 200, 211, 213, 217, 224: n = A,T,C or G
ccgactagtaacatatatcatagcttccaaagtatttgtttacagaataccacagtgactaattaccagaacttttcttattctctctgagcaaaggaacctcatgggagaaaaaaaatataggtcatttttaatgtaagggagttgctaggattggaggttaagacagctatttacacttcatgnanggantnnctgangacctcacaangngttntctaggnatagagaaaggtgcaaatcttcttatcagaaacgcattataaatagaaaagaaactcttaaaagagattcttcaaa

SEQ ID NO: 6256 - DNA, 300 bp, Homo sapiens
ggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctgggatttggtatctatgttggtacgactcctggccttttatctaaaggactttggcttttgtaaatcacaagccaataatagacttt

SEQ ID NO: 6257 - DNA, 288 bp, Homo sapiens
  misc_feature 151, 156, 161, 166, 167, 178, 179, 180, 184, 191, 192, 196,204, 206, 207, 209, 215, 226, 229, 238, 240, 248, 249, 252,253, 254, 255, 262, 265, 274, 275, 276: n = A,T,C or G
gctggaggcattcgaaagggactcccgatgtggtgggcggggctgaaccctgtggcttctgaggtccctgccagccagagacttgtgtgagtctttgaatggcttcacatgaacaaaagagcatttctgtcacctttcctctagttttttncatcncaccnatctnngagctgaggcnnngttntttctcnnattntatttctntnntntttttnctctttttttnctnatatttttntntgttacannttnnnnaatttcnttnttttttttnnntcttctatcttt

SEQ ID NO: 6258 - DNA, 293 bp, Homo sapiens
  misc_feature 246, 252, 261, 275, 285: n = A,T,C or G
ctcaaaagtcagcacaacaagtggaaactggccaaccagtatgagaaattccacagtccaagggaaagagaagagtatagtgactgaggtgggtctctctgtccaacatgcaggcagcactccctcatcctgctcagtgagagaattcagggggaatagaaaagctgctgagagttggtaaagaggatggtcgagtgagatggtgttgacctccctggatcttatgttactacatcctggacctcnagaggntcatccaanctttttgaaagctnatcttcttgnctggttaa

SEQ ID NO: 6259 - DNA, 300 bp, Homo sapiens
gtggcgcagtctgagttcactacagcctccacctcccaggttcaagagattctcctgcctcaacctcccgagtagctgggactacagttgaaaaagatcatctagcaaagcctttttcccagctacatataaggaatttgaaagtcacataaaatggttaagaaaatgtgccaagattacctcagtaattctggtctgtgttctcaggagaccctggaaataaacaatgtgtcttctgtggcttcagcgtcacctagtgcaggctgccattcaacaaacgcattgtcaacagtcaaccaa

SEQ ID NO: 6260 - DNA, 265 bp, Homo sapiens
  misc_feature 135, 138, 140, 148, 154, 159, 161, 163, 166, 171, 174, 180,184, 187, 196, 199, 205, 206, 207, 210, 211, 212, 215, 217,218, 219, 223, 224, 234, 236, 241, 243, 248, 249, 252, 253,254, 258, 259: n = A,T,C or G
gccagattgaccaagcgccagagacaaaatgtggcacaacgagaaccccagccctgtccaggtggctccgcgcccagggcccaggcttagcagtgctccctgccctatcttttggaaattcttgcttttatggtnttnanctctttangccctnaatancnangtncttgntgngtgttncttntcnttgctgctnttnttttannntcnnnatntnnntttnngctagagctntngctantnatatnnttnnntttnntgtttt

SEQ ID NO: 6261 - DNA, 265 bp, Homo sapiens
  misc_feature 169, 174, 177, 181, 182, 187, 188, 193, 197, 198, 199, 204,208, 210, 212, 216, 225, 227, 231, 236, 237, 244, 247, 250,251, 252, 255, 257, 259, 260: n = A,T,C or G
atcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggtgnctganaanctgnnactgnntatcntgannnaagangggngnanggcncacccctgntnctgntcatnnttaaccntgntcnnnatntngnnctctg

SEQ ID NO: 6262 - DNA, 300 bp, Homo sapiens
gggttgagaaccaagggagtcagatcaaccagtcagatcaaccatgtggctgcaagacagggcagagaggggacgtcagccccaggcccctccacacctcatgtgcagttctacagcacgggcacaggcactgcctacacagagccaacctctgagcccagacccctccactgtaaaatgagaataagcactcaggatggttgtgaggattcactaacagactgagaagaaatggtgacctaggctggcacatgggacactccccaagatgctcctttttcatttccctcaagcccagag

SEQ ID NO: 6263 - DNA, 300 bp, Homo sapiens
accaactgatgacccaccagcctaatctggcccacaaccatgttctgttcggtccatgttctatttaaaagtatcttgaattggttgccatcatttaaactcaatcagactttgaaggcatggtccagccacacagggcctacattcccacatggcaactatgaaagggctccagcccagcaggggctgtcccggtccctgccacccccacttcctgtgcctcagatctggcccctgctacgtaagataaggacagctacaggtccctctgagcctaaacccacctaaccggactaacat

SEQ ID NO: 6264 - DNA, 246 bp, Homo sapiens
  misc_feature 165, 168, 170, 172, 174, 192, 201, 203, 211, 212, 213, 214,220, 221, 224, 226, 227, 233, 235, 237, 238, 239, 240, 241,242, 245: n = A,T,C or G
cctgatcctgccaacagcagttcaggccagccccacatggagcaagtacctgaggcccagccccttggggacttgcccatcctggaagtggaggagatggagcccccgccggttatggagtccttccagcccgcccaggctaccgccccgcttgactctgggtgnganangnantttttgtttttatcttangaattgggncnttttgtgnnnnaattgnnttnanntttttntntnnnnnnttnt

SEQ ID NO: 6265 - DNA, 300 bp, Homo sapiens
gcgaagcaggcttttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccag

SEQ ID NO: 6266 - DNA, 274 bp, Homo sapiens
  misc_feature 183, 189, 190, 195, 196, 198, 199, 203, 205, 209, 215, 219,221, 222, 224, 225, 226, 228, 231, 233, 234, 236, 237, 239,246, 247, 249, 252, 255, 257, 258, 259, 263, 264, 266, 267: n = A,T,C or G
aagagacgagcggcccagacaggcctgggaaggcccctctgccccgtcaggggtgaaaagcaaagctggaaggattcggagagggttggggccgtcttcctcatccttccttttctcggggctcccgtgggtaggtgcacttggagcaaccgggcctgcggggtgtgcgggggtggaggttgnggaggnnatcgnncnnggcncncccnggtacnctcncnncnnncnccntnncnncncttctcnntntcnccncnnntccnncnnctccctc

SEQ ID NO: 6267 - DNA, 300 bp, Homo sapiens
agaagactcttcccctgccaagaaaactcgtagatgccagagacaggagtcgaaaaagatgcctgtggctggaggaaaagctaataaggacaggacagaagacaagcaagatgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagag

SEQ ID NO: 6268 - DNA, 293 bp, Homo sapiens
  misc_feature 280, 281: n = A,T,C or G
gatggccaaaaatatagaaaaggataccttgcatgtcctgtgaaatgcaaaggaattctaaagtgtcattatgagttacctcatggaagaaagcaaaaggtgaatctatctagagtttgtggttctgactcacaagagactgatgttcatgctgaaggacgagtgtgacaggtggaaggatagagcaccgagaccacactctaaagggtaggaatctatgggaactattcagggagatgaaagcatggaatgaactgaagcttgcagactcgttgagtannaagcgcgtttta

SEQ ID NO: 6269 - DNA, 271 bp, Homo sapiens
aataccctcttcccttgcaatggcatagggacatctagaatatagagaagacagagacaatggaggaagagtaaagaaactgactatatgccttcttcatttcactgcaaggaaggccaagcagatttttgaatgaggtgtgagattgctgttaaattggactggcctggacattttaatcccttaaatagaggtgcaatgattaaagtgagatttgtcactaaaatttatggtatctgcccaagattcaggagtgatgttgggaggagat

SEQ ID NO: 6270 - DNA, 300 bp, Homo sapiens
cctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagcc

SEQ ID NO: 6271 - DNA, 300 bp, Homo sapiens
aagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaaagaaaatccagtcaggacagacagtggggagacaggtccctgccctttatttgcgggatcaatcagggactcccagaaaggaaggagaat

SEQ ID NO: 6272 - DNA, 300 bp, Homo sapiens; identical to SEQ ID NO: 2980

SEQ ID NO: 6273 - DNA, 268 bp, Homo sapiens
  misc_feature 158, 160, 168, 178, 180, 188, 190, 191, 192, 193, 197, 200,205, 209, 211, 213, 214, 216, 217, 218, 219, 220, 221, 222,223, 225, 227, 228, 231, 232, 233, 236, 237, 239, 244, 245,249, 255, 256, 258, 261: n = A,T,C or G
caaagtgtgactttgctagcagtttactcaacaatgggcatgtcatctagagttcccaagatttttaccatcctgcaacagcagtcataggagaatatgcctcaatcaaaatcaggctaaaaatttgtttcaattctgcgtgtgagctgggaccttangnctttctgntctctatttntnttttcttntnnnntctnttncattncgtnantnncnnnnnnnnantnntcnnnccnntnttctnnaatntttctnntnatnttaatta

SEQ ID NO: 6274 - DNA, 300 bp, Homo sapiens
agcaaatggtgctggagtgcggtggctcttaagagtctccacagtttgctagtttgaatcagggactggatttgttgtaatatttttgagtatttatggttgtgactcaatatatccttccttattggatacattgaagtctaactgagaatcgatatttgttccttggacttgagtgtgaaggaaagagaagctttaattactactacaacatgacctcaaagtttttcaagtactcaatgttgtgttttctttttaatggggctgtttgtgaagatgaggcattaggatgttgtgatt

SEQ ID NO: 6275 - DNA, 270 bp, Homo sapiens
  misc_feature 231, 254: n = A,T,C or G
caacaaaagtcgtgagtgatcagtgaaagctctgctgtgaaggtgacatttgataactggggaagactgttcaggtaatgggggcacatgtgtgtgcagaggcctgaagaaggtgctggtgtggcaagaatagccaagagactcatcactggacccgatggggagaggagtaaaagaaaaggtccaagaattggaagagatggcgggcaggtcatgtagggccttacaaanaatttgactttggctgagagggnagccgttaaaagggtg

SEQ ID NO: 6276 - DNA, 300 bp, Homo sapiens
atcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgt

SEQ ID NO: 6277 - DNA, 260 bp, Homo sapiens
  misc_feature 201, 207, 213, 214, 215, 225, 226, 227, 228, 231, 232, 234,236, 237, 239, 241, 242, 243, 244, 246, 247, 250, 253, 254,255: n = A,T,C or G
gttggcttccccgggagaggagtatgaggattaaaaatattcagaaacaaacaaaagaacacaaaaatgcaaacacatggtagggaattactactgcttattctcaacagtaccacagaaccagtgtttgagtgctggcaccatatgcaacatggggcatccgggctggagtgatccagctttttagattcattgtatgantcatgntaaggnnnaggagtcttnnnntanncnannangnnnncnnttnttnnnttacc

SEQ ID NO: 6278 - DNA, 300 bp, Homo sapiens
ccttggtgcatgggcctggagccctggggggaactgtgggaactctgagccgtctggccctgagggctcagcctcagcctccacatctgcctgttgcggtcctggctgtggggtctcaggataaggacatagccccctggaagctgggaaggccccacatcaggccttgcagtttctaacccaggaggtggccgacagcagtgcgttggggctgcctgtccctgcacacgaggccctggggggtgaatggaggctctccctgtttttgttagcattggaggcctgagcagggctaacgcc

SEQ ID NO: 6279 - DNA, 300 bp, Homo sapiens
agaaggacttcctaatccatgaaaaccatgtaaagtttgatcatatcattagctattggtcagacctattttgttgtttgagaaaaacagacacatggggaaaatggtgaggtgaggtagtgtgttgaggagctggaagtgagcagctcttaattttttcctcctgagactgagttcggaagaagagtagaccatggcatggaggtgggagagacaaggacagagttggggaggtcactgcctcacacttctgctcacaccgctgggtctggtggaaactcaaagtttgtatctaaaaat

SEQ ID NO: 6280 - DNA, 265 bp, Homo sapiens
  misc_feature 140, 141, 144, 149, 155, 162, 165, 167, 169, 170, 173, 176,196, 200, 201, 203, 210, 211, 215, 217, 218, 219, 220, 223,230, 236, 238, 243, 245, 247, 251, 253, 254, 258: n = A,T,C or G
gtcctccctcgtgggcctcccaaagtgctgggattacaggcgtgggctcccgtgaccagcctggaacgtgctgatgagcctctttttctcctgaaaccccggtgggaacagatggtggatgctttcaaaacgcattgaanntgnacttnaagacntgcggantgntntnngangantttttgagattttttttaanatanntntttttanntttnannnnccnttggaancagatngngtttntntnaaantnnattnaatctgt

SEQ ID NO: 6281 - DNA, 300 bp, Homo sapiens
aaagaatgaaatgtccaaacccttactgacaaattatacctgacagcagaatacacccacatctactaagaggcttccatggtttttactgctatcactttgattactccaataatgaaactattgaatctgtttcttagaagccaaggtaagaaagcagagaatagtctgccattgaactgatagcatctgttttataattatctggtgacttttctagagaagatgtataaaggctgtgttgtttcatgtacaccacacttgaatgattgcttcttgagttggattgtactccagtta

SEQ ID NO: 6282 - DNA, 300 bp, Homo sapiens
cttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaagataggccatagactcatctcccagcacaaaggggcattctatgaaatggtactggccctaggaggatttc

SEQ ID NO: 6283 - DNA, 300 bp, Homo sapiens
gcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacat

SEQ ID NO: 6284 - DNA, 300 bp, Homo sapiens
gtcctccaagacctgattcagcctttcacacggtggtgccactggtcccagggtgcgccggccccatctcctcagggcagtgggtggggaagactcaccactacccctaaaatgggaagagaccagggttccaaagtgacccccagtgggggcttcacacgccagggagtacatgagatgatttctgtggtccctgatacacagctttcattttgagagacacaattatttgagtatctagtaattcaagcctgggattcaaagatatcatttaagatgaaactgaatatttctcttctg

SEQ ID NO: 6285 - DNA, 300 bp, Homo sapiens
cctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaat

SEQ ID NO: 6286 - DNA, 300 bp, Homo sapiens
gtggagatgacccctgagaagttcagtgtcttaatggagaagctctgtaaaaaggggctggcagccaccacctccatggcctatgccaagctcatgctgacagtgatgaccaagtatcaggctaacatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccacc

SEQ ID NO: 6287 - DNA, 266 bp, Homo sapiens
  misc_feature 171, 174, 179, 196, 222, 225, 237, 243, 246, 259, 261: n = A,T,C or G
gacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacnaanatggncacagccttcctaacangcaggtcatctggccatgtctgtatngtnacttgttaaaangcttcngtnatattgattgatnanatatt

SEQ ID NO: 6288 - DNA, 300 bp, Homo sapiens
tcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagag

SEQ ID NO: 6289 - DNA, 281 bp, Homo sapiens
  misc_feature 104, 105, 113, 115, 120, 124, 126, 147, 150, 151, 152, 153,157, 165, 172, 174, 178, 183, 187, 188, 192, 197, 198, 202,203, 204, 206, 207, 208, 212, 214, 215, 220, 225, 226, 227,228, 230, 231, 236, 238, 243, 244, 246, 248, 252, 254: n = A,T,C or G
  misc_feature 255, 264, 265, 266, 268, 269, 272, 273, 274: n = A,T,C or G
cacactataaatggaagaaaaaaattaatagcttctgtttaatctgatgaatgtggcttcttttgccttcactatattgccctgtgaagctgctctttggtggnntatttatngnactgnctgntnttattttgcttattgcctttnttnnnnttgnctttatcncattttntngttnttttnttcnnttgnttacnntttnnnannnttcntnngtttnatttnnnngnntcttntnttaanncngnggantnnttttttctnnngnngannntttcttt

SEQ ID NO: 6290 - DNA, 300 bp, Homo sapiens
tgattgatgagggctgtcggccaggaactgatcgaggcttgttaattgcatttgtcaaatgcagggaaattgggaattagtgaaatcggagaagggggtttggaaaacaaatgactcgtgcctaaggaaattttttgcaggaaagtatctcaggagcccctgcagtcagggagctgctggtgtggactcagactacatggttgaaataggcaggagctgggcggggcacagtggctcaggcttgtaatcccagcaccagcactttgggagacggaggcaggcagatcacttgatgccagg

SEQ ID NO: 6291 - DNA, 278 bp, Homo sapiens
  misc_feature 113, 119, 125, 126, 131, 141, 148, 155, 180, 183, 184, 189,194, 198, 206, 207, 209, 210, 216, 217, 221, 225, 229, 232,233, 238, 239, 241, 242, 246, 248, 249, 257, 258, 260, 261,262, 264, 265, 266: n = A,T,C or G
gttaacagtgatgatgacagcgtgctgctggtacactgtatctcaggctgggatcggacccccctcttcatctccctcctgcgcctttccttgtgggctgatgggctcattcncacgtncctganncccantgagatcctntacctcnctgtggnctatgacgggttcctcttctgcacntgnnggttnttctnatcnttattttnntnnttagtnntttnctantttntgnntattnntnntatntnntataatcnntnnntnnnttcctattattt

SEQ ID NO: 6292 - DNA, 300 bp, Homo sapiens
agagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgc

SEQ ID NO: 6293 - DNA, 300 bp, Homo sapiens
cttgggcaagctctttatcctaagattcctcagtgagccttatagagttgctgcgagaattacatttgttcatgatgtcaagtgtctggtatgtagctaatgcttattgaacacatagtaatttattgaataattgtcatgatcactggatgagatatagccactgtggaggtaggcacaccagggttttagaggcttgggatcttgcaacaggattttcctcttgcctctccaaactgccctttgcccagatggcttcagcatctttttgcatccctgtttccttgtttggtgaacacc

SEQ ID NO: 6294 - DNA, 294 bp, Homo sapiens
  misc_feature 276, 282: n = A,T,C or G
ccactaacagaactgaagaaaattctaaacgaaatggcaaaaagaaaattcattttttggctctctgctctgaagaacccttgttataacgtgtttatagcatctttggtagatggagagagatcttttatgacaaagagtgtgatacaatttttttaatgcatatagggcattgttcttcctagagcatatttacataaattatctcatttggaaaacacaacaaccttatacttgtgtctgcattcgcttgggcattttaaaggtcggaagaanttgaancttttcaagagt

SEQ ID NO: 6295 - DNA, 263 bp, Homo sapiens
  misc_feature 213, 214, 216, 217, 218, 220, 221, 227, 228, 231, 234, 236,237, 238, 239, 240, 241, 242, 243, 244, 245, 247, 248, 249,250, 251, 254, 255, 256, 257, 258, 259, 261, 262: n = A,T,C or G
agttccctcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagcggggtgnntnnnanntgttgnnganggngnnnnnnnnnngnnnnnggnnnnnngnnt

SEQ ID NO: 6296 - DNA, 276 bp, Homo sapiens
  misc_feature 241, 246, 249, 260, 264: n = A,T,C or G
cctctccttccatgtcacaaactaacccacatcaccattttgcaaacatgcatccttggtctcaagttggcctaacaaggaaattgaacagatccattgaaaagataattgaaagcacatatcctcttggatcagaaggacatttagcatggtacctctgcatcattcatgtgttcattcattcatttcacagatccttcaagaataccttctatggcctagacactgttgcatgtgaagnccacnganaaccactattncaancgggaccccttt

SEQ ID NO: 6297 - DNA, 300 bp, Homo sapiens
ggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaag

SEQ ID NO: 6298 - DNA, 300 bp, Homo sapiens
atgtgcctgtaatcccagctactcgggaggctgaggcaggagaatcgcttgaacctgggaggcagaggttgcagtgagctgagaccatgccactgtactccagcctgggcaatagagcgagattctgtctcccaaaaaaacaaaaaacaacaacaaaacttgctaccacccagggattttctgctatttaaaaggtgaatttcttttctggtactaaactgtagctgcttaacttagtaaaggctgtgtttggccaggcctgtgccagaggctcacctggagtgctccacccactggcag

SEQ ID NO: 6299 - DNA, 300 bp, Homo sapiens
aagaactccatgttccacttagaggcttcagagtgcagtgccaggggtgccttcccaaaagtcctccctgcctgggtggagcgtagacagctcagcaccccacggggggcgttggagccagccttggttttgttgggtaaggatgttagaagaggggcgaagacccatagccactggtgtgaagggtctgctcttgaccgaaggctgcctccctctgggtgcagaccaggcaggtggtcccagtcacggtgccctggggccactgggtctgtctgccctcaggctccactagacacacct

SEQ ID NO: 6300 - DNA, 300 bp, Homo sapiens
ttttgcacaagacaggttgctgaggggtcggcaagcatctgacttgcccaatcccctggatatggtgagccccgccatgcttttattctgtatcgcttttgtctttattgctgctttcaacatttacgtttggttacagttaactattttcggagtgtggtgattgaagacaatttcatcatcccactgtactttttttttgagagggagtttcactcttgttgcccaggctggagtgcaatggcacgatcttggctcactgcaacctctgcctcctgggttcaagcaattctcctgcct

SEQ ID NO: 6301 - DNA, 300 bp, Homo sapiens
gccatttcttctggcctttacaaaaaggcattttgttatactacagtgtaaacctcatttttttcactccaaaaggtagcagcccctcttcttcccaccctggacctgcctttcactccctgggcacagagcgcatggtaccattgatgtttggtttattccaggatccaaggagctggttctgctggttggaccaaacctcgtgagccagccacccctgacccaaatgaggagagctctgattctcccatccgggagcagtgatgtcaaacttctgctgctggggaaatctcatcagca

SEQ ID NO: 6302 - DNA, 300 bp, Homo sapiens
ctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatc

SEQ ID NO: 6303 - DNA, 300 bp, Homo sapiens
ctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatc

SEQ ID NO: 6304 - DNA, 300 bp, Homo sapiens
gtaaggcctgccttttacacaccagttgtgtgtttgttagtggctgctggatgccagtccacaccctcaaacacctcacagtcccaaacggggtgctcctacaggtcccagggtcctgttagtggaagaaaggcagttccaggaagtcttcctctagccttcatgacaggaagtagttaatcctctgggaaatagacttgcagccctgggaagaaaagagttgttcctccttggggacatacaccatcatctgggctatttcatccagtgtctcttctttatacaggagctcctggctca

SEQ ID NO: 6305 - DNA, 265 bp, Homo sapiens
  misc_feature 243, 247, 248, 252, 260, 262: n = A,T,C or G
agtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtcttttttttgnttgnnttanacggagtnanact

SEQ ID NO: 6306 - DNA, 300 bp, Homo sapiens
ccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaatagagcacaccatggccacgcccctggaggatgttggcaagcaggtgtggcggggcgccctgctcctggcagactacatcctgttccgacagg

SEQ ID NO: 6307 - DNA, 294 bp, Homo sapiens
  misc_feature 270, 272, 273, 279, 287: n = A,T,C or G
ccaggatggaggtccgggcctgccccaagggtcccaccacagccagcgggctggcctcccaccccagcatccatacacgtaggcctgttgctgagggaaggccctctagggtcatctggtccaggggttctttgcttcagctgcacatcggctgcctctccaggaagcgtgttcaacacatggaatcagggctccacccagacctgccgaggccacactcctggagtatctgcatccaaagatctgcacgtttgtaaagctaaggggtgntnnttggantaagcttnaggtttg

SEQ ID NO: 6308 - DNA, 299 bp, Homo sapiens
  misc_feature 114, 115, 116, 120, 128, 129, 131, 136, 153, 161, 168, 172,173, 198, 201, 203, 207, 214, 220, 252, 258, 264, 265, 280,283: n = A,T,C or G
gcaagaccagcatctggacagtgggggctcttgagagtccccggcgccccccacaccaggttgtcctataaccctctcccctctgtggagacgttaatgccaaggggtgtgtgnnnaggnaagtcctnntntgcanccaagattgacagatanttctagtnacttccngggnntccattcttattttattccaatatnaananaatncaggttntgtcanattattaaggtgtgcttatctatattttaaanaatctnttacanngttttcttgcatctngtnccattcatgtcttaca

SEQ ID NO: 6309 - DNA, 255 bp, Homo sapiens
  misc_feature 221, 224, 226, 229, 246, 249: n = A,T,C or G
aatatccccaaataacatgtcttacatgtttggtaagacttactgtaccctgtcctagaagatagaagatgccctgcccttagaagacaaagagactgtagagctatgccttctaaatcttaagccactcttcagataatggatcccttcatggtcagcccaaacatctcaagaacttttaatttgtaccgtttgtctttttttccatctatttaataccncantnttnactttattattatgaanccnatatct

SEQ ID NO: 6310 - DNA, 138 bp, Homo sapiens
tgcctgcgagggctgccctctgcagagcgctctctgtgtgccagagagccagagacccaagacagggcccgggctctggacctgggtgcccccctgccaggcgaggctgactccgcgtgagatggttggttaaggcgg

SEQ ID NO: 6311 - DNA, 300 bp, Homo sapiens
agccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttcc

SEQ ID NO: 6312 - DNA, 300 bp, Homo sapiens
agctcattaacttaccagaggttttaaaatctgagaagcactcattcaaatgctttggttttttgccatttgtatttcaggagatgcaagcagcattgtatctgcaatttgctacacagtccctaagtcagctatgggaagtagcctctatgctctagaatcaggctctgattttaaatctagagggatgtctgccgcgagtcgtgtgatattcgggcctggtgtgaccatgtccacctgtgatgtcatgcttattgatgacagcgagtatgaagaggaagaagagtttgagattgcctt

SEQ ID NO: 6313 - DNA, 300 bp, Homo sapiens
agtagaatagtcttttatgaaataatatacttatggaaaatatatgactggtatatgattcctttagaggaagaaaatttcaattttcagattcaaaggaagcacccttcctagtctatatatatagtaagcggagaactagttttacagtgctcatttcaggtcttcagtaagtgtgtatgatgatgtcagaagtattcattggctcactttcaaatcactgaaaattcagccatgctaaggttggctattacgtgtattagcgtttccaagcgagtggtcttggctggggtgagattg

SEQ ID NO: 6314 - DNA, 300 bp, Homo sapiens
ggtagacagcttcaagtggtactcggtgggatacatgaaacatttggaccgtgacccggaaaagttgacgcaccatatgcctttgttttactgtctctatgagaatcgggaagaagaatttgtgaagacgattgtggatgctctcatggaggttacagtttaccttcaatcagacaaggatatgatggtctcattatactgtctggattactgctgtcacctgaggacacttaagttgagtgttcagcgcatctttcaaaacaaagagccacttataaggccaactgctaggttgtccta

SEQ ID NO: 6315 - DNA, 296 bp, Homo sapiens
  misc_feature 99, 101, 104, 109, 121, 125, 128, 133, 140, 142, 151, 162,165, 167, 168, 171, 174, 181, 182, 187, 191, 192, 194, 196,200, 205, 206, 209, 210, 212, 220, 225, 230, 236, 239, 245,246, 248, 249, 260, 261, 263, 264, 273, 274, 279, 286: n = A,T,C or G
  misc_feature 289: n = A,T,C or G
ctgcaaagaaaggaagatttttctttttacaactagatattagttttagaggaaggaaatagctgaaaaactaaatttgctttggtgaaatgtcctgtncngancagtnccttggcatacnacanctncaatnggggagntnttatacatnctctgacgctntantnntanggngactctnnatttnctgnncntnttanggttnnccnntngtctgttntcttnagtanaattangcntccttnnanngttggtgtctnntnntgcatatcnntttangcttttnttnatattta

SEQ ID NO: 6316 - DNA, 300 bp, Homo sapiens
  misc_feature 224, 238, 251, 260, 288: n = A,T,C or G
atttccctttgccctgccactttcaccatagggccttcttacctggcagaggagtgccttagataccagaagattggcagggaagaagggcagccacttcctggttaccatggagaagcttgtcatgctccaagcctgtgcttacttgtccagtagcaacaatgggaaactgtattatttggggtaggggtagaaccctgagggcataaagctcagaattccangctgcatctggtanaatcggcttggcnggggttcanctgctccctgggaggccttggcatactnaggctgctccag

SEQ ID NO: 6317 - DNA, 300 bp, Homo sapiens
gtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggact

SEQ ID NO: 6318 - DNA, 300 bp, Homo sapiens
ggagaagcaactgacgacagatgctgcccgcattgtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggatta

SEQ ID NO: 6319 - DNA, 300 bp, Homo sapiens
ctcaatctcttgacctcatgatccacccgccttggcctcccaaagtgctgggattacaggcatgagccactgtgcccagcccctcccttccttgtttttgtaaaataaagtcagagaaacttttccagctatagtcaactaatacacattgatttgaaggagtagaaactgaggagtttacataaaataacttctctgtgaagtattagtgagatgatcaggcctggggtgggagcttgaagagaggagtggataaagcagtcaaggtcaaacaggagtgagacagtgagcaggactgaa

SEQ ID NO: 6320 - DNA, 264 bp, Homo sapiens
  misc_feature 218, 223, 231, 237, 238, 241, 245, 248, 252, 253, 254, 263: n = A,T,C or G
accacgtcatatacagcctacaaagagctcttgactgtgagctcgcagaggcccagttgcataccactgccattgacaaagagggtcgtcgggctgttaaagcgggagcttatgctgcttgccaggaagcaaaggaagatataaagagtcattcagaaaatgtctctcaacatccacttcatgtagaagtattacactcagagattatggctcattanaaatntgctttgngccttnnttnctgnatnaatnnntttattttnt

SEQ ID NO: 6321 - DNA, 300 bp, Homo sapiens
gaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggt

SEQ ID NO: 6322 - DNA, 283 bp, Homo sapiens
  misc_feature 223, 251, 259, 272, 276: n = A,T,C or G
cagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatggnacggagctcatcccttggtcgtgctgtncatccaanccgatgtgcccanttcntgcttta

SEQ ID NO: 6323 - DNA, 300 bp, Homo sapiens
gggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaacta

SEQ ID NO: 6324 - DNA, 300 bp, Homo sapiens
gctgggtgcatgtgctaccacacccaattatgaatttcatcattagtttcttagtagagtccacatgtcctcagtagtaagttcatcagtgctaaatatttgaaggtatttctactgttttgtaaaagtaacttaagcctacctggtctgctatcttttgagtatttatactttctacgggcttgtaggtaaacataaaaagagaaaaaatatcccaataatacagtttttaaccttttatgataaagacatgcttagaatgctgttaagccttctgagatttaaccactgaaactaagt

SEQ ID NO: 6325 - DNA, 300 bp, Homo sapiens; identical to SEQ ID NO: 128

SEQ ID NO: 6326 - DNA, 300 bp, Homo sapiens
tccttttaggtaacacaaagttccaagtatgttacctagtttacagagtggtactcaagaagagaattaacattcttactgtaaaacttcattgataacaatagtctacttctagaaacagaaataagaattaaaaacagtgctatctatttgtactggtgagtgaattttaacttttaagaaaattttaatgtttaagaagaacttcagtgtatggagttacaagctatcctgaatatttttataatagaaagtattagttttcccagtgtggcagcttcttaataaaagaaattattc

SEQ ID NO: 6327 - DNA, 300 bp, Homo sapiens
gaactaatgaaaagtggttgtctctaaccttggtatgctttcagagcatcagggttaaattacctcaacttttggcaggtatactctaaagctattaagtatataatatgggctcggcatggtggctcacacctgtgagccacctagcactttggcagtccaaggcggacagatcacttcaggtcaggagtttgagaccagcctgtccgacgtggtgaaaccccatctctactaaaaatacaaaaaccgagcgtggtgggtggcatgcacctgtggtcccagctacttgggaggctgagg

SEQ ID NO: 6328 - DNA, 300 bp, Homo sapiens
gagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagcttaacagggggaacttgtccccatggtcagaggagacccagctgtcctgcacccccttgcagatgagtatc

SEQ ID NO: 6329 - DNA, 300 bp, Homo sapiens
agaaggctcttaagacactcaataaatatacttattgaattagtagaacttttcccatgtatctcctattactacattaggatctttgttcccttagtgtgtctttagcctgtgctctcacaagctttgtggtgtcgtgtggatcacaggatcgtttaagataaagatacttttagctctttaattctggtattctattattggtacagggaacccatacattatcttaatttcagagtaacacacgtctcggcatgggacagggggtgtcctaatgaaaagagggctaacaggtggaat

SEQ ID NO: 6330 - DNA, 300 bp, Homo sapiens
ggaagggttaatattctcatttttccctcctattctatctggagagatcataaaatacattacagttagagtcaacaatcaccacttgaagaaatctcttcaacacaaagcctgataaaatttacatctggtaaatgtctatttaagctactgcgaaacacatatacttaaaaaaaaaaggccttttcattgtctcaatgtcttgaaggctggagattgtaaagcacttccctaaagttcctatgagcaggatgaggctatttgcctttatagagctatagaactaataagcaatcaaag

SEQ ID NO: 6331 - DNA, 300 bp, Homo sapiens
ggacattatatgtctgaattttcacagtacctttaattaaagagatatctttaattaaagtagctctgtgaacagcaaggaagtggatgaggaaacagaaattggcagagtccatgatttgtccagattaaactgccatgagtgactgtaacaaaaattcagaacttatgtaactcaaataggtatatttgagaaataggtcggcacaggtcaagatgtgaaagcccaataaagctaggcagagacttggtaagataaaaaaaaagtgcctcaaaatgttcagtgacagtagtgccctga

SEQ ID NO: 6332 - DNA, 300 bp, Homo sapiens
ggtatcagaagccaagccagagctcaggtgttttgattcacagccctttataaccattatcattttgaatgaaaagtaaatcactgtttcttagtgatttgggcatgtttcctgagttaagggatctgtctgacatccgtggtaagccttgtcttaagtgaattgtgggtaaagacttgtcccagatggagtgggaggacatgaaggatgaggaactaccttcaggaccttccagtccataggcagaggtgggggaaattcacagaaaaacaaatgagttaaagggatactgcagtagtg

SEQ ID NO: 6333 - DNA, 287 bp, Homo sapiens
  misc_feature 279: n = A,T,C or G
gtacagcaggccttgatttcaacaataaaatcccgacctcccttgctgcgctgcactgcccccgggagctgatgggttggagactggaaatcagaaaacacacaatccagaaacatggtttatctggaacctaggtatataagatgccaagataagtcaaattcacagagacacattgtagaatggtgattgccaggggccacagaggagggcagaaataagttattcttgaatgagtacagagtttcagggttttttgtttttgtttttttttttttntttaaaca

SEQ ID NO: 6334 - DNA, 300 bp, Homo sapiens
cctcggcccttgcccagggtggggcctggccctcatcttgaccaaagctgctgtgtggcagctcggcctctctacgaccccatcttggtggctgcacacttttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttggagacaagccaacaaaccctgcactccaaaaaagcaaaacaga

SEQ ID NO: 6335 - DNA, 300 bp, Homo sapiens
gggcatgtacaccctgctggcgcgctgcgaggagctggagcgggctctgcagccggttcaggggctggcgcgccaagtccgggatatccgacgtactctggaggtgttggaggccctgtgcaagtgaccaggaggacaggagaggccggtcctggccagggcagggcccagcaggaccctaaggactcttcagggagtcctggtgggaagtgcccactgaggggaggcctgtgtgttggaggctcttccagatgcgttcagctggcccgtgcccactcgctgggccttaggctggtgtat

SEQ ID NO: 6336 - DNA, 300 bp, Homo sapiens
gggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaagg

SEQ ID NO: 6337 - DNA, 300 bp, Homo sapiens
caggagcatgttgcgtcgtcactagctgaatgagaaccttcgggtccaagtttcagcttgtgggtgttaacacctacaggcacatcgatccgattagaaaaagcagtggttgcaaaccttttcctggacggcttcctttccttgcctatattgataccttttcttctcggagatgtcgctccagtaaacctgcttctgactagctgcttctgaaatgttctggggcctcgaaccggccggtctggccacctcaatccagactggctgcacccgctgctcccgcgaggcctggattcatgc

SEQ ID NO: 6338 - DNA, 277 bp, Homo sapiens
  misc_feature 214, 224, 225, 239, 243, 246, 248, 254, 256, 266, 268, 270: n = A,T,C or G
ggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgaggcctttttccctctagctttaaaagggccgnttttgctggnntgctcaagggtacnaatnggncnttaatngnatattaccgnanantgcctta

SEQ ID NO: 6339 - DNA, 291 bp, Homo sapiens
  misc_feature 180, 182, 186, 188, 190, 191, 198, 199, 201, 209, 220, 221,223, 224, 225, 227, 229, 230, 236, 241, 243, 248, 253, 256,257, 260, 263, 264, 266, 270, 271, 272, 273, 276, 278, 279,282: n = A,T,C or G
atgaagtcagggcaggccggtgccctttttgggaggcaccaggcggggaggagttggcggagcaggtctggctgtgagccagcaccaggcaacccggcccttgtccagggacctctgctgccttctctctggggtcaggaacctcagaggaggtggctctggctactgcataggacgcantnactngnanntgccgtnntncctgtctnattttctgtanntnnntncnncccttnttttntnctttnctttnttnnganttnntnttcnnnnttntnntanttttattct

SEQ ID NO: 6340 - DNA, 300 bp, Homo sapiens
ctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggc

SEQ ID NO: 6341 - DNA, 300 bp, Homo sapiens
gttgatgagaagtctaaagcagtaatagtagaattacatttcttctggttttaatagtaattgttgtctgctgccttcttgcagtttaccctacccatagtgtgtaatgccattaaaacgaagtatagaaagatccattggcctggagaaaggttagaggtgtaggagtgtatgacatttagttcattgttcttactgggttcagcacattgcaccctgcgtgttatttgcaacttaaaagggtatagattaaaacttgtgctcagtgtaacaactcagtaccacaaaaatggtagaatg

SEQ ID NO: 6342 - DNA, 290 bp, Homo sapiens
  misc_feature 258, 266, 270, 271, 278: n = A,T,C or G
gttacatcaagagataaatagagtgaagcagaactagtggtgcggaccagctcgccagcaacagaagggtttgtagtcggcctggcagtggacagggaggttggctagaactattaccttaggtccgtgataatatccctgaatccaacttttcagaaagaaataggtaacatatttttcaccaggaagctttacccagacactgaacagaatggtctcagtgcactaatggaggctcagttaaagggttgtggatcncatggaanagannttctganttggatatttgg

SEQ ID NO: 6343 - DNA, 300 bp, Homo sapiens
tggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgcttta

SEQ ID NO: 6344 - DNA, 300 bp, Homo sapiens
tctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaata

SEQ ID NO: 6345 - DNA, 287 bp, Homo sapiens
  misc_feature 124, 130, 134, 156, 166, 167, 168, 169, 176, 184, 185, 188,189, 191, 194, 197, 198, 199, 205, 206, 207, 209, 210, 215,216, 220, 224, 225, 226, 230, 238, 241, 242, 244, 245, 248,256, 261, 262, 264, 274, 275: n = A,T,C or G
cttcagcgtagctctccacctctacccggaacacaccctctcacagacgtaccaatgttatttttagaatttcatggatttagttatacataccttaatagttttataaaattgttgacatttnaggcanattnggtcaatattatcattgaatantttgagacgnnnnggtgttntttttatnnttnnanggnttnnngttatnnnannatttnnggtnttannnaatngggggggngtnnannggnatattggngtgannantaattagggnnttttttgtgtag

SEQ ID NO: 6346 - DNA, 259 bp, Homo sapiens
  misc_feature 145, 148, 149, 151, 153, 165, 166, 168, 169, 170, 174, 176,177, 180, 181, 183, 187, 190, 194, 196, 207, 209, 210, 213,214, 215, 218, 222, 224, 225, 226, 230, 231, 235, 237, 238,244, 245, 249, 250, 252: n = A,T,C or G
agtcagcattatttaacactccccttaactgtctttgaactttctcttttaacaaaaatgtcaagtctttacagttgtaatatcaccatgtttcccatttctgttaatacttctatgaacccctaaagtattgaagggaactagntgnngncnagaggatcacanncnnntgtntnntanngncaanatntgcnanaacagttactngnnctnnnggnatgngnnncctnnagtntnngagccnntgcnntncatgttc

SEQ ID NO: 6347 - DNA, 257 bp, Homo sapiens
  misc_feature 150, 154, 162, 170, 173, 178, 184, 188, 190, 191, 193, 199,205, 208, 210, 213, 214, 219, 220, 221, 228, 229, 230, 233,235, 238, 239, 244, 245, 246, 247, 249, 253, 254, 256: n = A,T,C or G
agtgctcggctgctgccagctgctcccaatgtgccgatgtccgtgggcagaatgacttttattgagctcttgttccgtgccaggcattcaatcctcaggtctccaccaaggaggcaggattcttcccatggataggggagggggcctgtnacgngctgcagngacaaacntangccgntggganttangnntntttcantcattntangntgnnataannnccataannnctngnatnngtatnnnntnactnncnt

SEQ ID NO: 6348 - DNA, 300 bp, Homo sapiens
caagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactc

SEQ ID NO: 6349 - DNA, 300 bp, Homo sapiens
gctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagact

SEQ ID NO: 6350 - DNA, 300 bp, Homo sapiens
gggaaaacaaaaggtaataggaggggtgctgggagaacaaataggaagaaaagggaaaacccagaaatagtaattgttagtacccctgctacttgactgttgaaaatgctttaaaagtttgttctgaattaggagaaaaggcgctccctcaaccaggctgaaactaccaccagtgttgttgccagaaacctggagcaggaaggagctgcttctcccctccgccttccagtcacccaccattaatacctgctattggcaaggcccatctggatggcagatggcaaagcagcctggaaagtg

SEQ ID NO: 6351 - DNA, 300 bp, Homo sapiens
gtttgagctcttgagccagtgacttccctgcacgttcagctttctcctttgtgaaatggtaatagaagcacgctgcacttgggattcttgtggattacatgtgagggtcttagaaacacttgatgtgtaagccaactattatgtattactgtatatggaacacaagggatgtagccaaaactaaatgcaagtttgtgcctcagatgtcttcctatcagaacagagtcaaatccagattttgatgcttaaatgtgacagcttattcagatttagaaaaacttttggtatgggccaaagaaa

SEQ ID NO: 6352 - DNA, 275 bp, Homo sapiens
  misc_feature 213, 216, 244, 245, 252, 255, 256, 257, 258, 260, 265: n = A,T,C or G
agcactgtgagtgaaaataaaaccaggagcagggttagcatatctggattttagtctgagctctttgtcaaaaaagtcctgggcctcagtttctttattactgaaggagagaatcaactctgtgattctaagttataaaccaccgttattaaagttctactggagccaaaactccaaattgttctgtatattaaaacttttcggcagggcatngtngcttacacctgtaatcccaatactttgnnaggctgnggnnnncntatcncatgtgccca

SEQ ID NO: 6353 - DNA, 300 bp, Homo sapiens
ctgttcactggcacacaatcacagtgtcttgatagtttttctggttttgaatttctggaagggaaatcctccttctgaggagacttcactttccgtcagtaatggggaaaactgtttccctcgggatagcagaggtcattttaaaagagaacactcagcagaaatgaaaatccaaacaactgatttttaattcgtgtctctttgttcagtgatgttggtcctgattctgcctatgagacgggaataaagagagatttcgggaaaagtgtgaagccaaacatgggtgctatttaaatacca

SEQ ID NO: 6354 - DNA, 300 bp, Homo sapiens
gtttctttcccatctgccttttcctgtctttcagaacatttctggggtgttgtttgggctcagcactgtgggaagtgaagcatttagcctagccagggactgggcattatctgtcagattaccaaatcttgagttatctgtggtctacaaaagaaaagaaggctgaaggaaccagacagagggacagtggcctgggaacagagccaagatgatcatgttttttaaccaaagcctgtagatcaccgtcaagaaaggaatttggaggataggagtatctacatgtagtgggggaggtgtggg

SEQ ID NO: 6355 - DNA, 300 bp, Homo sapiens
ctttacatcatctattctacctccattcactggtcaaagaagcgcagagttaagttggccagtgtggcgtggacacagccaggcgcagaccctcctgccagcgaagccagcgtgaggtctgttggctcaggggtccagtccctgggtccccgaagaggtaagccaaagacatagtgatacttggttcaattcggctccagagagtatcagatgggaaatagatgacttgttttacctggtcaaataagacatcactaaaatctaccatgactggaaattacttaatgcaaccagaggaga

SEQ ID NO: 6356 - DNA, 300 bp, Homo sapiens
gacatttccaatagctcctttgtgaatttccagatatgggattttcctgggcaaatggactttttggacccaacctttgactatgagatgatcttcaggggaacaggagcattgatatacgtcattgacgcacaggatgactacatggaggctttaacaagacttcacattactgtttctaaagcctacaaagttaacccagacatgaattttgaggtttttattcacaaagttgatggtctgtctgatgatcacaaaatagaaacacagagggacattcatcaaagggccaatgatgac

SEQ ID NO: 6357 - DNA, 300 bp, Homo sapiens
  misc_feature 204, 205, 207, 208, 211, 223, 228, 253, 255, 260, 264, 276,284: n = A,T,C or G
cagggatgtgaggctgctgttgggggtggggggaggggaatgggcaggcaagccagtcttctgtcttcctttgctaacttagggttttgagcaggttggggtatggtgcctgacatacccacctgccaccctgggaacctcactgatctctctttcagcctacacctgctgatccatgatgtgtgtgaattgagggtgtatganngnnctncatcaaccccanagatnaataattcttctatcaataatcagntnttacnactnaatgccattcgnattcttgntattcacaaaagatct

SEQ ID NO: 6358 - DNA, 300 bp, Homo sapiens
gcactcggtaaactctgggactggagccaagagactgtgagaaatgacctttctcatcaagtttgtcccaagccaggcttaaattgatagatcgtctaggttttctgatgctggtaaagagactctgtgcctcagggacaggtctgcaaagatcattaagaaacagattaaaattagggagcaagacaagacaagagaaagtttctttacgttctcccagacctctctgggcctataggcagatcaaatttggcctctagatcagcttggacaaaatgatgtccacggtgtctgagtagg

SEQ ID NO: 6359 - DNA, 300 bp, Homo sapiens
cagaggtgaagtgatgtgttcaaagtcacacgtagaacaagtggtggaacagacccaaccagtctgatggcagagcctgcctctgaccactacactgtcctgccaactaagcaggtttgaaagagctctcttagtaaaagccctgcaggcgggagtgagcagaagttgttggtatcccagtgactttttgaaatgcacaggataagggagggtggattttccaagccatggtaaggcagcatgacctgacccagggtgagggagagggttcatgatgtaaacctcagagtagctagtcac

SEQ ID NO: 6360 - DNA, 300 bp, Homo sapiens
gacacccagaggcagggcatcgagcgcctcaaacgaaagaaccagcccagggagcacatggggagctggcagtcagtaaaggagacctttggtggggacttctccctgaactggttcaaccccttctccagaccgtgtcagccagagatccccagtgacaaagacatggtgcggcaggtgacatcgctgtcagacaccgaaacaatggaggatccatcagaggagacaaaggacgaggactctgtggaggtgacagatgaatagatgctgctgtggggagagaagcaaacactaaaaagt

SEQ ID NO: 6361 - DNA, 300 bp, Homo sapiens
ataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctacggagggtgagagcagaaactcttaagaaatcctttcttctcc

SEQ ID NO: 6362 - DNA, 283 bp, Homo sapiens
  misc_feature 270: n = A,T,C or G
aggatccaatactgcctttcaataatataccaaaatactagttttataaatgttgttaaggtggactggaaaaactaatacatattttgaagtatttctctgatttattgaggatatgatgggcaaaggcaagctttctcgtaggtattatgagagcagacagatattttagtgtgtttgttgacatgagagagtcattggcagcgcagggaatagagagggaggactggtctgattatctggcaatgggaaattgagtttagtacgganaattgagaggata

SEQ ID NO: 6363 - DNA, 154 bp, Homo sapiens
gaggaccgtccctctcctccccctttccctctttcggaaaggggtttctgcggggcccgggagcctcggagtaccgaacctcgatctccggggcggggtccttggtggggactgaacgccccctcccggggacgggcggactggccgcggagta

SEQ ID NO: 6364 - DNA, 300 bp, Homo sapiens
tgagtcttcaaaaagtatcagaagagaaccaaaatgctttatgacaacagcagagcttgagcatcttgagaaccaactttgcccaagaatattgattagtagtttctgccatggtcacaggaaaggagaatttagcattttgtgtctctgtgtgtcatacctgaataagagtctattggtgcaaaagagcatatccaatagtgatattcataaaataagtgacgcaaaatagtccatgcaggatgggcacagtatttcaataaaatacaggtagttaagtaaaggtaatttctagttgag

SEQ ID NO: 6365 - DNA, 294 bp, Homo sapiens
  misc_feature 184, 187, 195, 225, 228, 235, 237, 241, 244, 249, 260, 264,267, 273, 276, 287: n = A,T,C or G
aaaacaagggaacagtgtgtaaggaacttgtgcacatcactgactggtaccccactctcattttactggctgaaggacagattgatgaggacattcaactagatggctatgatatctggtagaccatagcgtgattgttataattttatacttttatagagcacttgataataaatgtatcctnatntctatggnttttatccgtacaagtgtgctgcattctantgntacattntnggtntanctatnagtaccttatnatantcnttcttnttntcataatttgntttctga

SEQ ID NO: 6366 - DNA, 294 bp, Homo sapiens
  misc_feature 245, 249, 251, 257, 262, 280, 281: n = A,T,C or G
accgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtnctantncttggnaacanatggcctgtggtaatgtnncttctgattgtgg

SEQ ID NO: 6367 - DNA, 300 bp, Homo sapiens
  misc_feature 206, 207, 211, 215, 216, 220, 225, 229, 234, 247, 248, 253,267, 268, 270, 276, 281, 285, 287, 291, 292: n = A,T,C or G
ggaaatttgggaagaatccaagaagtataggccaatgaaaacaagttattaatacaaatagtactgtatatgagagtacacattaggaatgctgtgctttaatgcataaacatgtttacagtggtccacatgtgccaggagatgtgggaatggctacccctgaagtcatatggagaaatggggtcctcatcgcacaccatacacanncatnatcnnacanatggnttanagacncttaagacctgannccaancaaacttctaggannanactcanggtanagcncnatgnnatttgttt

SEQ ID NO: 6368 - DNA, 299 bp, Homo sapiens
  misc_feature 243, 244, 248, 265: n = A,T,C or G
gcacgcccccttttctccgccacttcaccagtttctgaaatccaacctcccagacttcacaggaagatagatattcttgagataatgaaaagtgatatcttcgcatactaaaggaataaaggttgaggtatatatgatttttaactgtattaggggtgtatgaaccagtttaaaaacgaggttttatttactgtacagatgaatgcaaatcagaaccaatgatcccttggcctacttagttannaccngttcatacatcccttanggcttttattattattattattattattacagac

SEQ ID NO: 6369 - DNA, 300 bp, Homo sapiens
cccacacctgcctggccaacccctggcactgatgatgcctgggtgcgggttaagctgggaggagctcctgcctgcctggatgaagaggaggtcaagactttgtcccccactccgcaagataccctctctgttccggagcggtgggtccctcccctgttaggaccttgtctccctcaggactggacctggatcctgggcctgcagtcagattgccagtttcacttagaggtggaaatgtcaacccactggttggaatgggaagctgctgtgttgtgagccaccttatggaaaacccatgtg

SEQ ID NO: 6370 - DNA, 300 bp, Homo sapiens
tgtctttatttttttatatctcctaaagtaaaatctgagaatgacccaagaatatttgtttcagagggttgtctttttgttggcaagcagtgaagcacatgtaagtttctcaagctttagaatatatatatattaaaaaacaaaacaaaaaaaatgaagcacagacatgttattttcccagagccatcagtccaaagtatttcactgtattattagaagcaacaacttctaaacattcaactattccaaaaataagattttcctccagtaagttatcattctcacttgataataagataa

SEQ ID NO: 6371 - DNA, 300 bp, Homo sapiens
attcgaccctggtgaatgatgcctataagaccctcctggcccccctgagcagaggactgtaccttgtaagctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagaaagaatttactgacaatgtgagcagtgcttttgaacaagatgactttgaagaagccaaggaaattttgacaaagatgagatact

SEQ ID NO: 6372 - DNA, 300 bp, Homo sapiens
tatttactctggaaagtagtagcagcacttcaaggacataggggttgctcatgtcagttgtttctgtttgtattggaagaatcataataacaaatatttaagttggtaaattactaggtaaacaggttggtggattttttgttatttttgagaatactttttagtttgattctttgaatgaatttacataacagctttcctgtcaagtcagtaatttcacccatctttaaaaaacaagtaccaaaagagtttcttaacaccatatactcctctagcagctgctgcctagtttctctcctc

SEQ ID NO: 6373 - DNA, 281 bp, Homo sapiens
  misc_feature 265, 266, 267, 269, 271, 272, 273: n = A,T,C or G
gggagaagagccgccagcggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctaaaaaaaaaaaaaaaaaaaaaaaaaaaaaaaaaaaaaaaaaaaaaaaaaaaaaaaaaaaaaaaaaaaaaaacnnncncnnntaaaaaaa

SEQ ID NO: 6374 - DNA, 125 bp, Homo sapiens
ggagagcagggcaagggctcttgggcatcacatccagaggctgagggaggggagacctggctgtgttcgtggaactgaaggaccactttcgcgactagaccttagccagggggaggtgtgggagg

SEQ ID NO: 6375 - DNA, 254 bp, Homo sapiens
  misc_feature 164, 166, 167, 172, 174, 180, 183, 184, 189, 190, 191, 194,198, 200, 204, 205, 210, 211, 212, 215, 217, 218, 219, 224,225, 236, 238, 240, 241, 243, 248, 249: n = A,T,C or G
ctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggtngnnttagngnattatncanntgatnnngangaanancaannaaatnnnttntnnngaatnngtttttttaanananngnttctnnttaaa

SEQ ID NO: 6376 - DNA, 300 bp, Homo sapiens
gtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacgga

SEQ ID NO: 6377 - DNA, 300 bp, Homo sapiens
gctttagctgttagaaaggaacccccgtgacatgacacagacacacgtgaacacccagcccgccggtcctagcagccagctgtgaaagctgtgtcaagtcacgggggttcccgtgtgtctgtgtcatggatgcaatgcgggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtcca

SEQ ID NO: 6378 - DNA, 300 bp, Homo sapiens
  misc_feature 278, 282, 293: n = A,T,C or G
atacatggaagtctcaaatctgaatttttatccatctcaatatgaccatttctctctgttgggagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccancagntcaggattacngggtata

SEQ ID NO: 6379 - DNA, 300 bp, Homo sapiens
  misc_feature 228, 242, 245, 253, 262, 280: n = A,T,C or G
gctgcttcggggactcagccagaaagctactgaggtgctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacngtggaggaggcagncanggccaggnacccagagncgtgcccaggtctttcancaggtggcctgctgcctctt

SEQ ID NO: 6380 - DNA, 300 bp, Homo sapiens
gctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgacttcagtctagcgtttccttggtgtttttaggttgctttggtaagtttaggtttgctatatttctgattgcttagaattttgttttagccctttaaaatcagatcataaatatgaattcatacttctaaggaattttcttgctataagct

SEQ ID NO: 6381 - DNA, 286 bp, Homo sapiens
  misc_feature 139, 141, 153, 162, 164, 168, 170, 171, 173, 176, 180, 190,191, 192, 200, 202, 209, 211, 215, 217, 223, 230, 231, 233,235, 238, 240, 243, 245, 246, 247, 249, 253, 254, 260, 265,266, 267, 268, 269, 270, 271, 273, 274, 278: n = A,T,C or G
atctgtatatctttccttttgtttacaactgttaaaaaacctcaaaatagctctcttcaaaagaagagagattccaagcaacccatctttcttcagtatgtatgttctggacatacttatcggagcgcgccagctaagngntcaagcatatanacattgtcngntggnanngnctngttnacagccactnnngcattggntncacgccncnggancncggtgnggctctnncncntantnccntnnntntgcnnttaccncctcnnnnnnncnntatntggccttc

SEQ ID NO: 6382 - DNA, 300 bp, Homo sapiens
ccaacctaaaatatcattattttcaatacttaaatattagcccatcattttttatcttcagatgtctataattggaagcctatatagaaatggttgatgagcctatcggttgaaccactgcagagaatagagtgatggtcttagggcatcctgtactttgcatgctcctcctggaagtaaagagtaagacagagaatagtaataatcacccattccagaactggttgcacaacatcacaaaagcttgtccagacttattagcaagttaataaaaaactagacttctttctaagtacttat

SEQ ID NO: 6383 - DNA, 300 bp, Homo sapiens
ggtgggtggcagagggaaatccaacatgcagactgtggcagtgtcttgaacttctgtttattcaggtcattgaataagaaactcttttcttctgcattcctgtctttctgcatgtgtgtgtgtgtgtgggctgggtagggactgtttttgagatcactgggctgaaatgtattctaggggtgaaggatctaggatgtacctgctcgtcatttcctgacttcaccttttaccaattcttttcttaacaaatttaaaattggtcagagcaggagctgctagctggctttttaacagtgtttc

SEQ ID NO: 6384 - DNA, 300 bp, Homo sapiens
gtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaatttagaaaagtccaatattgagcttgattgcaaacttagaaaaactcaagacttctc

SEQ ID NO: 6385 - DNA, 300 bp, Homo sapiens
aagggaagcattccaaagattttcactgtttatgttcaaattacaacatgtgcagaaagttgtgcaactgaaaatcctttcaaacaacagctacaaaagagattggtcagttaggacaggaatagaaagtggaaacttagaagactggctactccttgtgtatgattgctggggtgagtctgtgctgagaactttttacaaagggtgtcctttgctgatatgagaggggggtgtcaaacttttgagtgatcactgtgggtcctcagcttagacatcttctctggcccaagatggcacccc

SEQ ID NO: 6386 - DNA, 300 bp, Homo sapiens
ttgcttcggtcactagcccaggagacatttccccacccatagacctagtcaagaaagagccttatgggctttcaggactgaaaagagcttctgcttcttctctcagatccatctctgcagctgaaggaaacaagagctacagtggatctattcaaagcttaacttctgtaggttccaaggagacacccaaagcttcaccaaacccagacctgcctccgaaaatgtgcaggagattaagactagacactgcctcaagcaatggctatcagcggcctggctcagtagtggcagcaaaagctc

SEQ ID NO: 6387 - DNA, 300 bp, Homo sapiens
cgcgctttgaaaaaatgagatcagcaaaacgcaggcaacagacctaatacatttcaaaacttgatatttcattttgcgttttagctagagaagttttccttgtgacttactaatggctgcaatgccaatgattgtaagaaaacaaacaaatttatcatgaaattctccttgtcattttataaatgcctattttaacatcatttatggttccagagatgcatacacttttttctgacaagaaaaagtaaaaggtgatgagggcaattctgtcctactgtttttacaggcctttttcaaatg

SEQ ID NO: 6388 - DNA, 300 bp, Homo sapiens
ctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaa

SEQ ID NO: 6389 - DNA, 299 bp, Homo sapiens
aacaacaaaaatctgaacagaaatgctctatttacgttcttttccttatctgtagtgttttaaagtcattaaacttaaaaatgatgttcaggagaagatgagtgtatttgcatagtctgtcataactctggtattattttgtacaaggagtgtgttagggttttcagttgtaaccatgcagaaaatctacaaaataaaagcagttgttaattagtcctttacaatcagaattgtctattttggaaatttatgaagtacttcagatgtaatttaagaaattgtatttgagccaagcgtgg

SEQ ID NO: 6390 - DNA, 300 bp, Homo sapiens
attagaccaaaaaaatgggatgcgtgtgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaa

SEQ ID NO: 6391 - DNA, 300 bp, Homo sapiens
gtaatcctttctttttcttctccctctttcctgctcttacttatacagttaggtgaatatgatgctccacttcccccacagatactcaaatagctctgactgctgaaatattggtatcttactgtcagcacataacttgttgctgtgttattgacattttcactgttttgaaatttttactgttatctgggtttgaatcccagctctcccaagcttcagttttctttcatttgtcaaatgagataaaagtatccacttcatagggttgttatgaggattaatgatgaatacaaaacactt

SEQ ID NO: 6392 - DNA, 300 bp, Homo sapiens
gtattcagtaagtaccaactatggtgctaacgtgagttcgatacgaaaaaagctgagattcatctatatccattttagaggaaagaagtgctatgacctttccaaactttcatttctctatcccaaagtctcatctaaacagattttactactttatgatctatgtttaaagtccttgggataaaaagaacaaacccaagaatgaggagtcttacttctacacttttatgatttcttatattggcattagacataaacatgtctgagaggctgtctggtccaactgtctctggtcacttc

SEQ ID NO: 6393 - DNA, 286 bp, Homo sapiens
  misc_feature 74, 77, 78, 81, 83, 90, 91, 93, 100, 108, 121, 131, 144,145, 152, 161, 224, 248, 249, 255, 258, 261, 263, 265, 267,275, 278: n = A,T,C or G
ggccctaatacactctttgccctgtggcctctcccttttccccccttctggttggaggagggagaagtggcaantgnngcncncacagannanctgactngttgactnccttatgctaccntgggtgactncatattgcccctnnatgattncaacaccanatatagcaaatgacatttacatgctatgaaaacatctattgggtaaaatcagatcttggatanagaaattctcgacttttatataannttttgntanacngnananacagaaanggnttaagtgg

SEQ ID NO: 6394 - DNA, 166 bp, Homo sapiens
gattcatcttcttgttctttaaaagtcaaaaggctttttgacctttaaataactcttacatctggtcatcactgttgaaatgttctactaaattttcagagtggaaaagttttaggcttaaaactgactggtaaaaatagaatatttctttgtattgatttttcag

SEQ ID NO: 6395 - DNA, 300 bp, Homo sapiens
tgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaag

SEQ ID NO: 6396 - DNA, 300 bp, Homo sapiens
gttaaccttttcaggctccaccatacccaggctcttaccttagcagaagcctgtgaagctggtagcagaaacgagaaggaacaaaattaactccaaggcagtaagccatccacaagaccactacacgaagttaaggctgtgtgaaagagggagtttatttaattttattgttaaagaggcaataaaatatctagagaaacagtccattaaaaaattggcaaatccagcctggccaacatagtgaaaccccatctctacaacaatacaaaaattagctgggtgtggtggcgcatgcctgta

SEQ ID NO: 6397 - DNA, 300 bp, Homo sapiens
cgggagtgaaggcgcggaggcccgagaaaggataaacaagacaccgcctcatcagataagaacgtctccttcgatgtcacggatttcaagaggtagctggagaaactgacgtcaggagtgtcctgtgaatgaacatcgcccgaggcctagcacccacagaagaagggttctattttactctactttgcttgatattatttattttctaacaaagtgatccgtagtctgcaaccttaggctctgacaggcaaagcccatttcttagctctggggatggcttgcagggtctccacctctgtc

SEQ ID NO: 6398 - DNA, 300 bp, Homo sapiens
gagttggtcaccgtggcccactatgacagccccgaggccctgagccacctctgctgccgcctggtcagtaggggaagcaaggtgaccgcaagggggtatgatcagcagcccacttgttccagggttcaccggggcccccaaccgtttctactgcagccaaaccagataggctactggtggggcaagtccaaggtctccgaccatgccacctgccctgggggctcccctggaaccccggcccctggattcagctctgcagcctcctccgcactcaggatcagccctcctgtcctgcactag

SEQ ID NO: 6399 - DNA, 300 bp, Homo sapiens
gatacctgtgcctgacacatctgggcaaactgtggcactcaaagcagatgagaaaaccatgaaagaatccaggaggaaaacagatttctcacgaaggaaaggcgattccatggacagctcccttcttagtaggaactgtggaaaccagaagtagctttaaagtgctgggataaaactgtctttcaaggataagagtgaaaacaaagacatactcagacaaaaactgaaaacatttaccacaaacaaactcaccttaagcaggcaaatggccctcgatgtggaaagcaaagctcaggggac

SEQ ID NO: 6400 - DNA, 300 bp, Homo sapiens
cctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctggcttctccgccacccacacccttcccaccctgctgtggggccctgcctttgtggggagcagccagccctctgcccctgcccagggctccccaactataggcctgggacccccgccc

SEQ ID NO: 6401 - DNA, 300 bp, Homo sapiens
tgttatttctcagcacgtatgtagcagatgaggaaatgaaggctaaaggtcatatatctacaaagtggggaggtcagactttgaacccacaacctgactgtggagccacttcagtatactctctccccataagaaagttccaatagaaaaaaaatgctacttaagtagggaaatcacaaaataagtgccaatgaacaataaatgttcaacctcactacagttaaaatgtatattaaagcaagagttgagatgacacttttccttataaaacagacagggattcagggacattgggactct

SEQ ID NO: 6402 - DNA, 300 bp, Homo sapiens
gccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccc

SEQ ID NO: 6403 - DNA, 268 bp, Homo sapiens
  misc_feature 191, 217, 230, 247, 256, 262, 265: n = A,T,C or G
aaaaagcattcaacatgcaaataggtggtatatgttgatatcttggcctgactggctgctaatttctgaatcaatctgtttgtgcatttaagtcatttattctctatttcaaaaagattgaatctattaaagtcttaagatctgtcttccattataatggtgaaagattttgaccagataagggaaaaganaacacaacagcttgattttgggaacncagatcttctcanagggggccactttacanagagattgntcaccnatngca

SEQ ID NO: 6404 - DNA, 252 bp, Homo sapiens
  misc_feature 159, 171, 180, 181, 193, 204, 210, 212, 214, 215, 216, 218,219, 220, 224, 225, 227, 236, 244, 245, 250: n = A,T,C or G
ataagacaccaaatcaaagtggtgatagtaaatatcattgccttggttctcacctcagagactagtgtttcaccattaagtgtgatatagcttagttttttataaatacttgggagtgaatttttaactgggtcatagaggattgttggatttcagcangtagaaatcagnggaaattanntctccagacacngggaagagacnctagtngnannncnnntggnntnctttggctntagattannggganat

SEQ ID NO: 6405 - DNA, 268 bp, Homo sapiens
  misc_feature 154, 155, 159, 162, 163, 165, 167, 168, 169, 170, 172, 173,174, 175, 177, 178, 185, 186, 188, 189, 190, 199, 201, 202,205, 206, 208, 210, 213, 215, 216, 219, 221, 223, 224, 225,226, 229, 233, 237, 238, 240, 241, 242, 243, 244, 247: n = A,T,C or G
  misc_feature 250, 253, 254, 255, 256, 259: n = A,T,C or G
gaaagattctcaaggaagaagtaataaggcattacatctgaagagtgatgctgaatttacaaagatatttggccttactaaggatttgagagtgtgccttactcgaattcctgaccatttgacctctggagaaggtttcgattcctttagcagnntggngannantnnnncnnnntnntgtcacnntnnntttgcctcntnnctnntntntcncnntcncntnnnnggntatngtcnncnnnnnatnttnttnnnnttnctcctcttt

SEQ ID NO: 6406 - DNA, 295 bp, Homo sapiens
  misc_feature 231, 261, 280: n = A,T,C or G
ggagcggcaggcccaggcccaggagagtgaggaggaagaggagagccggagcaccaggacactagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcangaaggaggatgagtcaaaaggtggctactncaaagacgttctcctacgncttttgcttaagtat

SEQ ID NO: 6407 - DNA, 300 bp, Homo sapiens
aagagaagctatgaaaagcttcagaaaaagcaaatgagggaattcagaggaaataccaaaaatcacagggaagatcggtctgaaattgagaggttaactgcaaaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggag

SEQ ID NO: 6408 - DNA, 300 bp, Homo sapiens
cccatcctatgggttgtcttttgactttttggttagtgtcctttgaggcacgtaagttttttaagtttttctctgttttttagcatcatatctaagaatctactccaaatccaaggtcacagagatttaccatgtgtttttatctaaaagctgtatagttttagaagtcagttcctctgtcctaccagccacatttcagtgatcacatgatgtggctgatgtccacagcacttgtcagtgcagataaagaccatcataacagaaagttcttttgcaaaaaaacaactttttttttttttg

SEQ ID NO: 6409 - DNA, 300 bp, Homo sapiens
gaaagaaaatattttcacatgtatctagcagcaatatagtttacaataaaccctaggtggtataatgtgatgtacattacacatgaactatctacactcactaaaagccattatttaagagtaagctcacatagcacacctatttccttggtgttgcaaagcttgaggttgcacagctttctcattttgtagagcaaatgacagttttcatcaacagaccaatggattcacagctaagaataagacaacttgaaaactccacgttttacaaaatcattttctattaaattataaaaacct

SEQ ID NO: 6410 - DNA, 262 bp, Homo sapiens
  misc_feature 150, 158, 168, 174, 175, 181, 190, 191, 193, 195, 196, 199,200, 201, 204, 207, 209, 210, 214, 215, 216, 217, 218, 224,226, 228, 229, 237, 238, 239, 243, 250, 254, 255, 257, 261: n = A,T,C or G
acctcaaaaaaaatgctgatatcctaaaatattcctagtatcctaaaatattccataaatcagatatcctacaaagccaaactggtccttcttgttaaaattaataagattctataagctgttaaccaaaaaagtttccactaacactgnatacttanctctcctaantacatnnatttangcttgctgnnantnntannnggnccntnnttgnnnnnacttgncncnnagctattnnncacnatatccngtgnntnagtnc

SEQ ID NO: 6411 - DNA, 300 bp, Homo sapiens
gctgttgcacttgccacgttatcttggagcctcgggttccccgcgtcgcctgtggtggtccccgtccctcgacaccatctcctcggtgggctcttggcgtggtcggtcctccaagtcctcggcccactggaatcaggtagtgtcagaggcggagaagatcgtggggtaccccacgtccttcatgagccttcgctgcctgctgagcgacgagctcagcaacatcgctatgcaggtgcggaagctggtggcactcagcaccctctgcttaccacagccagggggcttgtacatgacagctgg

SEQ ID NO: 6412 - DNA, 300 bp, Homo sapiens
ctagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaagtatggtgaggttctcaacctggtgctttccagtaagaagccaggcactgctgtggtggagtttgcaacc

SEQ ID NO: 6413 - DNA, 300 bp, Homo sapiens
gagagtggctaccttaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactgcacatgtcacaaagtgtcagatgagaattttaggggctggaggaagatgtaaaagatgaaaatgttttccttatcacttttctttctccacccactcagttgtctagaagaaataacactgtaaggaaa

SEQ ID NO: 6414 - DNA, 300 bp, Homo sapiens
  misc_feature 215, 228, 240, 248, 249, 254, 264, 266, 267, 277, 278, 289,291, 292: n = A,T,C or G
tcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccagagtcctttctgtattgttgtgattttgcttntggagctgtgganctcgtaaagtcncacttgtnntacanatcaacccangnnttttgccttnnttcatgatgantnngatgatgg

SEQ ID NO: 6415 - DNA, 300 bp, Homo sapiens
ctcaccacccataccctccgtcccccgccggcctaccactatctagacacctcctgccctctccatatggctccgcgggattgtttccctccctagcccgacttctccaataaacagcaacttcctgcttctccagcaagtcgcataagaagaactggaatcttgacactacaactcctgacaggacgcccctgcggcatccagagacagggaagccagtgctgctctgcatgttcagggcgagtagctgagagtctccttccggcctggatactgaggaaggtgacttagactttctct

SEQ ID NO: 6416 - DNA, 291 bp, Homo sapiens
  misc_feature 98, 103, 106, 108, 112, 116, 119, 131, 134, 141, 151, 158,166, 167, 168, 170, 173, 178, 182, 185, 188, 196, 197, 203,204, 205, 213, 216, 218, 230, 242, 259, 267, 275, 276, 277: n = A,T,C or G
gtgacttctgtggaaaaaaaattaattctttaccattgcagcgttctgccctaggtccaaatgttaccaaaatcactctagaatcttttcttgcctgnaaganaangngctnacangancagattgttatnctngaacagnactgggaatnagatcanttatgatnnntntancggtnattngcnccnttgtttanntattcnnnatacatgnttntnttaattataatnccacttttctanattattttgtagtcggnaactcaanactttttnnntcagtaagttgtta

SEQ ID NO: 6417 - DNA, 300 bp, Homo sapiens
  misc_feature 291: n = A,T,C or G
tcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccagagtcctttctgtattgttgtgattttgcttctggagctgtggagctcgtaaagtcacactcgtcctacagagcaacccagtgttttgcctttggtcatgatgtatgngatgatggc

SEQ ID NO: 6418 - DNA, 300 bp, Homo sapiens
gccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactt

SEQ ID NO: 6419 - DNA, 300 bp, Homo sapiens
agaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcct

SEQ ID NO: 6420 - DNA, 285 bp, Homo sapiens
  misc_feature 136, 140, 172, 192, 214, 220, 230, 235, 237, 238, 241, 250,262, 264, 268, 272, 274, 275, 276, 277: n = A,T,C or G
gcacctgtagtcccagctactcaggaggctgaggcaagagaatcacttgaacccaggaggcagaggttgcagtgagctgagatcacgccattgcactacagcctgggcaacaagagcgaaactttgtctaaaaaanaaancactgggcttattcatgctctgatcacatctntcgtaaaagcttaagctctntccggggtccgggttggccgtnccgtgnaattctggtnggccngnntgnggtctctgnaaatgtggctgncngctnagancnnnnactctgac

SEQ ID NO: 6421 - DNA, 293 bp, Homo sapiens
  misc_feature 261, 264, 275, 282, 284, 285: n = A,T,C or G
gcacaccctcccgtggtggctgttcctccctgtcacctgcctcctcatcatggaagggggggggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctantangacctatttgncagtggngnnatttaatt

SEQ ID NO: 6422 - DNA, 300 bp, Homo sapiens
ttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtct

SEQ ID NO: 6423 - DNA, 300 bp, Homo sapiens
gttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctca

SEQ ID NO: 6424 - DNA, 300 bp, Homo sapiens; identical to SEQ ID NO: 2134

SEQ ID NO: 6425 - DNA, 300 bp, Homo sapiens
aatggatgctcatatattgcttatggatattttggataccaaagtaggaataactgacattcagtattttaaagctggcaaacctgtacatagaaaatagatccccagacagtggtctatgaagagggcagttaagtatcaaatacttaattttcttgcctttttttcttaagtggggaaaagtttctagatctcttacacctctgacacaatctgttctaaaacaggcacttgtaatgttggggcctccttgtaaacggtgtttttgccctttactctctgggattacaggcgtgagcc

SEQ ID NO: 6426 - DNA, 300 bp, Homo sapiens
gccaggctggtctcgaactcctcacctcaactgatcatctgcctcggactaagtgctgggattacaggcctgagccaatgcgcccagcctactttctataaaagtcgtcatgtctctgcccccaccccccgccaccccccacatagtctgtttcatttgattttccccttagtttagtgttttattttgatgtttcttcagatgccttgggatcattcactgttcctcatatttaagagcaaatgcttaaaaattcttagaaataccttcttgaaaagcctgcattcctaccacctctca

SEQ ID NO: 6427 - DNA, 300 bp, Homo sapiens
tcgagaccagcctcagtaatgtagtgagaccccatctctacaaaaaaataaaaataaaataaaatttctaagtacttgtctatttgcagtttactattcttgctagaatgtatctcttcagggttttggggtttacctatgcccccttcaattttgggttctctcaaatgccagatgtatctcctagaactctttgggatttttagctctctaatacctttagacatttaaaaaatatatattttggatgttttagttatcttcagaggcaatgttaatccgaattatcaaggtagtcat

SEQ ID NO: 6428 - DNA, 300 bp, Homo sapiens
gaaacgctgactctgcctcttagcccctgggttgaagccgactagagaatctcagacgtgcttaaccggtctgttgggcttccctgcccttttccagtcccaggtttcctttccctgctcccttcctgcttctaatttcagccaaagagaaagcaaagatttagaaaagaagggtaggaagaagctggaatttgaattggcaagagaagtttgaggttgtcttttctagatcaaaacaatttttaataggctgatgttcacatgttgcactttctaaagcccgtgcttgacctcctaagg

SEQ ID NO: 6429 - DNA, 300 bp, Homo sapiens
ccatcatagagcatttaggttcttttcactttctgttgtgaataatgcaatgttgaatctgagttcattaagtgaagagtccagctgcacactgcaggcccagtctggatgtaggtgctcagatggttctctttgagacaggctttatcctttggctctcatttttttgatgagtgtacatggcatgagggacacagattccgctagaattcaaatcccacttgtgtataacctagggcagtgtgccacatctctgcacatctgttcattgtaaggattacatgtttagtgtatataaag

SEQ ID NO: 6430 - DNA, 300 bp, Homo sapiens; identical to SEQ ID NO: 1188

SEQ ID NO: 6431 - DNA, 300 bp, Homo sapiens
  misc_feature 212: n = A,T,C or G
gttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccggttgtgcatctaatcatccaaaaaattcagctcanaacctgactaaagatagtactttaaaacatgaaggcttctattcagagaacttaactgaatctagaaaattcctgaaaagtagggaaa

SEQ ID NO: 6432 - DNA, 300 bp, Homo sapiens
gagatttcttctaatggcccaataatatccttcagtctccccacctccaatatccaaagttctgtcaaggatcacatactacatttggttctttattatagactttttaaatatcgttgtataccattgtgattctatcgtctcctttaataaagaggagaaccagaaaaatgaaaggtcataagaggaatgaggtttggagaataggtgaaaaaaggcatcataatgtttataataatgtttgcctgttcagagaaacaagaatcacagataaagtcacttatatgtagataagagaat

SEQ ID NO: 6433 - DNA, 268 bp, Homo sapiens
  misc_feature 57, 63, 71, 76, 85, 86, 94, 98, 103, 107, 110, 113, 118,121, 123, 126, 128, 141, 157, 161, 168, 172, 173, 175, 181,186, 190, 194, 198, 199, 208, 212, 214, 216, 218, 223, 224,228, 231, 233, 242, 243, 246, 250, 261: n = A,T,C or G
gctaaacatcaaaaacagatctggtaggggcggggaaatgagggggaagaaacatangcgtgntggtgccnttatnctgcattannaactttanttcnatgtntgtnttnttntttcnttnancgnanccttttatttatnttttttcctttttctntttnttatttntttnntnttattnttttntgtntttntttnnttttttttnatgntntnantttgnnttanttntntttttttcnnttntttntattatctttnttacttt

SEQ ID NO: 6434 - DNA, 300 bp, Homo sapiens
gggacccagtggacttcttcctgctggtggtggtagtagggatggtactcatgggcattttcttcagcactctgtttgtcttcatggactcaggcacctgggcctcctccatcttcttccacctcatgacctgtgtgctgagccttggtgtggtcctaccctggctgcaccggctcatccgcaggaatcccctgctctggcttcttcagtttctcttccagacagacacccgcatctacctcctagcctattggtctctgctggccaccttggcctgcctggtggtgctgtccataatgc

SEQ ID NO: 6435 - DNA, 300 bp, Homo sapiens
gtcaccaacttgaaaccagcaaccatcaaggtctatgactactacctaccagatgaacaggcaacaattcagtattctgatccctgtgaatgaggataggagctggaaactcaattagtcctctgtgacattactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggag

SEQ ID NO: 6436 - DNA, 300 bp, Homo sapiens
tgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtccc

SEQ ID NO: 6437 - DNA, 300 bp, Homo sapiens
atcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcat

SEQ ID NO: 6438 - DNA, 300 bp, Homo sapiens
ctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggat

SEQ ID NO: 6439 - DNA, 300 bp, Homo sapiens
gagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtaaagcttgagagcaactttgcctccattgtgtttgccatcatggtgttggaggggcttggccgctcactggaccccaaactggacatcctggaggcagcgaggcccttcctcctcacggcccagtgtgcc

SEQ ID NO: 6440 - DNA, 265 bp, Homo sapiens
gtgacctctgtgtttctataactatgttaatgtgacctgtaaaacagttcacttctcaacaagtcagcttcctcatatttaaaatgagaagttgtcttgagtttctaaagatgtttaggctgcattgtcttgggcctgctcaggattttgacctctgagataaaagctggatttaaaaagccaatccaagccaaacacctggcattattagcattgttattccatcagatctgtttgttctgataaagaagctgggggtggaatt

SEQ ID NO: 6441 - DNA, 300 bp, Homo sapiens
tgacatcaatgagttgaagtctactcctctcatggaggctgaagaaacatttgctgagcaataatagaacctgccacaattatgtttctgatggggtaggacgggtccttgcaggagtagagggtctgcctggagggcatgggtaagaatcatggctcatgatttgtgtgggacaagtggtcgcagagcagaggctctgggtaaggagacctggtttgagtttataaccagagacaggcagttcaccaactgagtctcagtttccttatctggaaaatgggaataatttgtcttctctgg

SEQ ID NO: 6442 - DNA, 300 bp, Homo sapiens
gtaggacagcctttggtgaaggagacactttggagagcatggtgtgtgaaaacacttaaaggaaaattaaagggaattaagaggaaattgaagggaaggagtatatgagaagggttgctttgtggttataagctgaattttctttaatgtattttgaaagaccccggtaaagaaaggaatttcttttaattttgcagagaatgaggagttgtccaattaggtgttgaattgttcttccttggaactctcaagagaggagttgtgtttagagatagatttgggagctgtaagcaagtagat

SEQ ID NO: 6443 - DNA, 300 bp, Homo sapiens
ctttagcaagtcactcgaggtcatggaacatgtttttgaagaaataatatcagttcatgaattctgtacctgtttcttgtcgctgaaggggtaagtgacatcagcagcatgttcattccttttcttgtcttctacctgttctccacaaaagtataaaaagccagaattgctttttgggttttgagatggcattgtcttccatttgcaaaaaacagtttataagacaaataataaagaaattgaaatgtttctgatggtttcaaaaatgtaaacataagccagagtagttatgtctcaaca

SEQ ID NO: 6444 - DNA, 300 bp, Homo sapiens
gtttaaagaaaacatacaagggtatgacggagatatgattaggagagggaatgctttttgagggcagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataa

SEQ ID NO: 6445 - DNA, 299 bp, Homo sapiens
  misc_feature 252: n = A,T,C or G
ggtggatgtcagagttcggtggcagctcccgtggggacctggggtgtgtggctgggtgaagacgatcacctcccttctgtggttttattccccaggctgagtttgagcccccaaggctcctgtcggttctggtttgtgattggctcctccgtgccccatgcgcatgtccagccgccagggagattaggcgtttgtagtaagtgatttcactggccctggggggacagatgggtagacagtgtttgatcccangtctttgcagggctctagcccctcgcaagcttctgcaccttctctgc

SEQ ID NO: 6446 - DNA, 300 bp, Homo sapiens
gtctcatgttagttgtacccacagctctcatcagaagcagacacagatactttttgtaggaaaacatctctaacttaagcctgtaggattcccaaagattaaaagcaggcaaatatgaattcagtcaaatcatagcattcaagtagtctcaacccaacatatttgagaattgttagaaacaatgaatatgtttcccaaagactaggttttggaattatcagatacagaacacagacttcaaatattagaattgtgagaaaatagttacatgtcaaacctaatataaaagaaagatggact

SEQ ID NO: 6447 - DNA, 300 bp, Homo sapiens
atgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaac

SEQ ID NO: 6448 - DNA, 300 bp, Homo sapiens
  misc_feature 242, 246, 256, 261, 266, 269, 279, 281, 284, 290, 291: n = A,T,C or G
ctggacttgggctttttcttctatttgctgggtagaaaagtccttaaagtggatgctcatgttcagtggcctgggcatatattgtttcactggtatcaataatattttaggatataattttctagcagctaggttttacatgtatatacactatggttcagatataaattacccatctctctatattagcccagttagctagtacatggataagtcattagataatttgctacccatgtatntgtnctattaagangtacntatanttnaactaccaancnatntgtacnntgcatttat

SEQ ID NO: 6449 - DNA, 300 bp, Homo sapiens
aaacaactgaaggtcaaaaacttatatgcctttttatgtgtacatttaataaaacaattttattgatttcttaccgtaagttactgtgatgagtgataaatacttcactattcagatactttcgtaagagatacatttcagtggaacactttgcataaatattttctcaaaaatgtgccatttctgggaaaaaagggaatgatgggaaagaatgttattgcagtttttcctagaaattttgtcagattggcatgcatttttattgactaagaatcccaattttagcatgaagaccattag

SEQ ID NO: 6450 - DNA, 300 bp, Homo sapiens
gggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacag

SEQ ID NO: 6451 - DNA, 300 bp, Homo sapiens
gggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccaga

SEQ ID NO: 6452 - DNA, 292 bp, Homo sapiens
  misc_feature 52, 197, 225, 244, 258, 267, 273, 284: n = A,T,C or G
ccaagctgaattccagattctgaaagctgagctggaaagaaccatagagganaagcaagagttaaaagagaaactgaaggaaacagagacacacctggaaatgctgctgaaggctcagggctttggcaaagcttacgcggctacgtatccacgtcagctatctccttacttctgtcctccctcacttggagcttcangagatcggctatgactcagaacaagtgnatgggatcctgtacacggngctggaggcaaatnacatactgnattgancaccagactgnataccctt

SEQ ID NO: 6453 - DNA, 300 bp, Homo sapiens
gctaattggaaaatactggaagtcccttaggtattccactgcagtagtatcataagcctagaaaatctggaacaattctgtgagggtttagaaaaagggacattgaattcagtctctagcagtatggtagatgagactcaatgaacaatcttgtcacaaaccaaggacatcatctgaaaaaatgttttaagtcttttgaaatgatctgtcaagaaaacagggaatcatcagacaccaaaaccaaagtgtaagtagcagaggtcagtaagcactcaaggtggccccaccctggaggtttct

SEQ ID NO: 6454 - DNA, 300 bp, Homo sapiens
  misc_feature 34, 38, 40, 42, 47, 49, 57, 64, 66, 69, 80, 86, 87, 92, 105,106, 119, 125, 127, 133, 134, 137, 144, 153, 156, 173, 175,176, 178, 180, 181, 185, 189, 190, 197, 208, 214, 218, 220,224, 227, 229, 232, 235, 241, 249, 257, 262, 263: n = A,T,C or G
  misc_feature 264, 283: n = A,T,C or G
agcacaagagatgtaaaaaaaaaaaaaaaccccncccncngnggaangncccttttnaggtttngnttngtttttttttnggtttnnttttntgtttttttaatnntggggataacccntgatgncnggctanngtncatatcnggtcttttnagntagtgggctcttttaananntntnngctnaaannttaactnataaaaggttngagccncgtnancatncgncnaanggnacccangcataganaaaagganattcnnnccctgtgtatgaatgagcnggtcagattcaaggcag

SEQ ID NO: 6455 - DNA, 300 bp, Homo sapiens
agtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaag

SEQ ID NO: 6456 - DNA, 270 bp, Homo sapiens
  misc_feature 231, 234, 240, 255: n = A,T,C or G
gttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgcanaanagttgncgtttctgcgttggntgctactgctaactg

SEQ ID NO: 6457 - DNA, 152 bp, Homo sapiens
  misc_feature 148: n = A,T,C or G
ggtgcgttagcatctgaaccactgaaagtgagtgatggcttttatggtactggagagacctttgtttttacattctgtccggagtttgaggtctttaagtggacaggagataatatgttttttatcaaaggagacatggattcactancttt

SEQ ID NO: 6458 - DNA, 276 bp, Homo sapiens
  misc_feature 257, 264: n = A,T,C or G
tcatggtgtctgtaagtgatgacaaaagctttaataactggcacactagcataatatagaaatcaatatatatcaatgtaaaatataacccccttttattctgtaaataaatacacacaagcacatgtatattatcactgtttatagcacaaattatcactctaatttccaattttttaattgatttttggacattctgaagagtattcttgctactagctaaatgatctccatttccgggccatggtttgacatanggaaagncagccaaacctt

SEQ ID NO: 6459 - DNA, 300 bp, Homo sapiens
gtatgccccttcagaacatgcagagtgtatctttttttaaatttctccttccgttgcttaagtattgcgcagatttgttcaactttgcaaatatggacatcactttttttttctttgagaaaacacttgtatcagctttgtggtgttttcagggagaccgctgatggcagtccgtgtaaaaacccagcaatgattatgcacgtggagacatgtgctttttatttcttagcaggatattttatctctgtacataaagtagaaaccaaaggctagggaaacagatactctttacaccatcat

SEQ ID NO: 6460 - DNA, 300 bp, Homo sapiens
gtgagccgagattgcgctagtgcactccagcctgggcaacagagcaagactccatctcaaggaacgttaaaaaaaataaaaattaaaaaaaaagaatatttaggaaattggatattttctaggagaattacagaagaaaggtagtaaagaatggcaaggttatatttgtgaaagactttaatgtctagagaagagttgacactagggatttgggtaaccatcaatagtttctaagtaaggataaaattttatcactattattacaataagcacttactaacatgatggatattatgatac

SEQ ID NO: 6461 - DNA, 300 bp, Homo sapiens
gtcactttactctccatccggagccgcttcctttctcgccgcgaggctcggggttggggggggaccagattggagccgcgggctaactgggatccgtcccatttccctgggcttgacgttctctgaatttttagctaatgtggaaagttacatttatttgcatttgtttatcgcttgctcacataggtctgtgtcccgaagcttggcagatgagcgaacttagccagcacacccccggccgtgaagcagggaggtgaagcggggagagcaacgagccccacccgggtcttgccagctgga

SEQ ID NO: 6462 - DNA, 300 bp, Homo sapiens
aacacttttagttgctctattgattacttagatttttgttggcaattaggagcttttcagtaacattctttgctccatcggtagtctctgctggctcttgttcactcaggaaacacctgagcacagggcttcaggaaagccttctattaaatgggcagaggccccagcaggactcctgcatgttcatctgcacagccagagacagctggagggcaggaggagccgcgttcacatagggttctgcagccttggagccgccgtttcttccaagtactcttcagatcagcggttcttagccct

SEQ ID NO: 6463 - DNA, 300 bp, Homo sapiens
ccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcacttaacttcctaggggctgctgagcccacccagaggttg

SEQ ID NO: 6464 - DNA, 300 bp, Homo sapiens
gttcttttgaacagtaacagtctaggatctttttttttctgagatgatttttgaatgcttttgtgtggaaccacatgcatcataatagatacaaatccatgaaagtataacagttaaatactagatcttactttttcaggttttgatttctcatctaaactttccaatgctttatcagtgaagcaaactaactcacattgactagcctgctctcctttagcaaacccttcaaataaatgcctcatttgctcctcaccactatcattttagattggccagacagttgttacttacctttta

SEQ ID NO: 6465 - DNA, 300 bp, Homo sapiens
ccaaagcacacaaatggcctaccatcttttattcttccttctagcttctggagagagaaatgattgttccagtttagaatgccaggagtttactgggtgtttgtattttttatctgtgccttaaaaaaattagattataatgaacaagacatctttatgttttacagggaaggaaaaagcagtgaaagtatgcattttcgaaagaaaagtgtgttgggaaaagagagagagggtggaaacccaaaggagaaataaaaattttaagtccttgttgcagtagctggaggaagtgagcttgga

SEQ ID NO: 6466 - DNA, 300 bp, Homo sapiens
agagtaaaaatagaaatgttctttttcccagaaaaaaaatcagtaagctggtacagataaccataccacattgcctgtttttccaaaaaattacatttgggtgatatcaaatgcaaatttttgaactgcattgacagaagtcaggcatgtttagagagttagtaaactttttcagaccacagatcagcattaagtgaaatactgcttcagccactgataccttcatggcagataagtattatactgacttctttttagagacacttctgttcacacacaagacacagaatttgttgaata

SEQ ID NO: 6467 - DNA, 300 bp, Homo sapiens
  misc_feature 266, 267, 269, 270, 272, 278, 288, 289, 290: n = A,T,C or G
cgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgcctaaaataaaatttcttgaaatggggaattaaccctggagtattgagctagtttttttggtttggttttttggggctgaacatttgggcctaatcctttgnntnntnaaaccntttaaaaaannnaaggtttggt

SEQ ID NO: 6468 - DNA, 300 bp, Homo sapiens
tttagatgaagtgctgagaatatttagaaaaagcgctttaaaaagcatctagagattatcatgaaaataattggagacaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaaa

SEQ ID NO: 6469 - DNA, 300 bp, Homo sapiens
ctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaa

SEQ ID NO: 6470 - DNA, 296 bp, Homo sapiens
cttgtgttttcttaactcccccagtaatagacctaactgattttgttttgagaagttcggtattagcttaagtttttgttcgtttatagaatatcaaaatggtatcaaaactgtttaaaaggtcaatgtacatctgtagcagagctttttactcttttccttgtcttctttctctttgtgtatatacattgtttatagttgtattcagtatacatgaaattttgtgtcttttttactcctctctgtataaactttctgtgctgcaacaatgtaaattacattcaggttgtttccag

SEQ ID NO: 6471 - DNA, 287 bp, Homo sapiens
ggtaaaaggtggagaccatcattgtggaatcttgtattttctattaaggtttgtaatagtcctacaaacttgaacataaatttttaatatttgggaaggaacattcactgaagaattgataatagactaaaaaataacctgttatcaattaatacatgatctgtccttgaacacatattcaccattatgtaaacctcacattatttcagcttatttattccacagataccaatagacatgttttcacattgtagcatctcccaaatcaaaatacttctaaaaattgg

SEQ ID NO: 6472 - DNA, 300 bp, Homo sapiens
gactatgcaggtctatggggaaacctttagtctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaact

SEQ ID NO: 6473 - DNA, 300 bp, Homo sapiens
  misc_feature 69, 78, 87, 144, 187, 208, 223, 226, 236, 252, 260, 267: n = A,T,C or G
ataacatttttgcaagtctgaaattatttcaaaatcaaaagagactatcaaattacaggattaaataanattggattnttcccatancaatttaatgccatttaaaaacaatgttacatgattacttattaaaagaatgtgctngccgcttttctgctgtctggctgacttggaggcctgagattanatggtacccttgtgttctttnggtggtggttataancanggatcctcancatttctcttttttgnatcttgcnattccgncttcaagctattccccacctgcaccctcccctt

SEQ ID NO: 6474 - DNA, 300 bp, Homo sapiens
ctcctgccctgcttaacccctctctgtgcctccccagtgtccctataacaaagcccacactccttggcccttgctaaaccttccgtacccctctcaaacctctgggaccccttccctggccatagccttgccctgtgttgctcccttggctgggaatactcttcctcctgctccattttgccaggccagttcctacccattctcatggcaaacatcccttcccaaaagacccaacgccctctccaggccaggtcatcccccagcctccttcctatgccctctcaggactctatagttctt

SEQ ID NO: 6475 - DNA, 258 bp, Homo sapiens
  misc_feature 136, 148, 152, 164, 178, 184, 187, 190, 191, 193, 195, 196,198, 199, 202, 203, 205, 207, 214, 220, 227, 230, 236, 240,243, 247, 250, 251, 257: n = A,T,C or G
gggagctgcaccacaaacgtctagctctcagcagagctgggagcaaagcctggccgcccaccccaacctggggctgcctcccactccgtgagatgcttctgtctcctgttcactttgtgtggtagtttcttatttnccaatgcatctnattngatcattactgngaccttggaaatcnctatgntanggnnancnntnnagnngncntatattntaaaancttttgnatnttaagnctcntantttngtnntctggnt

SEQ ID NO: 6476 - DNA, 248 bp, Homo sapiens
  misc_feature 218, 230, 232, 234, 236, 237, 238, 239, 241: n = A,T,C or G
cccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgangtgggaagaacngntngnnnnanccttgtt

SEQ ID NO: 6477 - DNA, 300 bp, Homo sapiens
tcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctca

SEQ ID NO: 6478 - DNA, 300 bp, Homo sapiens
cattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaa

SEQ ID NO: 6479 - DNA, 279 bp, Homo sapiens
  misc_feature 109, 117, 133, 136, 138, 143, 147, 154, 158, 183, 186, 192,196, 201, 204, 208, 216, 217, 219, 225, 226, 227, 232, 238,239, 243, 244, 248, 251, 252, 255, 268, 272: n = A,T,C or G
ctgaagggaacccacccacgctccttccttcccaagagactgagcgggccatggagatcctcaaagtgctcttcaacatcaccctggactccatcaagggggaggtgtnggaggttntttatgttattttttnagntngtttntttntttttgngttntgttttttttttttttttttttttnatnttcttntttnttttnttntttntttttatnntntttttnnntcttntttttnntttnntttnttnngtnttttttttatttntttnttttttt

SEQ ID NO: 6480 - DNA, 300 bp, Homo sapiens
ggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcc

SEQ ID NO: 6481 - DNA, 300 bp, Homo sapiens
actgggtttttgttctgtgcctccagtatgtgcataggaaatgtgtctttgaatgatggggaagctgtggaaacgcactaccaaaaggaggtttcataccctgttcacctaattgtgtcacagaaatcagaaaaggaaaatctgtgtcagtgaatttcactgtatcgtcaaccctccagattgggggatctgtggagtcaaccaaccttggatcaaaaatatttggaaaaaaaatttgcattcatactgaacatgtacagactttcttttcttgtcactgttccataaaacaatacagtg

SEQ ID NO: 6482 - DNA, 300 bp, Homo sapiens
gggaaaataacccagttttgatcttttttagtctgggtgcttactggatgtcaaggtagaaagtgtccaacaaggtgctttaactataggttgagttctcaaaaaggttaagagggtagagttatagtgacatcttcagcatatatagtagttgaggccagtggaaaatttcccattgagagctctgagaggaaagtattttagaagccaagggaaaaaggagtattgagaaagcgttagatatcacagaaaaattagattggtgatttctaagacaaggatataaccgttaggatgtca

SEQ ID NO: 6483 - DNA, 300 bp, Homo sapiens; identical to SEQ ID NO: 3128

SEQ ID NO: 6484 - DNA, 300 bp, Homo sapiens
ggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccggtatttcaggaacatctgcttgccatccccacagctct

SEQ ID NO: 6485 - DNA, 300 bp, Homo sapiens
tttttattttgaaatacttggctgacttacaaaagacttcccctcacacttgacatgattgacaaaagctgtttgcagtgtttcctgcacgatgaacaccaggaacctgggaagtgagaagaaccctgggatgaagtcatcctgctggaatgacctggctttcaggctgactgccacccgccccatggggaacctatctccactgctatggccagctatttttttcgagccaggctctcgctctgttgccaggctggagtgcagtggtgcaatcactgcactgatcctcccacctcagcc

SEQ ID NO: 6486 - DNA, 300 bp, Homo sapiens
atccctacctagaagagaatagatgggaagagaactgaaagaaagaattcctcaagcactgaagtcaggaaaatccccgtaggcactgtattagttgttccatttatcccagcactccacttgtggatgaaggagttgtatagaaaggagatgagaaaatggcaggagtggaagcagccaagaagagatcgatgactgaagatctccttcaccttcaggactgtctcaaggggttatttcacctctactcatgaggatggccagtttttctgtcttttatctttagacccatatataatc

SEQ ID NO: 6487 - DNA, 300 bp, Homo sapiens
aatcagtcagatatgcctagatgaagaaacaaaatggcaatctgagtagaagaaataaggagaaaggaggagaggtgtgaaaaaaagtcctttttctgagaacaagcattcaaacagataaaacacaggtttcataaagaaaagttaaatgtcccactactatgagtcaaaatggtgcatttgctttttcctgggttttgatttattgccctctgtttgtaccccacattcgcatccttggcacagactgtcatatgtcacacattcagcctcctacacttccaccccacaatctcttta

SEQ ID NO: 6488 - DNA, 300 bp, Homo sapiens
tcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaac

SEQ ID NO: 6489 - DNA, 300 bp, Homo sapiens
tcactgttgcagcctttttgaaggggacacagtctatgagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaac

SEQ ID NO: 6490 - DNA, 284 bp, Homo sapiens
ggctggtggaagaaaggggcattccagactagagggagcagtaattgaagagtcctgagagaaatgtaggagagagagagactaaagggtaaactggggtcaaatctgatgaagggcctttattggggatttaggcatatctaagagtagataaccatgcttagtcttgtccattagaaacagtacaacttagctctgtaactgagtagttgtggttatcaggctgttccaaaacagtgagatgcactttgataagctatgatgcctattttttcacatatagg

SEQ ID NO: 6491 - DNA, 300 bp, Homo sapiens
aatgcggcccgagagagaaggaacacacttatgggcttgtcctgaaatgaaagggaatgaggaaaactgggtagagggcaaggatgctccagcctggtggctctgctctccaagaggaaggaatagagctttagaagtgtggatggccagagttcagggcagcctggctcccaagcctacctaaaacaaccatcccattcctagacccgtggattgaggactgggcagagatgaatcatccattccagggaagccataggcagaccccagacttcggggagcacctggccttgctcccac

SEQ ID NO: 6492 - DNA, 299 bp, Homo sapiens
gcactgtcatgtctctagctgggaaatacacattgaacaactggttggcaacggtaactgttgggccaggcgggcatgcacgcaacatactaccacaaagccagtgaccagctgcaggtgggtgtggagtttgaggccagcacaaggatgcaggacaccagcgtttccttcgggtaccagctggacctgcccaaggccaacctcctcttcaaaggctctgtggatagcaactggatcgtgggtgccaccctggagaagatgctcccacccctgcccctgacactggcccttggggcctt

SEQ ID NO: 6493 - DNA, 300 bp, Homo sapiens
ggtaaatcagtttggaatttgttttcatgtactcttaagttactcaattttagtgtcatggagttccaaactgttgttttacagtgatagttattaatcgtatttgtagaaagccaaagcctttattaatacagatggtggagattaaaatgaaacctgttactgattatttagaagttactcccttttatattttaatttaggaatcatttctgtagttgttaattataaattataattacttttgcattttatttacagaaaacctgggagctttccttccaagtgttttctttaatt

SEQ ID NO: 6494 - DNA, 300 bp, Homo sapiens
ttgcagtcatgtttctgagaagtcttttgtcctctgagcagtggaaactccctgttgaactgattttgtatacctgtgtaataggatgtcttgtatttctggtttcgttatttgccttttcttacttacagctatgggaaaattccaaaaatcaaatattttacaagatcagtgattactcagtagaagatacatttttaaatcatgtttaatacctaagccaatgaaatgagcattatatagttagagtaagctttttttaatggttagtatttaactatagtatttgactaactttaa

SEQ ID NO: 6495 - DNA, 300 bp, Homo sapiens
ctcccctaatccatccccacctgttagaattctatttatctttccagtcttagttcaaataccacttgtttctatgaaactttcttaactttccaacacaaattcacctcttcatttctctattcccttagcagtttgctcataactttattatataatgattgcactccaacttggatcttagctaattacgtacctgcattccacactagactgcaaacttgaggaagatgggtgctgtggctgccctcaaaccgtatgtgcctcccataggacacaagagttggttatgcaggtgtt

SEQ ID NO: 6496 - DNA, 264 bp, Homo sapiens
  misc_feature 234, 241, 242, 243, 244, 246, 247, 249, 256: n = A,T,C or G
atttttatgtgtttattcttattttatagaattcttagttgctggaagccctcaaaacttagtcatattaccattgggtatttattgttccctttcaagtgagggacgagcataatcaaatctgcattgtacatgaccaggatttttttttaaaaaaacagtactgccctggtggatctagtttattattgagtgtatagcagaaaggtaaatagtttgccatgttggtgcatnaaattgnnnngnncncctactnattctatc

SEQ ID NO: 6497 - DNA, 300 bp, Homo sapiens
gtaaaggaaagcactaagccattttctctgccctctagaagcttataatgtacagtcctatcacaaagcagaataaaaacatgaaacctataaatgggaatgccataaagtatttttatctctacaggttcattcatgcagagggcatttattgggtgactgcagtactgcaaaaggttgcaaaggaaatggaagatctggtccctgtaggttgggagtttacaatctaattagaaatacaaggcatatatacgtgaaaaaactagaatccccagctgtaagcaaaaggatggagtaggt

SEQ ID NO: 6498 - DNA, 300 bp, Homo sapiens
ctcattcgaaaacacccacaacataacataaagattggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgat

SEQ ID NO: 6499 - DNA, 300 bp, Homo sapiens
gtttagaaactgattctagacatttaagttcccagactaatgtcacagaagctaatgaattgcagaggttaattggaagcctggtcttaacactcccaggttatcttaatgagttcatgaggatggcatatggataatgcacttcaaagggtgttgtaagtattaactaagttaatacaggtcaaatgcatatattagcactcaatgcacggccattgatcaataaatgctagtggttctgatcagtgagaatctaacctctgcttaaatacctttagtcatcagcagcttccactccct

SEQ ID NO: 6500 - DNA, 300 bp, Homo sapiens
aaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaa

SEQ ID NO: 6501 - DNA, 295 bp, Homo sapiens
  misc_feature 211, 219, 239, 245, 247, 257, 284, 288: n = A,T,C or G
aaaaaataaaagtaaattctaggcaagctaaagagtgaaatgtatcatcacataggaggaagtgggggaaaaaagtgaaatgtaagaaatgaaatgataagaagaacttagtgggtattcgtttgattttggaggcactctaggaaaattctgccagattgtactacatttaaaaaaaattttttttaacttttgtgtgcttcagtttggncatagacnaatgaaaaggcacatcacanactaanangaaaatcagntcctatatatgataacgggttaatatngttntatatgg

SEQ ID NO: 6502 - DNA, 165 bp, Homo sapiens
  misc_feature 135: n = A,T,C or G
atgcgcttattaggtattttatctttcaaaaatatatgtacccaactgtgtttgtttgtttcctgactgtgaacactgaagaggactagatcaaaaatgaccaattgagtagcaattgaacatttacagtgctgngtgcagtgaacttctgtagcacccaaattg

SEQ ID NO: 6503 - DNA, 300 bp, Homo sapiens
gctgagatcacataagtacagaatcatgaccttaatggtttgacagtttggaagcaccctggcaacaagccatttcagtggaatggtagaaatggaaaccacgctgggttgagaagtgagtggatgtgaaaatatggggcctctgaatggaggtaacccttgaaaaattccactgtggagaagaaaggagagagagagggctggaatttggaatgaaaggagatatttgggattattttagtaagaaaacagaggtgtcatgacctcagtgtaaccctattagctgcaaaaaattcttca

SEQ ID NO: 6504 - DNA, 300 bp, Homo sapiens
gggagcctgtcactgcttgagacagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagt

SEQ ID NO: 6505 - DNA, 300 bp, Homo sapiens
cttgtttctctgaggaagctgaattaatggaaagtttctcttaaaacttagaatatattgtttggcaatttctgctgtgggcctaatattgcagaatcaaagttggagctacatcatgtagcacttgcctcaataagattgccttagtgacacaatgcaaaaggttacagacttttcttcaagttaccatttcccacaagggcctgtgatgaaagaagaaaagagaagcaagaaaagaaataagctagatacttccccagcacttggaccttcaaaatttgtacgatacagggagacact

SEQ ID NO: 6506 - DNA, 300 bp, Homo sapiens
  misc_feature 254, 269, 271, 283: n = A,T,C or G
gctatccctcctcctgttccaccctccagaggtagtctctgttacccttttatttataacttttatggtttttttttctgtatttatacaaatcgatgcacaaagagggttctcttctctcataaaagtgattattagtcttcagtgtgcctttttttctcctaacaaatgtaaactgggagcattttcccaagtacatatttataatacttacggtgcctatctagtattctgtgaatatatactgttaattnattccttcccattgncngacttaccttgnttccatgtattgccatt

SEQ ID NO: 6507 - DNA, 300 bp, Homo sapiens
gtttagtgttcctccactgctagaaattttggttgttcctgatttttattttcccttttataaatgtctctttggtgaacgttattagacttacagtataatccagttgatacataagcgaatgaagacagtaaccctcaaacagatgtgtgtgtggcatgtacattaactgctatcctttcagcactttgttttgttgaaatggccatttccattatgttcaggaaaactcattttgggaagaataagcaataaatttgtaattaatgaaatctggttcagtttttcagtttgtccagg

SEQ ID NO: 6508 - DNA, 300 bp, Homo sapiens
gacagaatgtgcaaattaagtttgaattaatgtaactacagaattagataaaatcttacctgagtactgaggattttgtgaaatgttagaacctggtgtattgggcattatgaacattaacccagggaagcagttaggtttgaaggaaggtatgggcaggagcttgacagatgctggcaacacatattattagatgtttctgtgccatttttatagtcaaagtgtgttcatgggaaaactaaagaatttgggacagttgacaaaattaagtcgtattttagtaaattaattaaaaagttt

SEQ ID NO: 6509 - DNA, 290 bp, Homo sapiens
  misc_feature 249, 251, 252, 254, 257, 259, 261, 262, 281, 283: n = A,T,C or G
gctatccctcctcctgttccaccctccagaggtagtctctgttacccttttatttataacttttatggtttttttttctgtatttatacaaatcgatgcacaaagagggttctcttctctcataaaagtgattattagtcttcagtgtgcctttttttctcctaacaaatgtaaactgggagcatttttccaagtacatatttataatacttacggggcctatctagtattctgcgaacatatactgtnanntnatncntnnggattgacagacttacctngngtccatg

SEQ ID NO: 6510 - DNA, 300 bp, Homo sapiens
gtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttca

SEQ ID NO: 6511 - DNA, 300 bp, Homo sapiens
gttctattcatgtttcatggatgtagtatcttcttttgtctttattaagatactaatggcgttttaaacagtttttgtctcctttcatagtttctgacttctcaatgttgcattattttaaaaaaaatgtttaaaaaggttttggcctccatctttcctagatgctctcctgaaatgtctgacccttgattattgctcatgtttaagggtagggaactaaaattatgaaacttctaagtgtggggattgggttttaccagctatgagcgtcagtgtatagcaatctggctgtactgttgt

SEQ ID NO: 6512 - DNA, 300 bp, Homo sapiens
ggaaagggccgtatttgaggtcgtagggattcacagtacagctgcagaacaggactcctcccctggtccggggctgcgactgtgtcacatggacaggctcactggttatgtgctccaccaagttatatgcacaaacgttttgacactacagtcccgcctctggaaataaccttccctatgctcgcacaagattcaaagatgggcatttaccatagcaccatctaatagcaaaaacaacaaaaaacaccccaaacccaaatcctgaatattcgtgaagagaggaatggtgttaggaagtat

SEQ ID NO: 6513 - DNA, 297 bp, Homo sapiens
  misc_feature 58, 63, 68, 79, 80, 82, 84, 86, 89, 93, 95, 97, 105, 111,115, 118, 120, 123, 126, 127, 138, 148, 149, 153, 160, 166,167, 172, 173, 174, 178, 181, 184, 189, 192, 197, 202, 205,208, 222, 232, 241, 250, 252, 253, 254, 256, 257, 260: n = A,T,C or G
  misc_feature 262, 267, 269, 270, 272, 275, 276, 280, 282: n = A,T,C or G
agatctagagctttggatctttcgggtatatgtcaatggaggtattattctatagggnctttncattnaaatgacttgnntncntnctncttncncnaaactcgncggctnccancgntnctnccnntcccccgctcncctgcctgcnncccnaccatancctctnncaccnnncacntgnccnacccncgncccantcgcnccncangcccccctccaccntccccacccncccctcctncctcccccnannnanntcncncatcntnnantcnnccancncttccacctctgctc

SEQ ID NO: 6514 - DNA, 300 bp, Homo sapiens
aaggcacagaggtggccaccaacctggtgattctctgcaccggcatcaagatcaacagctccgcctaccgcaaagcgtttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcc

SEQ ID NO: 6515 - DNA, 300 bp, Homo sapiens
ttttacgattctaaaatcctaacagattttaacagttgcttaaatattatttcttggcatatatagctttttaaggctgtgggtcaaagatagatgtactcatttgagacttagtgatttgttttataagtatgttgaataagttgagccagtttgaattgtgtccttctcttttaaagaaaagatttcccaaatttaaacctggatttagatgttttttgggttaaccctactgaactttccaaaattttcaggcttctgggcctaactcaaactgtaatttcatgaggccggccaagt

SEQ ID NO: 6516 - DNA, 300 bp, Homo sapiens
attacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaagtccatttgtcactaattccattcaggttctccaaccttcttcttgaatatc

SEQ ID NO: 6517 - DNA, 300 bp, Homo sapiens
agatagtctctgaatttagaactgggacgaaagtgtacataataggctattataaaatttttagaattggatttctaaacttggggtcagtgaatctagcaggcttaagcagtgttctcaggtttttctggcacagacaaggaatataagaggaggagagaaaaggagagacagtagtgggagggaatagaatgagagaagatagaaaatatggaattaatagagaaaggatacatgaagtattacaagattttcttggaaaaattggcatttcagtgatggatcaaagatgtctaatga

SEQ ID NO: 6518 - DNA, 300 bp, Homo sapiens
  misc_feature 260, 264, 268, 271, 276, 284: n = A,T,C or G
gcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaaggtgatgggagcacagcttggaacaatgtgctcggccccagtgctttgtggaancccnaggncanttacnttggggtnacctctggcctggggg

SEQ ID NO: 6519 - DNA, 300 bp, Homo sapiens
gctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggagga

SEQ ID NO: 6520 - DNA, 300 bp, Homo sapiens
cttttccctcccaaagttctgggattacagatgtgagccactgtgcctggccttattcagatcttgaaaattccttttgccgtataaggcaacatattcacaggttccaggattaggccatggacaattttggggaggtaattattctgcccactacaccttgggaggcattcatttgctcacctttactttctttcctctccctgtctgtactgataccatggatagtctatcttctcttcacttccttctccaggaatttcatttattctcatacatttgatatttaatgaggatgac

SEQ ID NO: 6521 - DNA, 259 bp, Homo sapiens
  misc_feature 252, 254, 257: n = A,T,C or G
ggggagccagagaagagctgtgagcagggaagggatagggtcaactctagtgacatcacactgatggacaggagataagaggccagggaggaggctgggcggagagtccagagcggaaagtgagtgcccagctctcacttccttatgtctctctctgcttcttacggccgctgtccctgaatgtttcttccctgtctgggtctgggctgtgggcttcctgcagagggctggggggttttcaccccttttttntnccnta

SEQ ID NO: 6522 - DNA, 300 bp, Homo sapiens
  misc_feature 100, 101, 103, 107, 110, 111, 118, 124, 129, 133, 135, 136,140, 149, 153, 154, 156, 165, 167, 173, 182, 187, 188, 190,206, 207, 208, 209, 211, 216, 218, 222, 225, 229, 234, 236,247, 249, 265, 267, 271, 272, 277, 280, 282, 288: n = A,T,C or G
gacagaattcacattgggatccagtcttttcctcttatgaatgggtctaccgccaggtgacgctcaattgcacgaagcttacccttattcatatgagganncnaccnaanncacattngcattnatgtncctntnngatnaagagcgcntgcnnanccttccctntntgcccngcagacccncactnntncccacttccatgcccnnnntnccatnangctnacntttncgctncntctgacggtcncntttgccctctgtcccnanacanncagcnggntncaccancaggaagctttt

SEQ ID NO: 6523 - DNA, 300 bp, Homo sapiens
tgtttttgtttgggaggtatttctgaacttaaaaaggaaaattgcaaaccattatagggactagtttgcctttggaggaaaaggaaaattgcaaacccttataaagaccaatttgcctttggaggagaaagccaatttatcatccaaaatcctcagaattctcaaatacaaaaagttctgaaaactgaaagtttcttcttaagtttggtggcaaaagttatttatagtcttgacttatcccatttgatgtgaatctgcttacatttcattgcacaaaatgtttctgtgattgtgaaatac

SEQ ID NO: 6524 - DNA, 300 bp, Homo sapiens
gcacacacacgcacacattccgaagttgacagactaacatacacacagacatgatgacaaccaaaagctgggactccacacactgaatgcaggactttaggcggggggcagagagagaaggtgctggggcacaagaggcaagggtatgaagtccctccaaataggagtggagtgccaactgccctgcctcgctccaaacacctgactcctgggccatggcaagagtccagtccattaagtgcagcgtgcaatactagcgcttggagtctcctgtcctcatcaatgaagcggtgtggacgg

SEQ ID NO: 6525 - DNA, 300 bp, Homo sapiens
agatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaaggg

SEQ ID NO: 6526 - DNA, 300 bp, Homo sapiens
ccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaa

SEQ ID NO: 6527 - DNA, 300 bp, Homo sapiens
cttgaagccacctttttttccctccaatcagaccactgctgtaaaccacactgacactattgtagtatgcttttttcctatacccataacacagtgggagattaaaaataattttgtagggtaggaagagaagtggatagagagccaggagatctaggtttgggtgctgctggtcctgcagttaagcaggcatatgtctttgggcaagtcatttcacttgtttagattaattttctcacttatgaagtgagggatttggactgcttagcgaggtacttttcatctctaaaatttatgaat

SEQ ID NO: 6528 - DNA, 300 bp, Homo sapiens
gatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcatttcttgcaaacttatttgaagctgagttgtgggtttgggttttgtttgtttctttggttgcagggtggggtgggggg

SEQ ID NO: 6529 - DNA, 300 bp, Homo sapiens
gcactttccatcaccaggcgcgggagtttgctgtgaacttgcggaaccgggtgtctgccatccatgaagtgcccccgcccagatccttcaccttcctcaatgatgcctgccagggactggagcaggctcggaaggtgctggcctacgcctgcgtgtacagcttctacagccaggacgcagagtacatggatgtggtggagcagcagacagagaacctggagctgcacaccaatgccctgcagatcctcctggaggaaaccctgctgcggtgcagagacctggcctcctccctgcgcctcc

SEQ ID NO: 6530 - DNA, 300 bp, Homo sapiens
cattcatataatgatcctatgaggcagaaggaaattaatcagatgttaagtcatgtgtccaagggcattcagcttagaaatggaactgggatttgaacctagagtaaccataaaatccttccttttctacaccaccatggtacctcctagatgaagctgaattttgcctctaagctactagtcctcacaatttagtttacaagtcatctggggcataaaaaccagacacctagaccttatgtagagattgctacagcacaggaacaggtgtcttagcaagcatgacgtacaactaagatg

SEQ ID NO: 6531 - DNA, 300 bp, Homo sapiens
tgtttttgtttgggaggtatttctgaacttaaaaaggaaaattgcaaaccattatagggactagtttgcctttggaggaaaaggaaaattgcaaacccttataaagaccaatttgcctttggaggagaaagccaatttatcatccaaaatcctcagaattctcaaatacaaaaagttctgaaaactgaaagtttcttcttaagtttggtggcagaagttatttatagtcttgacttatcccatttgatgtgaatctgcttacatttcattgcacaaaatgtttctgtgattgtgaaatac

SEQ ID NO: 6532 - DNA, 300 bp, Homo sapiens
gtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccagtaagcatcagttcagaaacaaatttaagtaaagaaatggaatctgtaatgaaagatataaaaaataccactcagaagaaatatagagactatagcaagaccccgggctcaccagacaatgattttctctttatgtactctgttgc

SEQ ID NO: 6533 - DNA, 277 bp, Homo sapiens
  misc_feature 218, 224, 226, 231, 240, 244, 248, 254, 256, 260, 261, 262,264, 265, 266, 268: n = A,T,C or G
aaaatatttgttaatcaaatgaacatgattgctaaaagggccaaagaagattacaatacaaaaagtataataaaagaaaattataaattctaaaagcattcaaggaagctgtctttgaatttgaaatgcattgtctatagaatatccactcagtggaatataatatataccttgtgatatgtggatatagatctcactaatttctaatgatgctttanaatttngntactnccgatggtntggnatgngtcttngnaacnnntnnntnattggtgtt

SEQ ID NO: 6534 - DNA, 300 bp, Homo sapiens
gaagaactgtatgtcaaataattcaaaaggggcaaaactgaatgtagttatgtgggaaagccttcagaaataatttaaatggcactgtttatcagagtatgtatgccgaggaaaactaagaatttagtgagcttataaaaccatggtagccaggcgtggtacgtagctcacacctgtaatcctcccaaagtgctgggattataggcgagagccaccacgctcagtgagtatgacatttttaaaagaacagtataaagcataaaatatcccatgtggggcaaactcccagattattttcct

SEQ ID NO: 6535 - DNA, 300 bp, Homo sapiens
ttttttttgaattattgagaatatttctttggacccacaactataaaatgtgaaaaaaaataaaaagtatgccaaaagggccacgtgtttctacaacacacgaaagtaaagaataatactgcatgtctaatatgcaaataaaatgtctctgccaaaatatcacaacttaaaatgccattatgaaacaaaccacagaaagaccttatttgtgttacataccaggaacataccaaaatttgaatgtctgatccacacagtgattcacataagatgataaagaaacaaatggatattttgtga

SEQ ID NO: 6536 - DNA, 300 bp, Homo sapiens
aaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgt

SEQ ID NO: 6537 - DNA, 256 bp, Homo sapiens
  misc_feature 158, 169, 171, 173, 186, 187, 188, 193, 197, 200, 201, 202,205, 206, 211, 212, 213, 215, 217, 218, 220, 226, 229, 234,237, 239, 240, 242, 244, 249, 251, 252, 255: n = A,T,C or G
tgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacantagagaacttnanantaaaacaggcgtnnnaattntgtnccnnnctnnttgcnnngncnntntcaccnctngcccngcncnncncncgtgncnntcnc

SEQ ID NO: 6538 - DNA, 187 bp, Homo sapiens
gagctctctctggaaagctcgcactggaatggagaacacaagcaggaaatgtgaaaagtaacggttgaaagccttacttatgatgacacatagggaggcaggtgcatatcttacaattctagacacttggataccttgggaaaccatattgaaagttaccttgatttctttctttcttttttttttt

SEQ ID NO: 6539 - DNA, 300 bp, Homo sapiens
gttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatga

SEQ ID NO: 6540 - DNA, 300 bp, Homo sapiens
tctggatagaaatgcagaggaggctgctctacagctggacagtagtgagctctgggccgccatgagactgcctgctccatgttgtatgtggggcagatgtgggagaaggatggtgggaagaatggcttccaaactgtcgattgatcagataaacaagggaggatgccaggggataatgccaagaagaggtgggtaaagaaaggaaaggaatccacaaaagggaggaggggagtgcaggtgtgcatgtgttctgaaaagtgctcatgcacatacagtttgcttattatttaaaaacttact

SEQ ID NO: 6541 - DNA, 300 bp, Homo sapiens
gctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttttacgtttttgagcctgcttcctgcatgcataaaattaatacttcagccctcttccaaaggattcaaatttacactggttagctgtgc

SEQ ID NO: 6542 - DNA, 300 bp, Homo sapiens
gtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattact

SEQ ID NO: 6543 - DNA, 300 bp, Homo sapiens
ttttagtccagtggcttgtaattaagtcatttttagtctttaattatgttggttgcttttagaattctcttttagagttggtctacatccttttaaaacatgggcaatccaaatttataacagtaaattaagatacataaaaaaaaacactggctaaatttaaaaggaaacacttctagaatatactgtattttgacacaagaccagactgtgctatgtgtatgtggtgtttcaagtaatttaagaaaactgttggaattttctgtatttccagtttcacaagaaacaacctcaaggagg

SEQ ID NO: 6544 - DNA, 285 bp, Homo sapiens
  misc_feature 84, 88, 89, 90, 94, 100, 102, 103, 104, 105, 107, 118, 122,125, 126, 131, 132, 133, 136, 139, 141, 145, 158, 159, 179,183, 186, 194, 197, 198, 204, 207, 210, 216, 219, 220, 221,222, 230, 234, 236, 240, 241, 243, 245, 249, 250, 254: n = A,T,C or G
  misc_feature 255, 258, 259, 268, 269, 276, 278: n = A,T,C or G
gccaggcaacaggactaaactacctccaaagcaagcagtcttttcagttttgactgagtgatgtgaggaacttcttttcttttntttnnnttcntttttntnnnngntttttttgaanctgnttnngtttnnnttntananggtncatgtttagctgnnttttttttttttttttaatntggnaanttatttgngtnntttgtnagngantttttnttnnnnttttatangttntnaggnngnancccnntttnntcnnttttttttnnaaaattngngtttttt

SEQ ID NO: 6545 - DNA, 300 bp, Homo sapiens
gaaaaaaccaatttaatagaaaagataggctttgcttcaggaagctggttgagaagaagaaggaaaaagtcgattctactgactgacgtttccccctgctgttaagaatcccaaccacacactttcacacactattccaggttctggctactgaatgatcccacagctgaggtctattgtcatcgctccacttctatttttagcagcactaaaaacattcccaaaaaaaatgttttttagctttttaactgtagattcaccactaagaaattggcattggaacagtccacagagcttatt

SEQ ID NO: 6546 - DNA, 300 bp, Homo sapiens
cagctgccctggaggtgtttaccatgtcccccattttccagaaggcgaagctgggacatggattaggtcagctgtccaaggtcatggagcaggatccaaaggaggcctggagagtgccatctgtctggccccttctttgtgctgcctctagaggatactggggaagcctcctcttgtctgactctgccaggatacccttggccatcaagtgctcagctaagccacagtgccactctgggtcaggccgacctgggcccagctgtgcaggatgaggtacaggaggcagctgccacagctgct

SEQ ID NO: 6547 - DNA, 300 bp, Homo sapiens
ggtaattaataagcagacaaatcagaaacaatatagaagatctgaaaaatagagttgaccagctctaatgggtccctgtatccaatagttagagatgggcattgtttttaggcacatgtgaaataatggcccccccgttctggcccagcagaaattatatacttggcaacaagtctcatcacattttaaataaactgtcaaaaagataacattctcatgtttccgcaatttaattttaaaatgaaattaaatttttttgaaggtaaaatacattttggaaatctaaactgtttaactctt

SEQ ID NO: 6548 - DNA, 300 bp, Homo sapiens; identical to SEQ ID NO: 1295

SEQ ID NO: 6549 - DNA, 286 bp, Homo sapiens
  misc_feature 124, 127, 142, 151, 154, 159, 169, 170, 176, 195, 201, 204,216, 233, 243, 247, 249, 260, 275: n = A,T,C or G
atcgtatttattacttgttgtataggggtagaaaagaggactgtcaatacaacaagtaataaatacgatatatatttcatatatagaacattagaagggtaaagctctacagaaaaaaaaaaanggngggcaaggccggccncaggggctnacncctgnaatcccagcnntttggnaggctgaggcagggaaatnacctgnggncaggagttcaanaccagcctggccaacanggggaaaccntgtntntactaaaactncaaaaattacctggncatgggggagg

SEQ ID NO: 6550 - DNA, 300 bp, Homo sapiens
cagatttccaaattgttaacactttgctgcatctgatgttttccacctctattgtatgtgttttttttctctaagccaataggagtaagctacaggatatgacaccccttgacctcttaatatttcagtgtatttcctagaagcgaatgcattatcctatatagtcacagtgcctgtaaccacaccaggaagttagtattgccaccaggcctcacactgtgtgcagtgatgtttcacaggctcacccactgtatatagtgatatttctagtccccttcagtcaggaacggtcccttgcct

SEQ ID NO: 6551 - DNA, 300 bp, Homo sapiens
attgcctcccagcttgggagcatccaaagtagaaccatgactgggtcatgaaatgggttaatttggtttctttcattacagggcaaagttctccctgtggactgagaaataaacatattataaaagttacatatgctcatagaatagaaatcaaagagtaaaaagtattgagtgtaaaaaacaagtgtcttttttccccccagtctaactccccagaagtaaccttttttattttttatgttattttttcttaccttcaaggaaggagaaaagtaaccatttttgagttgatgcgtatcc

SEQ ID NO: 6552 - DNA, 300 bp, Homo sapiens
gagggaggatcccctgggttgtgcatatggcgggaaggggtattccaggagtggaggatgtcagcagggtgggaatgggatcagtgaggggaggaggagcagaggagtcagaaggatctaagggtagggctgaaggtgggaaaacaacctgtagggctgtttaggacacggaaagggccttgactttgctgccaacgaagatgtgaaggctccaggcaagggtaacaatctaacttacattttatgagggtcctgtggcagctgtggtgagaacagactttaggggtgctgaggtggatc

SEQ ID NO: 6553 - DNA, 300 bp, Homo sapiens
gcccgttctccctttcttggttaaacggatgaagaaataaaaatgccattttcatttgtaaacttgtatttttgtatttatatttaggagtataaaatgtacttatatttaggactacaaaaatgtacctgggaaggtgacgggacctctatactcaggttaagtctcgactgcacactgacaggagtatgtagaccattccatttccctgaagactcagccttgttagtatcaggactggtcggcagatgtgcaggaaaaggtggcaagaaagtgcaagttctagaagccgatgatatt

SEQ ID NO: 6554 - DNA, 300 bp, Homo sapiens
actggcccaattaatattcatgcctgggagtattagataggtgctccaaaaacaatatagatcctatttccaaatgaggaggagtggatgcagagttgaaaggtgaaaaaaaaaaatgttctttatagtgctccagtttcctttcttagaaaagtctaactactgattgattgattgatttacttatttagggttggaggtgcagatttcattgacaatcagaaagggcaagtttgatttgtcttttcatcctaaaagtagcaacaagtgtttgcaaaaggctggctctttgttcagtgc

SEQ ID NO: 6555 - DNA, 300 bp, Homo sapiens
gagatgtgtcatcctggtgaatgtccctttaactgcaaccagaaggtaaaacttaaatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgag

SEQ ID NO: 6556 - DNA, 300 bp, Homo sapiens
ttttatataagcagtactctttctcagtttctcttgaacattcaactcattagtgagtggttttccccagtcatttccatttttctttatttggctctgatagttttctgtttttgtttttcagagataatcctttactatactaaattctacgtgattatattttccacctctatttgcctatatttatctgctgtcttttccttttccatatatgggcttattttttttttccctcttcttccttttctacctttggtatttaaaaagttacttaggactgagtgcactggcttacgt

SEQ ID NO: 6557 - DNA, 300 bp, Homo sapiens
gagatgtgtcatcctggtgaatgtccctttaactgcaaccagaaggtaaaacttagatgtccttgtaaaagaataaaaaaggaattgcagtgcaacaaagtacgtgaaaatcaggtttcaatatgaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttga

SEQ ID NO: 6558 - DNA, 300 bp, Homo sapiens
  misc_feature 252, 253, 267: n = A,T,C or G
ccgtggcccgtgggggatacagaggcagaggaggtcttggtttccgtggtggcaaagggcgtggtggcggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacgtcaaagctgctgcatagtctacaaacnngtctctgaaaatangtgaatttctagctcttcatggtcctgaacatt

SEQ ID NO: 6559 - DNA, 300 bp, Homo sapiens
  misc_feature 151, 187, 188, 197, 201, 210, 217, 218, 220, 221, 222, 223,225, 226, 228, 230, 232, 241, 251, 254, 260, 265, 271, 273,279, 281, 283: n = A,T,C or G
attggagtgacatttctcacgtgtgaatttttcacataactaaaaaacaaacctaaaaaaaagttagagttaaaaaaatagtaataccttccttttaggccagttgcggtggcttacgcctgcaatcccagcactttgggaggccggcacnggtggataatttgatgtcaggaggcttaccagcctnngcagctggngaanccctatcanacctgannannnngnnantntntgctcatgnggtcttcaanttntttttntcttntgcttngntaccantngncactgctccatgttaaa

SEQ ID NO: 6560 - DNA, 300 bp, Homo sapiens
tgtacttaactgttgtgtgatgtgtgcttttgttaggcatcactgtgcccaagtatttcatgttcattgtaaagaggaaaaatacagatttctctataatgtcaccacttatttctaattgccacttttcatcttgtggaaatgccatgttttgattcagtcttctgaatttgaacattattcaggttatttccaattgctgggaatatccttactgctaaaataaattcttagcattggaattgctaggtcaaagattatgcatgctttttaagggcttttgaaatgtattgccagtct

SEQ ID NO: 6561 - DNA, 300 bp, Homo sapiens
aatatccccaaataacatgtcttacatgtttggtaagacttactgtaccctgtcctagaagatagaagatgccctgcccttagaagacaaagagactgtagagctatgccttctaaatcttaagccactcttcagataatggatcccttcatggtcagcccaaacatctcaagaacttttaatttgtaccgtttgtctttttttccatttatttaataccacaaattcactttattattatgaagccaatatctacatcttctcacaaagattctcttaagaaatgcagaactggccggg

SEQ ID NO: 6562 - DNA, 300 bp, Homo sapiens
aggacatgaaaaggagtgaaagttaagaaaccttagctgtagtgtttggaattaacacttgggaagtcatgattgacaaatagagaaatataaatttgttttatatcagttatatatacatatttataactgatataaaacaaattagattttgacattagaaacacatatacacatactgtaatatgtactttcttcattctctttaacctatattctggttttaagtttcctggagcccgtggagtaatgggacaggaaggctcagagggtctctttactgatagttaagatacaaaa

SEQ ID NO: 6563 - DNA, 279 bp, Homo sapiens
cgggttggagcctggcgtagtcatggccgccttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgg

SEQ ID NO: 6564 - DNA, 300 bp, Homo sapiens
aaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtt

SEQ ID NO: 6565 - DNA, 300 bp, Homo sapiens
  misc_feature 240, 245, 255, 261, 265, 266, 268, 272, 277, 288, 292: n = A,T,C or G
cttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacattcaaaccatccacganagctngtgccatacngcaacngcanncngttnaaaanccccaagtatnccantgcccaaa

SEQ ID NO: 6566 - DNA, 292 bp, Homo sapiens
gtgaaatgatttgctgcactgcaagggaggtgagtgagaccaaggaactacacccaccaagatcccttccaagggtctaagttgcttctctaatcagaaacctctcaaacctttgcgactgtgcacataggtcccatgatggctttggcaacatttacctgggaccagggtgaacttcgtaccatgtattgcatatgagaaaagaaaagaatgtttgtcaaacaaaccactatgttttattttattttattttagtgttgctggtaggtgtgtagtgagttctcagtgtgtg

SEQ ID NO: 6567 - DNA, 256 bp, Homo sapiens
  misc_feature 229, 230, 241, 242, 243, 244, 248, 250, 251: n = A,T,C or G
gctctttacttggtgaacacatattgtaagaatgtgaactgatgattggaaacattacttttgacaagttcccatacttgaaatactacaaaaacatcacctaacaagcagaacaaccatgaatgggtagacattgattaaacatttaaaaagaaacaaaaaagggagatggcaaaaaaaaaaattgtttacatctgttttaattgattgggtgattcattaatcattnnttgcttataannnntacntnntccta

SEQ ID NO: 6568 - DNA, 300 bp, Homo sapiens
cacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagcccaaggctctctgactgactccgtcccaga

SEQ ID NO: 6569 - DNA, 300 bp, Homo sapiens
gcagttttccagctctaagcaccggcaaaagaggaaagctttggcactgctaatcctcctttctacacaacctccctccctcctgcccgagttcctcctcgcacttgctctgtttgtcctctcacctttctctgtcaaaatctgcacttggatatgagcctaggatcagtcatttggaccttaatttcagtgtgtgtgcttcctttgcctcaaattgtggcaagaaaaatagtcgttcctcattaaagcagtatcagctatccttgagcacaagtgggaggttgggtattttttggagac

SEQ ID NO: 6570 - DNA, 300 bp, Homo sapiens
gcaccacagaataagagtttgccgtgtaaagacaatatccccattcgtcatgctcttattttcccgtgggatatttgcatacaaatgcatgtctgttaccaaaatattgtgtaacacagacagaaaccacctgtttttgtctttccttgtttcccttaatatttcatgaattgtctagcaaaaatggtaggatgcttctgtagttcacaaatgttacatttcagagactttagaggaaaaattattttaaataactgtcaactgtttcattgctttttaaatttttcacgtgcataaccc

SEQ ID NO: 6571 - DNA, 300 bp, Homo sapiens
cttaatgtttttcaattgctcaacgaactgtcagccctgtcagatatcatatatctggtaaaattaccccttaggaatgagggggaaataaatacatactagatgaaggaaaactaagagagtttgttgctagcagacctaccctaaaagaaggctaaagaaagttcctggctgggtgcagtggctcacgactgtaatcccaacactttgggagactgaggcctgccaagctgaggccaggtggacagcttgaagcctggagttcaagataaccctgggcaataaagggaggcctcattc

SEQ ID NO: 6572 - DNA, 300 bp, Homo sapiens
ccaagatattcccaaatctccaaatttaaaaatagctctttcgcacacgatttctcccacagaatgtagtaatgtagatatgaaacattcaggtgaacttgttagaactaatggttctataaataaaaactgacatcattcataaagttatttaaataaattttgtcactaaaataaatttatatgttacatcattgctaataatgattttaactgtgagttttctttttgtaaaaaagaattgagccaagccccagggtttttctaacaagctgacgggatacttggctggggttctca

SEQ ID NO: 6573 - DNA, 299 bp, Homo sapiens
  misc_feature 288, 291: n = A,T,C or G
atccaattatttctagaaatcccattgatttcagggaactgaatttgatagccaggaggcattccactggcttcttaaaggacattattggttttcattttgttttgttttgatttcaattgcaactcaaacaatgaatcttccaaagatggttaccctcactctacaaaagtgctaagttaatattctttaaaataaatacaagcatttcttggactagataccatcaactttaattttatttttctcacataaatggtaacccaaaacttaatgaaaatttccttntgncacacagc

SEQ ID NO: 6574 - DNA, 281 bp, Homo sapiens
  misc_feature 155, 182, 185, 190, 198, 205, 210, 212, 213, 214, 215, 216,221, 222, 225, 228, 232, 233, 234, 236, 249, 250, 252, 258,262, 264, 267, 268, 273: n = A,T,C or G
ttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacnaacatacttctctggcacagccttcanaancatcngcttttgntctgttntcgtncnnnnncgtgnnctntcnttcnnntncgctgctcctcgnntngccgtnttgngncgnnaggtngtcgctcg

SEQ ID NO: 6575 - DNA, 300 bp, Homo sapiens
acttgtcatggagctggcactgtggcgctctcccgtcccgcggtggttgctgctgctgccgctgctgctgggcctgaacgcaggagctgtcattgactggcccacagaggagggcagggaagtatgggattatgtgacggtccgcatggatgcctacatgttctggatggctctattatgccaccaactcctgcaggaacttctcacaactgcccctggtcatgtggcttaagggcggtacaggcggttctagcactggatttggaaactttgatgaaattgacccccttgacagagatc

SEQ ID NO: 6576 - DNA, 300 bp, Homo sapiens
ttttagatcttctgaagtatatcagtggctttaatgacaaatcaggcccattttctcctttcctatcattatgctgtatgtatagatagaatatgtattttagatgttttattgtttagttattattttagtcttatccttctaaagttcagcaaagctttaggtaaatggcgtggatttttgaaatcctgcattcagtcgctagctgacatttagaatacaggaatagtagtttcctggaaaacagtgacacttatgttaaattcttgtggtttttacaaagtgaggtgtcaacacaga

SEQ ID NO: 6577 - DNA, 300 bp, Homo sapiens
gataaacttcacttatcaatattacttatatttggctgcatgcctctgacacttcatctggcctcatgtgttttccattttttctttctgaacagactagcccatgccccctgcccacctcatctcacctccacctcttcccttctccattcccctttggttcaccctttggcagaaggtactggtggctcagcctgcatgccgctgtctctcctctcgtgctggcatgtcatggtggcactgttgtgatctcttcctcttcctttttactaacagacgcagaccaaactggagcatgcc

SEQ ID NO: 6578 - DNA, 300 bp, Homo sapiens
aagaagaaaaattacaagaaaacatctggtttttgcatgtttgatgtgtttgtgtgtgtgtgcgtttacagttttaactgatattaagtgaagatagattaatgtcacccaggttttacaaaatcaaagaaatagaaataattttaaagacttttggtacttgaattactttgttgttttctggtcatttagtacatttatggaacctcagaaggtttgagttgaacagaggcaagttacagcagttttttgggtgggagaattcataagtcagcatgtgaatcttttgatctcatatat

SEQ ID NO: 6579 - DNA, 287 bp, Homo sapiens
caaacttctttgtcttttgaatagtgtgcctttaatagaacacatatagcatagttctagggattagagtcttctgacttcattactatttttacagtaatttatatcttggtttcttcaattagaaaaaaaaatcgggcctgattttttatttcatttactagctcagctgttctcacacctacctgctgaattagaagggacaagtataatccatcttcttttcttctttccctccttctgtaataatgtttttctattttgcaggggtaatttttttttttttt

SEQ ID NO: 6580 - DNA, 275 bp, Homo sapiens
  misc_feature 155, 177, 180, 187, 191, 192, 194, 197, 198, 200, 202, 203,204, 205, 213, 217, 221, 224, 226, 227, 230, 231, 233, 236,239, 240, 241, 247, 248, 249, 250, 251, 256, 260, 263: n = A,T,C or G
gcggaggggaaatggctgccgaaaacaagccggaagatgatcatgggaacagcaatagtagtcatgtaaaaatctttttaccgaaaaagctgcttgaatgtctgccgaaatgttcaagtttaccaaaagagaggcaccgctggaacactaatganagattatgatgcatttgtcttnttnttttttntatnntnttnntntnnnntttttttntttntatntantnnttnntnttntannntttttnnnnnttttntttnttngggacttctttt

SEQ ID NO: 6581 - DNA, 286 bp, Homo sapiens
  misc_feature 151, 154, 156, 157, 158, 163, 167, 170, 171, 172, 173, 176,184, 186, 187, 188, 190, 192, 195, 196, 197, 198, 199, 204,205, 207, 213, 218, 219, 221, 227, 228, 233, 236, 244, 245,249, 259, 260, 262, 263, 264, 265, 266, 269, 274, 277: n = A,T,C or G
  misc_feature 279: n = A,T,C or G
ggtaagtgcttagaacaatatctaacacatagtggttgcccagtaaatgtgagctgtgttgattttgagattataactacaataataactttttcaaattgatacatatttagccgatataatctaattttttaagatggaattattctanttntnnnatttntttnttnnnnttntttttttntnnntntnttnnnnnttttnntntttttnttttnntntttttnnttttnttntttttttnntttntttttttttnntnnnnnttnttttnttntnttttttt

SEQ ID NO: 6582 - DNA, 300 bp, Homo sapiens
gctgagagaccccttgctgatgcagctctgatggcaccagtgactgtccatcatgcattccttttattctctctcctttagtatcgattttaaagggcattaagcactatggttccagagtttcttggggaaaacttgcagattcttattaattggttctgcaatacttaaataaattattttacaattataagttttcagattataacatttgcattaatttttactgattttccaagatacttcttacatttactatttacgtacctttatgtacattctctgtaaaaatagacctct

SEQ ID NO: 6583 - DNA, 300 bp, Homo sapiens
gtggagtgttggctttcattttttcttgggcaagatggaaaattctcttcctgttactccatcttggccagaaatctaaattctcatataaaccgattttgcttgttcagttgttatttttatttgcaactaaaagcaatgtcatgcatgatgacttgaagaaatgtctgaaacttttgaaaattccttatttggcaagaaaatctacttatttatttaaatagctttcgaacatacccttccctcactcataattgcggggtaggagcacaccacagtttattagtaaaagttatttta

SEQ ID NO: 6584 - DNA, 300 bp, Homo sapiens
agacatttacagccatttatccagccatcataattttattgagtaactattttgtgtgaggcactgtactggatgctttggcaacagagataagcaaggcaacccctgtgaataaggcactcctggtctacacacagtgggagaaacatagaaattcatctcttctgagcggagcctgtgggaacccagaggatggacacccagcgtggactgaggaatcatgggccataacaggaggcatctggagagatctcttgggtaaagaatagtgagggctggaaggatattccaggcagtggg

SEQ ID NO: 6585 - DNA, 264 bp, Homo sapiens
  misc_feature 100, 103, 112, 115, 116, 117, 121, 126, 128, 130, 131, 134,142, 144, 150, 153, 157, 163, 188, 204, 210, 211, 219, 221,223, 231, 233, 234, 235, 236, 243, 244, 245, 246, 248, 252,253, 255, 257, 260: n = A,T,C or G
caggaataatgctgacatacatacatatatatatatatatgaagagagagagagagtcacacacagacagacagacacacggagtctcgctgtgtctccntgnctggagtgnatnnncttntaggncntnngtntttccttncngggttnctntctnagaganagagagagtcacacacagacagacngacacacggagtctcnctgtgnngcccaggntngngtcttgangnnnntttttannnntnttgnntntntgnttct

SEQ ID NO: 6586 - DNA, 300 bp, Homo sapiens
gaaaagtgagtctgtccagagatacttatagacggtagttgattagagacgagaaacgaaggaggtgaagccggggtttctggcatggggaaccagatgggtggtggtgccattcactgaaatagggagcactcaatgagcagattttctgagagaggtcaggaagcaggatagtgatgtgatggtgtgtgtggagacctgcaagtctgtcggtgcactagccttcacttcagtggggagaggcttctaccactttgggaaccatcagtttgggattgatagttaacccattggagtaga

SEQ ID NO: 6587 - DNA, 300 bp, Homo sapiens
tagtgatggggaactgactacctgaaaacagctcactcaattgtttaacacttccagttgttggaaagttctaaagcatatcaacagctaaccattattaagcacatattgtgtgctgggtattgtgttaagtgcttgtatgtgttttcccttaaatactctctgtaatcccttgaggccaggttagtatctccattttttagagcaggaaacagagatgtacagtttcttgttcaggctcactcaggtggtggtggaacaggaatggaccccatgcagttggcctgcagcctgtgctcc

SEQ ID NO: 6588 - DNA, 288 bp, Homo sapiens
  misc_feature 231, 232, 235, 236, 237, 245, 248, 252, 254, 255, 257, 260,261, 263, 272, 273: n = A,T,C or G
gatcaatatacagttgtcctcagctggttccaggcccccccccaccccttaccaaaatctgctcatactgaagtcccgaagttagccctgcaaagaccctacagaacctgcacttaggaaaaggcagccctctgaataccagggattcgagtccctgaccatggatatgtgggtccacgtggttcaaacaagtttttttttgggacggtgtctcactgttgcccaggctcnnacnnnctaggtcnccncttncnncntcnncncttcatccnntccttccgtcccgtc

SEQ ID NO: 6589 - DNA, 300 bp, Homo sapiens
gtgcctcctgcctctccaatcctgatcccccattcccagccaaggagaggttttcagcccttggtcaccctgatgacctgcagctttccaggccctaggctgagaagtttaagtccagtgtctcattaatcctcataataatctagggaggccgggcacggtggctcacaccttgtaatcccagcactttgggaggctgaggcaggtggatcacttgagttagaagtttgagaccagcctggccaacatggtgaagccccgtctttactaaaaatacaaaaattagctgggcgtggtggc

SEQ ID NO: 6590 - DNA, 262 bp, Homo sapiens
  misc_feature 188, 195, 197, 198, 199, 200, 213, 214, 216, 217, 218, 222,238, 242, 243, 247, 248, 254, 256, 257, 258, 260, 261: n = A,T,C or G
gattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttctttctttttttttttttnaaaaggnannnnccccttggacccnngnnngaangccagggccccaaatntggnntaanngaaccntnnncnnc

SEQ ID NO: 6591 - DNA, 300 bp, Homo sapiens
ttaaagagccatgacaacaaaatgcagcccttgattctagtctggattctggacttgaagggaaacatttttcttatcttttgctataagggacattagtgggacacttggcaaaatttaaattaactgtagattagataatactattgtattgttaattttctggcttttattctactttgattatattataaaagtccttgttgttaggaaatagacactaattattttgggttaaaggaatatcatgtgaaattcactttcaaacagttccaaaaaacacagtgatatatatgtata

SEQ ID NO: 6592 - DNA, 264 bp, Homo sapiens
  misc_feature 150, 159, 170, 174, 176, 177, 180, 181, 182, 184, 187, 189,193, 199, 214, 215, 218, 224, 227, 230, 235, 236, 240, 243,244, 245, 247, 253, 260, 261, 262, 263: n = A,T,C or G
ggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcanccctatggngtccctgactnattnanngtnnntnctnantaantcttgngttttcttgtttttnnttntttttnttntcnttttnnttanttnnntntttttnttttttnnnnt

SEQ ID NO: 6593 - DNA, 300 bp, Homo sapiens
atcatacccagcctgtgttgttttttaacaatatataataaaagccaacatttattcagcactgaagtattttatacacattagctcacttaatttttacaacaaacctgtgtgggaagtactgatataattaatcgatattttcagataagaaaatagcagctgaaaaagtacaaatactttcctcaaagacagacagggcttaaatcaggcctttctgatgtagaccatgctcttcactaccacagagttccatgctactttctctccctctccctcctctcctgtccctgctacaca

SEQ ID NO: 6594 - DNA, 300 bp, Homo sapiens
gcaacgaaataattttaaagtggatctgggttggtagtgcttatgggagttaggcaaggaaaaatgcagattctctttagaatatcttcacctaggtcccaaaggattctcatagatagatttccaacaaatatgaggttataataaaaaatacaaatcacatatagaagtatggcaccatgaatgagaaaggaaaaaactgtcagaacaagaccctcaagactttactggaattaacaagcaatatgtaaagtaaatagaaataagctattcataataagaataatgtataagagacta

SEQ ID NO: 6595 - DNA, 300 bp, Homo sapiens
  misc_feature 186, 197, 200, 215, 219, 221, 223, 225, 226, 229, 231, 232,236, 237, 239, 240, 241, 243, 246, 249, 254, 256, 257, 258,259, 262, 267, 268, 272, 274, 278, 279, 286, 288, 289, 290: n = A,T,C or G
caggggtgagccaccacaccaggccaagcattttctttcaaatacaaggaatatttttctgatttaaaaaaaaaaaacgaactttttttctgataatcaaagggaaagttgcaaagatgaaaataaaagtcatctgtaatctcaggtaataccaggtaattaacattttgctggatttcttaccantgaaaatgaangcntatttttaaggtggntgcngncntnnttncnngttnntnnntnggnttngttancnnnnagnatgtnnttcntnttanncttgttntnnntgtagtctct

SEQ ID NO: 6596 - DNA, 300 bp, Homo sapiens
tggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaa

SEQ ID NO: 6597 - DNA, 300 bp, Homo sapiens
aaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcc

SEQ ID NO: 6598 - DNA, 300 bp, Homo sapiens
gccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaaga

SEQ ID NO: 6599 - DNA, 293 bp, Homo sapiens
  misc_feature 270, 273, 274, 277, 278, 280: n = A,T,C or G
tcaggctgggagggacttcagttagcatggtgggggagaaccagtaccacatacccagtaggtaataaggtgtccagcagaggatgaaggtcagcaagataagcagggccagtctcagggcccggagacgaacacggtgacaattgtcaaaggagcgggggagggcaaattcaccagcaggggctaggaatttagaatatatactgtacttcacacactcactttctgatctgagtatagggtgaattgatggagggtcattcctagtgngannganntngcctcctacaatg

SEQ ID NO: 6600 - DNA, 300 bp, Homo sapiens
ggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaa

SEQ ID NO: 6601 - DNA, 284 bp, Homo sapiens
gaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccagggtgctgtggtggtgctgaacatggtggaggcctcgagggagattgccagcaccctgatggagagtgagatgatggagatcttgcagtgcta

SEQ ID NO: 6602 - DNA, 300 bp, Homo sapiens
aaagtgaatatcgagttggtaacgccaagaataccagaattctggaaatccatgaagcagcagcataagtggtttgcctctttctccagcagcaacatagtgaaatcttaaccctgaatccttgtattcttggcgttaccaactgagagaatttaaaagtgaatatcgagttgtagcactggatttgagaggttatggagaaacagatgctcccattcatcgacagaattataaattggattgtctaattacagatataaaggatattttagattctttagggtatagcaaatgtgttct

SEQ ID NO: 6603 - DNA, 298 bp, Homo sapiens
  misc_feature 153, 161, 164, 166, 167, 169, 172, 173, 174, 176, 181, 182,183, 184, 187, 192, 193, 194, 203, 221, 223, 225, 227, 230,237, 239, 249, 260, 261, 262, 274, 283, 286, 287: n = A,T,C or G
gctgctcaaggattgcagggatgaggcaagtggaacagcctcggaacctccgaaaatgggcacgctccaggtcccagtttctatggcaaccataccggcaaattgggctccgcaatggtttctcctggaaaaaccgtgattttggttaccgcngacgtctntancnntnggnnngnctacnnnnttntaaannntttatatgngaatatgtattgcatatntntngncancacttantnctttacattntctatgatgcnnngacctttgttangttttttgnctnntgacccttttc

SEQ ID NO: 6604 - DNA, 299 bp, Homo sapiens
gcggctcttttccctcgtgactcggttgctcctggcgccgcgacggggcctcacggtccgcagtcccgacgaacccctgccggtggtgcgcattccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatcctgggatgtgagcctgg

SEQ ID NO: 6605 - DNA, 300 bp, Homo sapiens
  misc_feature 158, 159, 163, 168, 180, 188, 189, 192, 197, 199, 205, 207,211, 214, 215, 216, 218, 219, 231, 235, 245, 249, 250, 253,255, 257, 258, 260, 261, 263, 268, 270, 271, 276, 279, 282,283, 284, 287, 293: n = A,T,C or G
ggatcttcttcaatcagcaataacaggtggctctatagaatggagggtagaagggatgtgggtgacttactcagtttttagttaaagaggaccctcttctgttagcatggtgaagtgcagtttctttaataaattgtgcatggtgggggtgggattanntttnctgtngtttacttcagncttgcttnnacncctantnaatccntnattntannntnntctctctttctncctncctctctttnttcnntgntntnncnntnccctntnncctgnccnttnnnaanattctntcctctt

SEQ ID NO: 6606 - DNA, 300 bp, Homo sapiens
gtggagggatgcactatttcacaaggtccaagatttgttttcagaagatgaaaatgaaaataaaatagagtttaggaagaaaggaggatttgaagggggaggattccttggaagaaagaaagttccctatctggcatcatcaccaagtacttccagagtgctgggattacaggcatgagccaccacacccgacacttaaagggcatttcttatttatccttgttttagtcacaccatagtggaatgagtaatcagttttagaagctgcaaatttaccattctctcaaagatgctagtgta

SEQ ID NO: 6607 - DNA, 300 bp, Homo sapiens
aaacaccaagaatggcacctgtttggataaataaggctatgtttttgaaagtaacctttccacaagtcaataacagaagctatggtgaaatgtaaaaattcacaattctactttgtttcactgagtgcccaatcaacgattcatacagttgagatgaatgtgacaaaactctttatagataaatatatatgcctaagtttatctatatatatatgtctttgtgtgtatatacatacacagatatatgcaaagacataaataatcttccttacaaaacatcaatagatcattttcacaggg

SEQ ID NO: 6608 - DNA, 300 bp, Homo sapiens
ccagcctgcgtttcaaccaagaccaaagctgcttttgctgcgccatggagacaggtgtgcgcatctacaacgtggagcccttgatggagaaggggcatctggtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaacccca

SEQ ID NO: 6609 - DNA, 300 bp, Homo sapiens
gaagctttcatgtcctgcattgtggaatcgggtgtgtcaccctctcaacacattgatatgttcaccaaccaggatgcttcaccatgcttcggtatctaaagtttttattggggtttcattatatatgtataattgattgaatcactggccaagtgattgaactaaatctccaccctaccccttactctgggtgtcaggctgactcaaagcaccagctatgtaatcacatggttgttctcgctggtaactggcctccatcttgggtcatctcatcttccagcccaaattcaggtgtgatcc

SEQ ID NO: 6610 - DNA, 300 bp, Homo sapiens
  misc_feature 286: n = A,T,C or G
gagaacatctttgagtaagaagatgcagtgtttgaacctgaggaaaagttaaagcgtagaaaatattgtcttgccgaaggattttgcagtcctctgtcagtaacttccattgattacgcagacatattcaggtaaaccctaatcattaagaaaaaaattatcaatgtagaaagtaattcccttttttctctctgagatatacctcaatcacacacttccccacccccacttgaaacagacctcttcacttgtgtttttttttcctgaggtggagtcttcccctgtntgcccaggctggag

SEQ ID NO: 6611 - DNA, 300 bp, Homo sapiens
tagaaatgagatgactttatgtctaagatttgcattaaaatactataatcatttgaagaaagaataaagtaaatatgccaaattttgtattataattcaatctgtatgacagttatgtgagtttttttttgttttgttttatgcttgtgtgaagatttttgtagttaagctttttttaaaaaaaagtcaactgagttacttacgtgatgaaattagaacacatacttcttacaagcacattctctcctatccccctctccatttcagttggcaccataatgccatttttgcctaaccata

SEQ ID NO: 6612 - DNA, 300 bp, Homo sapiens
agcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatg

SEQ ID NO: 6613 - DNA, 300 bp, Homo sapiens
  misc_feature 272: n = A,T,C or G
caaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcanatgtttttaaaaagtatattaagatgcc

SEQ ID NO: 6614 - DNA, 300 bp, Homo sapiens
ggcatgagccaccatgcctggcccaaaacttcttaaaaaggatgatgatggtggtggtgataatattgttatcatcattatctaacacatagtgcttactttctgccagttgttgttctcagagctttacatcattaattcatttaagctttgctattgacctcctcacggatcttaaagactttgaccttacaacctcatgaaataaatcctactgatgcgattgtacagatgaggaaactgagctaaaagaggcacaacagcttaaacccaggttacacagctaatacgtgatggaac

SEQ ID NO: 6615 - DNA, 300 bp, Homo sapiens
cttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggtt

SEQ ID NO: 6616 - DNA, 300 bp, Homo sapiens
gttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatggtcatataagctccacaggtgatctgcag

SEQ ID NO: 6617 - DNA, 300 bp, Homo sapiens
aattgatttgctacatgcttaaaatgatagaggttgctcagcatttttggagtacaagggggtcagagagacatgtgatgaaaattacagggcgagtacagagatttagaagggaacgggttttaatgcgagtatctatgacagagtcttgctctgttgcccatgctggagtgtagcggtgctcgctgcagcctcacattcaaaggctcaagcaagccttccttggcctttgaagtagctgggaccacaggctcatgccaccatccctgggtcatttttaaattttttgtagagagggtc

SEQ ID NO: 6618 - DNA, 258 bp, Homo sapiens
  misc_feature 118, 133, 135, 137, 142, 143, 144, 152, 155, 156, 160, 161,164, 166, 173, 179, 180, 197, 198, 200, 204, 210, 211, 216,222, 224, 227, 228, 230, 231, 233, 235, 237, 238, 240, 242,243, 244, 246, 248, 250, 251, 252, 254, 256: n = A,T,C or G
cagagcttagacatccaaaactaatcaatgctgaggtggctaaatacctagccttttacatgtaaacctgtctgcaaaattagcttttttaaaaaaaaaaaaaattgggggggttatncatacattgacaacncntngattnnngaaaattnttnntttnngcnangcgattnccgtannagaatggaactgtagcnntnaagngctacnngaaanaatttnantanncnnanantnntntnnntntncnnnanantt

SEQ ID NO: 6619 - DNA, 300 bp, Homo sapiens
gttaactgcactctgttcaaggagggtttgaattggagacacagagcagtcatcgttgatggcaaatttgaaatctagccaggcacacatttccagttccttcatcagggcccagtcctactcgcagaattgttctccacagtttgacttggccctctgggctttcagttttttcttctgagtctttttccttttccattaaaaaattagcagagttttgcagtgattggctgtcttggcctgcattctacttgttgtaggcccagtttatgttctttctacttcagttcaaggtgttgt

SEQ ID NO: 6620 - DNA, 291 bp, Homo sapiens
  misc_feature 152, 155, 158, 162, 163, 164, 169, 171, 174, 175, 176, 179,180, 185, 205, 206, 210, 214, 224, 227, 235, 242, 245, 253,256, 260, 264, 266, 267, 272, 273, 277, 278, 280, 282, 283: n = A,T,C or G
gccagatcccagattcaacagcagaaacgcttgttgaatggcttcagagtcaaatgacaaatggacacctaccagggaacggagatgtgtatcaagaaaggctggcacgtttagaaaatgataaagaatcccttgttcttcaggtaagtgtnttnacntacnnnttttntnctnnntgnnatatnttctttgatttctttttttnntttntctnttgctttatntgnttttattnttttttnctngagttttnttntttntctnanntctgnnttanntntnntttctctt

SEQ ID NO: 6621 - DNA, 300 bp, Homo sapiens
taaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgc

SEQ ID NO: 6622 - DNA, 285 bp, Homo sapiens
  misc_feature 123, 125, 128, 131, 132, 133, 134, 137, 138, 139, 142, 149,152, 156, 157, 162, 169, 172, 173, 174, 177, 178, 179, 180,181, 182, 188, 195, 196, 204, 206, 210, 213, 214, 217, 221,222, 231, 232, 233, 236, 237, 238, 246, 247, 250, 255: n = A,T,C or G
  misc_feature 256, 258, 259, 266, 269, 270, 273: n = A,T,C or G
tcagaatgaaacagaacaagtccatttttattttctttcactgcattgcatatggtactcaagttgtgttgtgtatagctaataggatgccattcacattttatacatctttttttttttttngnaanggnnnnccnnnttngcccccnggncggnnggccngggcccnatnnnggnnnnnnggaatnccccccnnccgggttnangccnttnnttngccnnaaccccccnnngannngggaccannggnccccnncnntaccccnggnnaantttttggttttt

SEQ ID NO: 6623 - DNA, 300 bp, Homo sapiens
gtccatgctaatttctagattgatgttttagccataaaaatgcagtatttaataatattttattttccaaattatggaaagcttcagaaatagaaatattcaatataattagtactctctaatcttttttctaggttgaaaaatctttgttttgctttaggttagattatgttgaaacacatctgtgtttcagatgtgttcagagctgaggtctcagctgaggctccactgaagcaggattcacttccaaaataacagagttgttgccaatattcagttcgtagcaaactactggaacaa

SEQ ID NO: 6624 - DNA, 300 bp, Homo sapiens
aataaataaatgggacctggttaaatagcttctctacagcaaaagaaataattgtcaaaataaacagacaacccacagaacgggagaagataagacttgtaaactgtgcatgtgacaaagaactagtattcagaagctacagggaactcaaatcagcaagaaaaataaataatcccaccaaaaagtgggcaaatgacatgaatagacatttctcaaaagaagatatgcaaatggtcgagaaacatatgaaaaaatgttcaacatccctaatcattagagaaatgcaaattaaaaccacag

SEQ ID NO: 6625 - DNA, 300 bp, Homo sapiens
gggtgagataccacgcatgaaacccacgtggactgcaactcaaagtgtggtccttggcccagcagcatttgtcagaaaggcagaatctcacagggccaggactagggtggcacaggtgaggcatcccgggcacagcatttaaggaggccctcactgtcagggtcgtacagggcacctcctcggctcaccctaatcccagctctgaggtccacccagacctttctgagtcagagtctgccttttaacaagactctcagcgatatgtatgcccagaggagtgtaagaagatctggccttaga

SEQ ID NO: 6626 - DNA, 291 bp, Homo sapiens
gaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaggccatgccctggggccacagggaggtgaggtgggctggatgccacacagatggtctccgtgctggctcactgaatagctgagcctgtggctggcct

SEQ ID NO: 6627 - DNA, 278 bp, Homo sapiens
  misc_feature 204, 222, 224, 243, 246, 247, 249, 251, 252, 255, 258, 260,265: n = A,T,C or G
cttaaagatgcataacaaagtcaggggattcattctatatgatatccaatgagtatggcattggcataaggctagacaaacagggcaggacagagggagtgaatgaacagacacacatatatttggacacttgaatgtggataaaagaggcaatgtaggaaggaagggaaaagatagtcttttcaatagaaggaactggatcanagagatattcaatggaananaagaacgaaattttacctnttnntnannacntangnaagtnaattattacttac

SEQ ID NO: 6628 - DNA, 258 bp, Homo sapiens
  misc_feature 243, 252, 256, 257: n = A,T,C or G
caaacttaaaataaaatccccactatgcacattttatttctccaacatactcggattctaccctagcatcacacacacacacacacacacagtattttgacctagggattgactatgtaacttaatttggagacaattgacatataaaaatattgagatttccaactcatgaacataatatatctctctacttatgtcgtgtttgatttcttttagcaatgtttgcagtgtacaggttttacnccttttggnaggnnt

SEQ ID NO: 6629 - DNA, 288 bp, Homo sapiens
tggaaaagaaaataaaattggcagctcactcttctgtcatttgatcttctgtcatttgcttttctgagttttggccctcctgtacaatctatctggtcgggtttacttttctccatcttcaagcagggtgtgtcttcaagcatgcatgtctgtgttttgattcggaattgatagttataatagaagcatgagctgctgggaaattatacctcctgatttgtgtggttttatttgttcatcttgcaggtttgagtagtttttggtggatgtgttgggagatatgaacgc

SEQ ID NO: 6630 - DNA, 223 bp, Homo sapiens
aagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtc

SEQ ID NO: 6631 - DNA, 265 bp, Homo sapiens
  misc_feature 78, 79, 95, 97, 101, 102, 112, 115, 121, 122, 123, 136, 138,139, 141, 146, 152, 155, 159, 160, 161, 162, 170, 172, 174,180, 181, 192, 198, 199, 200, 202, 207, 209, 213, 215, 217,223, 230, 235, 238, 239, 247, 253, 255, 259, 263: n = A,T,C or G
gccacatctgccagagcctggagtctgcgaaggccgggacccggttccccggcccacagtgggggtgtgcaaacccgnnagaactggttaagatntntttnnttcgctgttntgntttttnnnccgagcttatctnanntntatanttggcnatntttnnnnctcttgtntnanatttanntatctttttcntcttcnnntnttttntnctcnantntttatnttttttntcttnatnntttctaantgcctntntcantttntt

SEQ ID NO: 6632 - DNA, 300 bp, Homo sapiens
  misc_feature 283: n = A,T,C or G
cttttttgtatttttacgctctgctgtccatgacatatttctaacacctttatgattattgttcctgcttgtaaaagggctgatatttacatgagtgcaaggcaggaagaaaaggtagctgtgccagccacttctggcaagcagttctcccaccttagcctcccaagtagctgagaccataggcatgagatttctcaaaattcctcccagcaggctttcacttagtttcattgttgagaactgtgacaggtccatctctagctgcaaaggaggctgagaaagngaacacagcagcctcct

SEQ ID NO: 6633 - DNA, 259 bp, Homo sapiens
  misc_feature 87, 89, 95, 97, 104, 109, 110, 113, 115, 126, 128, 140, 143,147, 152, 154, 166, 172, 178, 181, 185, 187, 205, 209, 214,224, 225, 235, 238, 242, 246, 248, 250, 253, 254, 256, 258: n = A,T,C or G
catttatatatatactatatatttcatatatgtatttcaggaatttatagaccacacattcatatatagatacagatatatatatgngngtgtgngnatatacncatanntantnaagcgtatatncngtagtatacatnatncacncatananacgtatatatgnaaacgnatatanacncgtnanataattatatgttatatntacngtatntacgtatacnncatatgcacntgntatncgtntntntgnntntnt

SEQ ID NO: 6634 - DNA, 300 bp, Homo sapiens
gcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctggttttggagatctcaactctggctgtgtaccgattgccacacccaggctggaggccggagatggtgggcctgctgtcgctgtgggacatgacccgcatgctgaacatgctcatcgtgttccgcttcctgcgtatcatccc

SEQ ID NO: 6635 - DNA, 300 bp, Homo sapiens
gtggcaagttggttatatggaaagtctctgttcactcacttgggtgaataacagtaaatacctttctattgttttcactttacattaggccatgagtatttgtgcctgtggctgcagtttgtgttagtttcctaccccaggtatctcctgcagcatgcagcttcagtcctaccagaccctcaaaacttaaaagctaacactattactagggaggattttgcaggaaaatggagaaagggttacacacaaaaaaggttaaactactctatgcatgtttctgcaatgtgttatctcaagaat

SEQ ID NO: 6636 - DNA, 300 bp, Homo sapiens
ggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgcccacacgctgcgttcactgccaatgctgtactcacctccatcaccctccaactttggggcccatgtcttccttgggccaaggtctcatgggggctagggccaagttgggggcccaggaggcggggagggaag

SEQ ID NO: 6637 - DNA, 300 bp, Homo sapiens
gtccattcttataaagggaacttctagcaaacctgcccagccctttccctggagggaaacattatctgtattatcctaaagagcaaacaaatctgctcttggttccaaatagagacactttatctttcaagacaatgcctatgcaaatatcttagaaaagatagtctaggagaaacaagctgccacaagaactgcaaaaatgcaaacagcctataaagaattgtctcccaacatattgatcttttatattattctctttatgcgttgtcataaaaagttgagagactgcaatcctgcacc

SEQ ID NO: 6638 - DNA, 297 bp, Homo sapiens
  misc_feature 274, 277, 290: n = A,T,C or G
gtgagcctagggacccatttctcctcctttgacagggacatcagtggagccttctcagacccacaggggtccttggggaattttgacatggttatttaaggaaccttgcctagaagtcccaacttgcagttccccatcgacgggaaggcttggactccaagatgattataaaggaatatcggattcctctgccaatgaccgtggaggagtaccgcatcgccatctgtacatgatacagaagaagagccgtaacgagacatatggcgaaggcagnggngtggagatcctgnataaccg

SEQ ID NO: 6639 - DNA, 271 bp, Homo sapiens
  misc_feature 186, 188, 191, 193, 197, 198, 208, 214, 221, 226, 227, 235,236, 239, 243, 244, 249, 258, 264: n = A,T,C or G
aggacgaccgctacttgcacttcctggaaggcacccgggactatgagtggctggaagcactgcttatgaatcagacggtgatgtcaaaaaaccttttctggctcaggcgcagaccccaagaagctgctcgggaagccctgtgcatggacaggtacatgttgctgcacccagactttctccgatacntnaanancagnnttttgaggcntattancctgganggtanncatcatcnnganatannttccnatttctgangtcctnactgcgg

SEQ ID NO: 6640 - DNA, 300 bp, Homo sapiens
atggaatttacttttcttctagactttcttttgcaatggaacgttgctttgtgtgtgatttggtggaataacaaccaatacacaatgagcagtctaatgtgtagtcatttggtgctctgtgttcaagtgtgaaatctctatcagtgcccaatagtaagccagggtctgcttttcatatagaaaatggttgctgacagaagaagatgtggccgtactccagggtggttctctatggaggcttgtgagagtctctatacagcatccatgactgccaccggcacttccaataccattagttat

SEQ ID NO: 6641 - DNA, 300 bp, Homo sapiens
ctccatcaaggcatttctcttcattggatattgcagtctgcacaattgagagagccaatggtctgatcaatcgcctcatagaggaaaataagatggatctgttaggaatggtggttgtggatgaattacatatgctgggagactctcaccgagggtatctgctggaacttttgctgaccaagatttgctatattactcggaaatcagcatcttgtcaggcagatctagccagttctctgtctaatgctgtgcaaatcgttgggatgagtgctacccttcctaatttggagcttgtggctt

SEQ ID NO: 6642 - DNA, 300 bp, Homo sapiens
cagaaatcagcatgcatgaattaatcgaaatacaatgcatattaaacaatgcaattactatagtctaaatcaccaaactgataacccatacaaaagtagctcttacaactttttttgagaatatttcccctaaaaaattccagtgatcatcccaacctacaaaactagattattttactagtatcatcttctctttacccctcttctccccaccaacactccctccaacacacacacacttctccttaagagaaacggcttcctcaagaaattatctgatggttcagtagcagttggagt

SEQ ID NO: 6643 - DNA, 300 bp, Homo sapiens
aagaaggtgggggcctgccacggccccaggaccccactgctgggcaccgaccagtgtgccctgggcccaagcttctggtgcaggagccaggaggccgccaagctgtgcaacgctgtgcaacactgccagaagcatgtatggaaagagatgcacctccacgctggggaacacgcgtgaccgtggctgccagagacccagagcctgctagcgaggcccatgaggtgggtgctttccccatccccatttcacaaatgaaaaactgaagctctgaggagggaggctgggaaggagcagagctga

SEQ ID NO: 6644 - DNA, 293 bp, Homo sapiens
cctatgattcattcattcaataagcttttactgcataaactttacatccagcactgtagttaagtacccaaaattgaatagaaataatggcttttgaaaattgcccaaagcaggctgggattacaggcgtgaaccactgcacccggcccagtactgcatcttaacagccaagccattttattctactttataactgatagacttgataccatccatctctttaggttacagaggataatttgaagagaaatgttactgtagaatatatagttctgtactttttttttttaaga

SEQ ID NO: 6645 - DNA, 266 bp, Homo sapiens
cgcgacgcacattgatggagcgtatgtccaggcgccggtgcaccgcaaggagcaaaacagacacagttcttggtcctagggctcacgtcccggggcgaagaggatcctccataaacgatcagccatagcagctgtgattggacaagagactgatttcagtgactttctcctgataagagaccaccgaccagctgaccatgccgaccagctgacccgttaatagagagagatgatgcacctgcatgcctttgtgtcctgaaaatgac

SEQ ID NO: 6646 - DNA, 300 bp, Homo sapiens
gcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcag

SEQ ID NO: 6647 - DNA, 271 bp, Homo sapiens
  misc_feature 140, 141, 143, 147, 151, 158, 171, 174, 176, 186, 187, 188,189, 198, 200, 203, 207, 208, 214, 216, 217, 218, 219, 223,224, 226, 232, 234, 236, 244, 248, 249, 253, 255, 257, 259: n = A,T,C or G
ggaaagtggagaggtctctgctgcgaagagaggcactttcagggactttccttcagctgtctcttcctctgggaatgagctactcaaggctgacccctcctcctgttgcttgaaataatgatgatatataggttggattnngnagtntgtnacctccngctcaatctcctnctncntctctacctnnnntcttctccntnctncctnncttcgntnnnncttnncnctcccncntnttactctnacanntccntntncncaccctcactct

SEQ ID NO: 6648 - DNA, 300 bp, Homo sapiens
ccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctc

SEQ ID NO: 6649 - DNA, 224 bp, Homo sapiens
cggatatcctctccctcatcaaacttttctccaccaactttagcatctggttgccaccctccaaaatggccccagtgatcccatctcctaataagtacatgtctgtgtggtcctctcccacactgcataggaatggcttacgtaaccaataggtagttgaggatgtgatgcagtctgacttttgaggctaagttgtaaagaaagacactgtgtcttcctccttg

SEQ ID NO: 6650 - DNA, 268 bp, Homo sapiens
  misc_feature 144, 145, 146, 147, 150, 151, 152, 154, 155, 156, 157, 158,160, 165, 167, 169, 176, 179, 180, 183, 188, 189, 191, 192,193, 200, 211, 214, 217, 226, 228, 234, 248, 249, 250, 252,255, 262: n = A,T,C or G
cttgagtctaggagttcaagaccagccttggcaacgtggctaaaccccattgctacaaaaatatatatatacaaaaaattagctgggagcggttggcacatgcctgtagtcccaactactcaggaagccgaggtgagagaatcnnnnggnnncnnnnntntactntnangttaaanaannggntttanntnnnaaattanctggaagcggntgncanatgcctggngncccaantactctggaggccnnngnggnaaaattnctggaa

SEQ ID NO: 6651 - DNA, 300 bp, Homo sapiens
caaatccaatagcaagctctgttttctaatatagtaaatgtctttatagtaatagtgagtaatcattaattctaaagatagaattattattacaataaacaaactttagtcacatattggcagtttttctatttcaaacacagcaccagagatcagagtctacttgaaacttacatttgtgttatttaacaatttttctgtatctttttcattggtgttttgttttgtttatcttttgtttttgtttctttggtttggtttgtttttgttttgttttttgagatacgatctctgtcacac

SEQ ID NO: 6652 - DNA, 300 bp, Homo sapiens
gctcagtgctggcatgttgacctggtgttgtcagtgagtctgtggatccagggtcagtgctggtatgtttagctgacattggcagtgagtccatggatccaggctcagtgctggtatgttgacctggtgttgtcagtgagtctgtggatccaggctcagtgctggtatgttgacctagcattggcactgagtctgtggattcaggctcagtgctggtatgttgacctgacattagcagtgagtctgtggatccaggctcagttccacagaggttgtataaacatggtctcaggtgggttc

SEQ ID NO: 6653 - DNA, 266 bp, Homo sapiens
  misc_feature 124, 133, 135, 140, 141, 151, 155, 158, 160, 161, 164, 165,168, 175, 176, 177, 180, 181, 182, 185, 191, 192, 195, 200,201, 202, 207, 210, 214, 220, 221, 222, 224, 226, 227, 229,230, 233, 235, 238, 240, 242, 243, 244, 245, 246, 247: n = A,T,C or G
  misc_feature 250, 253, 263: n = A,T,C or G
cgtgttggccacgttggtcttgaactcttgacctcaggcctcccaaggtgctgggattacaggcgtgagccaccgagtctggccttggcagttatttttcattactttttgttttttttggacnaggtctggntntgtannccaggctggnatgnagntnntgnnatnacagatnnntgnnnggntcaacnnggnaagannngatgnggnttcncggggnnntngnnannaantngtnantnnnnnnaangantacatgaagntag

SEQ ID NO: 6654 - DNA, 300 bp, Homo sapiens
  misc_feature 234, 271, 284: n = A,T,C or G
aaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaattatgaaaaaagttatgggattaaagaaagtcaggataaaaattttaaaaagcaggccantgtcagcaaagcctggaaaattggggccggaggctcngcccccatcatgngcctgccaccccttcc

SEQ ID NO: 6655 - DNA, 265 bp, Homo sapiens
  misc_feature 47, 53, 67, 70, 74, 79, 92, 97, 101, 107, 113, 123, 129,130, 131, 134, 135, 140, 143, 144, 146, 150, 151, 158, 169,172, 175, 177, 180, 181, 183, 187, 196, 200, 204, 205, 208,209, 213, 217, 222, 223, 230, 232, 238, 244, 245, 248: n = A,T,C or G
  misc_feature 255: n = A,T,C or G
gaggcatccaaaggctcctgagacacatgggtgctattggggttggnggggangtgtgtgaggctgnaantgtnctctnttattaggctatntctancttnccattnactganttcactcaanactgcnnnatnnctatnaannantaanntaaaccntcttaggtcantantantnctnnantgantttcatcantatncctnnacnngttncttngttanncagatancnttaacnttattnnacngagaaantctcttctaa

SEQ ID NO: 6656 - DNA, 300 bp, Homo sapiens
agaagaaagcattagcaaccttgatgccatgacaatagaaactatccaaaataaggcacagagaagaaagtggaaaaaaaggcaaaaaggaaaacagagcaacagataatgtgagacaaggtcagatagtctttatgtatgtgtaattggagtccccaggagatgtgagaggaaaaagagttgaaacaatcatagacaaaatatttccacgtttgatgaaaactatattagttgtgtattgctacctaacaagttattccaaaaatttagtggcttaaacaaaacatccattatctccca

SEQ ID NO: 6657 - DNA, 300 bp, Homo sapiens
gccacctactgcgtcttggtcatggagaagaagagctggagacagagaaagatttcagcagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaagcttgtgcaacctctacaactggcgatacaagaatctaggaaacttacccca

SEQ ID NO: 6658 - DNA, 300 bp, Homo sapiens
  misc_feature 67: n = A,T,C or G
attaaaaagaaagctttatgtagttatgcatgtcagtttgctatttaaaatgtgtgacagtgtttgncatattaagagtgaatttggcaggaattcccaagatggacattgtgcttttaaactagaacttgtaagacattatgtgaatatcccttgccaattttttttataataagaaaacatctgactaaagtcaaagaatgatttcttatggtttattttgatgaaagttcttttaacatgtcttgaatgtacacataaaggaatccaaagctttccattctaacttaatctttgtga

SEQ ID NO: 6659 - DNA, 300 bp, Homo sapiens
gtgacattgtgattgcaaaaagcccaagtgatccaaaatcaaatatttgtaaaagagtaattggtttggaaggagacaaaatcctcaccactagtccatcagatttctttaaaagccatagttatactatagtgataaaaacctgtgctacacatccatttctcagcaacggctcctaggataatcaatcatggcatactgctaatgccttgattgcagctgatatggaggaaatatgtttactcttttgctaaagtgaagttcactgcggaggtgccaatgggtcatgtttggttagaa

SEQ ID NO: 6660 - DNA, 300 bp, Homo sapiens
gcccagatgaccttttcaggggtaacaccccagctgcttgagagaacagtgttgctgctggcagagatgcattccagagatgcactccgctctggaactcactctcagccacagggagctgcatgcaccacaggggcaatgcacctttgcaggggtaccttctggccccaacccttgactcaacggggacaactccagaaggtcattccagatccagagatccccatcgaactgaaggatcactgggttgcagacacattgcaggtcagcttcttcctctgcccagtcctgcctcactcc

SEQ ID NO: 6661 - DNA, 289 bp, Homo sapiens
  misc_feature 123, 126, 133, 145, 148, 152, 156, 160, 163, 164, 166, 170,171, 180, 186, 193, 195, 201, 203, 214, 217, 220, 224, 232,237, 239, 247, 257, 269, 273, 275, 277, 281: n = A,T,C or G
atcatgactcactgtagccttgacttcttgggctcaggcgatcctcccacctcagcctcctgcatagctgggactacaggcatgtgccaccacacctggctaatttttgtatttttttttttnggnaaaaacncggttttgccgngtngccnaggntggnctnnanctcnngggctaaancaatcnattcacngnagcctntnaaagggctggnatnacnggcntgaccccntgcantnggccgacnttcaattttnatgaataaaacntacntngnaaantaaggggg

SEQ ID NO: 6662 - DNA, 300 bp, Homo sapiens
gttttataagtggagtcttcagggaatgattatttgggaattaggctttgaaagagcctcagctgtgttccaccccctccaagaattcaggctgttatttttcaaggctgccacagaggtggggagtggaaaatgagactagtaagttaaaatactacaaagcttgctgttcttacagaaattcagccatttttcttgaataaacacttccatggattgctgcaagccttgattaattgccagaatctgaaatggttgcttttgacagtttttttcccataggtttttgttgcttttatg

SEQ ID NO: 6663 - DNA, 299 bp, Homo sapiens
ttttttttttccaattctgttcctttcagcttaggaaccttagtacatgcagtttcttctacctgaaggcttcctcatccctttacctgacaccacactctgactcagggccttcaaactaactaaagcctaatcttctgggcaaagtttgctttttaatttttttttcaacaattgctcaaagagtagttgttttcataattaatccaaaattgtcctaagaaaggccatcatcacagggggcaaagtttaacatcatttcctgaaaagggttatcataccccccaaataaattaggt

SEQ ID NO: 6664 - DNA, 300 bp, Homo sapiens
ctaatgtgctataaattcttctgagcttgctgtggctaatttattaatttaaaaagtattttttgtctttcttaggcctccttgaatctagtcactctagagatagaatacacaatcttgtcctgatgtttttacttgcaactcacaatcttgtttggtggtttagttgcaggtttcagagattagaccgtatatatctaaatgctgggatcatgcctaatccacaactaaatatcaaagcacttctctttggcctcttttcaagctgaaggcctgctgacccagggtgataagatcact

SEQ ID NO: 6665 - DNA, 293 bp, Homo sapiens
  misc_feature 133, 137, 143, 144, 149, 161, 162, 163, 165, 171, 178, 179,181, 183, 189, 190, 193, 197, 208, 209, 215, 225, 239, 252,254, 266, 269, 271, 275, 276, 282, 286: n = A,T,C or G
gccctggatggaggacaagagtttggtagtcaatggcaacagtaccattcaaaaatagatgatctgatcgacaacagtgtaaaagaaatcatttcactgttagtttcaaagtttgtttcagtgttggaaggcntgtngtctannctgtnaaggttttattnnntnactttnttatctnncntnttttanntcnactnttaaattaatnntttttnttgttatttncatatttttttctnttattttttttcntntttttttttttnttntnttgnntttttnatanttttaat

SEQ ID NO: 6666 - DNA, 300 bp, Homo sapiens
gttctcccttatctgatgctcactgtggccttgggcagcctggcatcgagaattctcagcatgttcactcttgagttctgtgcctgcatcacacagcaatggaacagtcccaaaagattcttaagggtggggaaaggcactaagaaaagatgaacctgcagtccctgttataccatctggtctaattgatactactgttgtcaagcaaaaggagctctctccctgaggcactggaagccaatattttgacaccaggtttttgagaaagaaaagttttttattgtaagttgactcacaaga

SEQ ID NO: 6667 - DNA, 276 bp, Homo sapiens
  misc_feature 174, 175, 177, 186, 194, 200, 204, 205, 209, 211, 217, 220,221, 224, 225, 228, 234, 235, 256, 261, 263, 264, 269: n = A,T,C or G
gggtggcaagccacccaggtgccgaggcaagagaccgagagcacgagctgttccagtgtaataaaatatataaaataacaagagttatactgatatagctcatagatatgattatatataaataccattaatcattagtttgtagtaattactctttattcaaatattataatnntnctcactctncaatcatnacctanatanngctngnatttgnaannatnntanctgtgnntacatggtgttaactgtttanttccnannattcnttttttt

SEQ ID NO: 6668 - DNA, 300 bp, Homo sapiens
gaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaaga

SEQ ID NO: 6669 - DNA, 257 bp, Homo sapiens
  misc_feature 203, 204, 210, 211, 216, 229, 231, 232, 235, 243, 244, 246,248, 254: n = A,T,C or G
acaacagaacccgaagtgcccaggatgatatttttacacaagctgtaaatatggcaggattgccagcagtgagtatccctgttgcactctcaaaccaagggttgccaataggactacagtttattggacgtgcgttttgtgaccagcagcttcttacagtagccaaatggtttgaataacaagtacagtttcctgttattcannttcttnnactcntggatgattgttnannttnccttgttnntngnaagttncct

SEQ ID NO: 6670 - DNA, 300 bp, Homo sapiens
  misc_feature 128, 135, 147, 148, 149, 154, 157, 158, 165, 167, 170, 171,174, 175, 178, 187, 188, 192, 194, 198, 201, 203, 205, 207,208, 210, 213, 220, 224, 227, 230, 231, 233, 235, 237, 238,240, 242, 250, 254, 256, 259, 261, 263, 264, 265, 267: n = A,T,C or G
  misc_feature 269, 271, 279, 281, 282, 283, 288: n = A,T,C or G
attacagccaccttttgggtttcatttaattttggtagtgttaatgtctattaatgtgattttttttttaacctttctcccaataggttgatgacaacaagaaactaggagaatggttaggcctttgnaaaattnacagatagggtnnnccccntannctggtcncntgnnttnntcnttcctatcnntttnanatgnggnancncnntnctntacgttncccnttnttnntnantnntncntattactntccncnttncncnnntncncnttctttgnannnccccntctccctctcgt

SEQ ID NO: 6671 - DNA, 300 bp, Homo sapiens
atcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggcccc

SEQ ID NO: 6672 - DNA, 300 bp, Homo sapiens
atgaccagagaggaaggagaagatgcagtccagtttgctaacagggttaagtctgctattgctatacaaggaggcctgactgaacttccctgggatggaggactaaagagagcaaaggtgaaggacatctttaaggaagagcagcagaaaaattacagcaagatgattgtgggcaatggatctctcagctaagaggacggatgacagcctttagatctagaactagcccttagaaatggaatggcttttttgttttgttttgttttattgttttgtttttattattgttaatcttttcta

SEQ ID NO: 6673 - DNA, 296 bp, Homo sapiens
  misc_feature 193, 203, 206, 207, 208, 209, 214, 215, 218, 225, 240, 247,249, 254, 256, 258, 259, 264, 268, 270, 273, 274, 275, 279,281, 282, 283, 287: n = A,T,C or G
aagattggggtaatactgaatgtatagtttttagggggtgaaatttagctgtataaatcataggctgttgacatttgtgattacttcattgctaagttttacatataggagtcttcatactttgtttcagggacagaatgatgctgctgaaattggaacaagaaattttagatttcattggtagtaatgagtnagtcctgacnttnnnnagatnntanattgggntcccattctccttgncttctancntggantntnnttttntttngnttnnncctntnnntttntttttgctc

SEQ ID NO: 6674 - DNA, 300 bp, Homo sapiens
ggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgt

SEQ ID NO: 6675 - DNA, 300 bp, Homo sapiens; identical to SEQ ID NO: 3287

SEQ ID NO: 6676 - DNA, 300 bp, Homo sapiens
ccctatcttatgagaaaagtaactttgaaaggactaatacatcctgttcttagcttctgcttccttcaggccttctctatgaagccagcctattctgctcagcgctttggaacactgattctatttcatggaccgaagcattgcccaattgtagaattgcaataaagccaactgagatctttaaattggctataattcatcctttggcaatacagtaaaaaaaaaaaattctcacaattctgtaaaagggtatgagatatacaataaaagacacccccaccctctgcaatctaccactca

SEQ ID NO: 6677 - DNA, 300 bp, Homo sapiens
caaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacc

SEQ ID NO: 6678 - DNA, 300 bp, Homo sapiens
ccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcaggaaggtgatgctctcttacacaaccttcattctcgccctcaaagacttattgatcatataaggaatctccatgaggaagatgccttactgaaggaggaaagcagcatctatgatgatattgtttttgtggatgttgtcga

SEQ ID NO: 6679 - DNA, 291 bp, Homo sapiens
  misc_feature 238, 252, 262, 263, 265, 271, 275, 280: n = A,T,C or G
ctgcctcagcctcctgagtacgctgggattacaggcgtgcaccaccatgcctggctaatttttgtatttttagtagagatggggtttcacaatgttgcccaggttggtctcgaaccgctgaccttaagcgatccgcctgccttggcctccccaaggtgctggaattacaggcatgagccaccgtgcccggctgacttttttttatcttatttctttgtgacacggggatgtgctcaancttccaggctggantgcaatggcnncncatggntcgntgacntcaatctgctg

SEQ ID NO: 6680 - DNA, 284 bp, Homo sapiens
  misc_feature 122, 123, 127, 136, 145, 163, 165, 172, 178, 179, 182, 184,187, 191, 195, 196, 198, 201, 206, 210, 212, 214, 221, 223,224, 225, 231, 233, 236, 239, 250, 253, 256, 259, 267, 269,271, 275: n = A,T,C or G
agagtgagaacccctctgctacaaaaaatagaaaaaccagctggggcgtggtcgcgctcatgtatagaccagctgctggagagactgagctgggaggatggcttgagcccaggaggccaatnntgtngggagctgnggtcgtacnactgtactctaatctggncnactcgancacganntcntntcncatnactnntntcngtgtntttngngnttttccntnnnttggtntnctnttncattgttcttnctntcnctnattgtganangntctnttcctcctt

SEQ ID NO: 6681 - DNA, 300 bp, Homo sapiens
gcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatg

SEQ ID NO: 6682 - DNA, 298 bp, Homo sapiens
  misc_feature 113, 117, 118, 123, 124, 125, 126, 128, 131, 136, 150, 152,154, 160, 161, 165, 168, 174, 181, 182, 183, 186, 187, 189,190, 192, 195, 205, 226, 228, 234, 235, 237, 248, 249, 251,254, 255, 256, 259, 268, 270, 271, 272, 278, 280, 281: n = A,T,C or G
  misc_feature 288, 289: n = A,T,C or G
ataagaaattgtcttgcctaagattaaatatatatggatatttttcctaagaaaagttttagaaaagactgatgagtgtatttctatgtaattggaatatatttaaggtcatnccgnntgggnnnnanatnttctnctcacactcagggncntnggggannaacnccngttggnggaagannnccnngnncnacntgtgcagcanctatcccttttcctcacggcngntctccnngnacctcctcgcnntnttnnngcntcccctggngnnnctctgncnncctcccnncattcctga

SEQ ID NO: 6683 - DNA, 300 bp, Homo sapiens
ggaagacacaataattttaaattgcctacagcaggggttggcaaatagtggtgcaagggccacatctggctagcagcctatttttgagaatgaagttttatgagaacccacacatctgtttgtagattgctatggctgcctttgagttacagcagtggagctgagtagctgtgacagagactatatgacctacaaaaactaaaaatattggtcctttacagaaaaagttgtctgacccctggcctactatttcaaatcctgggtaggtcctccacgtcagttcttcatggaactgtattg

SEQ ID NO: 6684 - DNA, 290 bp, Homo sapiens
  misc_feature 221, 228, 239, 243, 255, 257, 260, 262, 263, 267, 270, 271: n = A,T,C or G
gtccagcattatggagtgaacgtcagctccaggaagcagagacttctggccctttgttcaccatttccccagaacctagggtggtgactcacctataagtgctcaaaaaacatgtggcgaatggaggaccagagctaggctctgaatgaggcctcctggatctcacgcaggggatggagagtaaggaccagcccctctacctcatgctttcttcctgctgnctcgtangagcccacatncttntgtcctgagcangncanannctgnagnnctgccttgacaggatggct

SEQ ID NO: 6685 - DNA, 300 bp, Homo sapiens
ggaaatcatgaaggaaggcaagcagtttcaccggatagtgacataccatcgccacctttatgatatccacgtgactgttcagccaaagtataaacacgtttatcctaagaactctgtagtaagaaaaagccatttgtagggtgcttaagcttgtttgtaaaatggcctacttgaagtcctcatgaataatgagggttgactttcatttgcttgaaacttaaggaagtttgtgcctataaaagttactgcaattcagtatttctttatttttttcgagacagagtctcaatctgtcgccca

SEQ ID NO: 6686 - DNA, 296 bp, Homo sapiens
  misc_feature 77, 86, 88, 90, 91, 92, 97, 98, 169, 254, 259, 263, 268, 278: n = A,T,C or G
ggcgggcgaatgtagtctcagcctcccgagtagctgcgactacaggcgagtgcctccatgcccagctaattttttgnatttttagngnannnggcgnncaatcctgttagaaactgttggagctgcgccgaggcactgaccctgccaccctctactgcattaacttcanccacgactcctccttcctctgcgcttccagtgataagggtactgtccatatctttgctctcaaggatacccgtcttaaccgccgntccgngctngctcncgtgggcaangtggggctatgattggca

SEQ ID NO: 6687 - DNA, 279 bp, Homo sapiens
  misc_feature 94, 98, 99, 105, 107, 109, 120, 123, 125, 127, 138, 145,146, 151, 152, 154, 158, 164, 166, 173, 177, 178, 180, 192,193, 194, 199, 209, 217, 221, 228, 229, 232, 236, 237, 238,239, 243, 249, 261, 267, 271, 272: n = A,T,C or G
ggcaagccctggatgaaaacatggacctcttggaaggtataactggctttgaagactctgtccgaaagtttatctgccatgttgggggcatcanttannatgccntngnccgttgactgntgntntnagaggctctgngttcctnnagggnnanctcnttatanantcttgtntctnngntcttatcagcannntgctntataatcttntgtacctncccntttggtnnagnactnnnnccanataagnattgatgcctanctctcntatnnttattgc

SEQ ID NO: 6688 - DNA, 300 bp, Homo sapiens
gtgaaagcggggcctcacgatccttctgaccttttgggttttaagcaggaggtgtcagaaaagttaccacaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatc

SEQ ID NO: 6689 - DNA, 300 bp, Homo sapiens
gtcggctcttcctatcattgtgaagcagaattcaccaagcgttggattgttcacccactaatagggaacgagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgt

SEQ ID NO: 6690 - DNA, 300 bp, Homo sapiens
ggaagaaaagtggcagcatgaacagtaagagaatcattacaggctgggtgcagtggctcgcgcctgtaatcccagcactttggtaggctgaggccaggagtttgagaccagcctgggcaacatggtgaaaccctgtccttacaaaaaagttaaaaattagccgggatgtgataccttgtgcctgtggtcccagctacgtgggaagctgcggtggaaggattgcttgagcctgggagatcgaagcttcagtgaaccgtaattgcaccactcccttccaggctggaggacagagcaagaccc

SEQ ID NO: 6691 - DNA, 297 bp, Homo sapiens
  misc_feature 55, 64, 65, 79, 80, 82, 83, 84, 85, 95, 99, 100, 102, 116,117, 120, 122, 133, 137, 139, 142, 145, 146, 150, 151, 158,160, 162, 164, 166, 170, 174, 176, 177, 179, 182, 186, 187,204, 205, 206, 211, 214, 215, 216, 220, 226, 232, 233: n = A,T,C or G
  misc_feature 237, 239, 245, 249, 256, 257, 258, 263, 266, 283: n = A,T,C or G
ggatgggcagcccaccatgtgttcagatgggatattatggtatttttcatgtggnattgcctgnnatggtttatatttnncnnnnttttttacangggnntngtattgtttcttannttncntgttttttcgnattntnatnttnncttnnttttttntntntntntttntttngnntnatntttnntttgattcttctatttnnntttcnttnnntttntccttnttagtnnattntntttttntttncattgtnnngtttnttnattttttttttttattnatattttttaatta

SEQ ID NO: 6692 - DNA, 265 bp, Homo sapiens
  misc_feature 146, 147, 158, 160, 162, 163, 177, 178, 179, 186, 188, 194,195, 198, 199, 202, 204, 205, 206, 209, 210, 212, 216, 217,218, 221, 231, 236, 258, 260, 262, 263: n = A,T,C or G
ccctgcagacttcttcttggacatcattaatggagattccactgctgtggcattaaacagagaagaagactttaaatccacagatatcatagagccttccatgcaggataagccactcatagaaaaattagctggagatttatganntctccttcttntncnnagagactttagctnnnttacatntncttttnngtnnttnannnaanntntttnnncgnttttttattntgggnttttatttttgttttatttttntntnnat

SEQ ID NO: 6693 - DNA, 300 bp, Homo sapiens
tccgcacccaccgtggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgc

SEQ ID NO: 6694 - DNA, 279 bp, Homo sapiens
  misc_feature 107, 134, 135, 139, 141, 143, 145, 155, 159, 160, 161, 169,170, 174, 176, 180, 181, 186, 196, 198, 203, 204, 206, 210,216, 220, 221, 226, 228, 230, 234, 239, 240, 243, 249, 252,255, 259, 260, 262, 264, 265, 266, 267: n = A,T,C or G
gagaccttgacaagaaagatgcatcaatcaacatagaaaatatgcagtttatacacaatggcacctatatctgtgatgtcaaaaaccctcctgacatcgttgtccancctggtcacattaagctctatgtcgtnnaaanananantttgtctgtnctannngttttttnntttntnggtnntccangtctttaagnanctctnntnttgnctcatntttnntgctncntnatcntgtgnnagncgtctngtnctnctanntntnnnntttgatcttttt

SEQ ID NO: 6695 - DNA, 300 bp, Homo sapiens
  misc_feature 71, 72, 74, 83, 88, 89, 91, 92, 96, 111, 113, 117, 120, 122,123, 125, 126, 133, 141, 150, 176: n = A,T,C or G
gaggatatagcgatagagatggatatggtcgtgatcgtgactattcagatcatccaagtggaggctcctanngngattcatangctanntnnggcnccatgactgagcgcntnaccnttncnngnnccctcgncgtcctangcggctggntaacccatatcgctactaccccgcanttcccggacatgatcctctccgcctctcgagcctctagaactatagtgagtcgtattacgtagatccagacatgataagatacattgatgagtttggacaaaccacaactagaatgcagtgaaa

SEQ ID NO: 6696 - DNA, 300 bp, Homo sapiens
gctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaa

SEQ ID NO: 6697 - DNA, 300 bp, Homo sapiens
gtattaaataagatgtctttaaacagaaacacacatatatgtattgattgattaatgaggctctcaggaacctgactctgtgtttcccctaggagcagtgtttcagtattcactaatcgagtgttcatggtgactttatagaaccactgcaaatagtgagaattaactatacatatatgtttctgtgtgtacgcacatgtgtgtgtatgcatacttgtctctaaacatatgggattatactctgctgctgttttgctctttatgtcattatgtatactatataagtatatttttacatta

SEQ ID NO: 6698 - DNA, 299 bp, Homo sapiens
  misc_feature 138, 139, 140, 142, 143, 145, 147, 150, 154, 155, 159, 160,162, 172, 177, 178, 180, 182, 189, 195, 196, 198, 199, 200,201, 203, 207, 208, 222, 223, 226, 228, 231, 232, 236, 237,238, 239, 241, 243, 253, 254, 256, 259, 260, 266, 267: n = A,T,C or G
  misc_feature 268, 272, 273, 281: n = A,T,C or G
gaagtgaatgaaaagaaagacagagttacagatgcccttaatgctacaagagctgctgttgaagaaggcattgttttgggagggggttgtgcccttcttcgatgccttccagtcttggactcattgacttcagctaannnanntnantanatcnntagnntntcaccttttnttttnnananaggcctntttttnntnnnncnttgnnttttctttgggtcnnctntnttnntttnnnncntncctcttttgnntnaanntctttnnnttannttcttttnatttgttttttgggtctt

SEQ ID NO: 6699 - DNA, 300 bp, Homo sapiens
cagagaagggacagaacctgacttcaaaatttaatatagtaatcaagaaagtatggtatgggtgagagaatagacaaatagatggaataaaatagagattccagaaagacccacacaactagagtccactgatctttcaaaaaggagcaaaggcaattcaatggagaaaggatggtcttttcaacatggtgctgtaacaattggacatccacatgccaaaaaaagatgaatctagacaccttacatctttcacaaaaattaactcagatcatagacctaaatgtgatgtacaaaagtata

SEQ ID NO: 6700 - DNA, 300 bp, Homo sapiens
gagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagctt

SEQ ID NO: 6701 - DNA, 296 bp, Homo sapiens
  misc_feature 173, 177, 181, 209, 222, 238, 247, 253, 256, 258, 261, 270,280, 281, 286, 289: n = A,T,C or G
gtaaactgtatatctgtaatatgaatcccagcttttgagtctgacaaaatcagagttaggatcttgtaaaggaaaaaaaaaccggaccaaaatggagatgagtacttgctgagaatgaatgagggaaggagttggcatttgttgaaagtatagtctttttctctttttttttnaatngcancttttactttaaatttaggaggtcagtncccaggtttgttncatgggtatattgggngatgctgancttggnatncnaangatcctgtnacccaggtanngagtntangccccca

SEQ ID NO: 6702 - DNA, 297 bp, Homo sapiens
  misc_feature 64, 70, 74, 90, 96, 104, 110, 113, 117, 119, 121, 124, 126,127, 128, 130, 132, 135, 144, 147, 161, 163, 165, 166, 173,177, 179, 182, 188, 189, 190, 191, 195, 197, 199, 207, 209,210, 216, 227, 228, 229, 232, 242, 248, 250, 254, 262: n = A,T,C or G
  misc_feature 265, 266, 267, 269, 272, 275, 280, 285, 286, 290: n = A,T,C or G
gtcaacatgaagggcaatgacatcagcagtggcacagtcctctccgattatgtgggctcggcgncttccntggncgcaggctttcatcgntatgtntgtctgtngtattntcncttntngnttntnnntntntgntgttttttngtnctttttttctgctntntnntcctttntttntnctnctaggnnnntttntncntttcttantnntttttncttttttttgnnnttntttttttatntatgtngntttntttgtttntannntnttntgnattcnattgnntatngctattt

SEQ ID NO: 6703 - DNA, 300 bp, Homo sapiens
ggatctgtttccagtaatagtattcttttttgttccacaaatcatagatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtac

SEQ ID NO: 6704 - DNA, 293 bp, Homo sapiens
  misc_feature 218, 219, 254, 267, 275, 281: n = A,T,C or G
cagagaagggacagaacctgacttcaaaatttaatatagtaatcaagaaagtatggtatgggtgagagaatagacaaatagatggaataaaatagagattccagaaagacccacacaactagagtccactgatctttcaaaaaggagcaaaggcaattcaatggagaaaggatggtcttttcaacatggtgctgtaacaattggacatccacatgccnnataaagatgaatctagacaccttacatctttcacnaaatttaactcanatcatatnacctantgtgatgtacct

SEQ ID NO: 6705 - DNA, 267 bp, Homo sapiens
  misc_feature 124, 142, 149, 150, 165, 166, 169, 173, 174, 175, 176, 177,178, 182, 186, 187, 188, 190, 191, 192, 207, 208, 209, 216,220, 221, 224, 227, 232, 233, 235, 238, 240, 241, 243, 244,245, 249, 250, 251, 254, 256, 259, 260: n = A,T,C or G
gacggaagtaaattatgatgtccagggggagatggaggataggacgtatttataataggtatatagaacacaagggatataaaatgaaagatttttactaatatatattttatggttgcacacngtacacaccagaagatgntaaattnntttgtggcatttaannctntctnnnnnnttantgcnnntnnnctctaattttttttnnntttgtcntttnnttntcnaaganntnatntnntnnngatnnnttntntanntttcctt

SEQ ID NO: 6706 - DNA, 294 bp, Homo sapiens
  misc_feature 262, 268, 276: n = A,T,C or G
gtcgccttgggcgggagctgagcaaagtgatcattgttgacaattcccctgcctcatacatcttccatcctgagaatgcagtaagtggccccaaagaaagaaaatgtcgtgctccatctgagccctctgtcttgccaggcaggtaccacttttgagcacctacacaagaaggtctctgggccttttcctaatgaaatcccagctctgccatttagcagttgcgtgtcattgaccaagttatttaacctcactgagcctcggntgcctnatctgcanatgggaattataggaatg

SEQ ID NO: 6707 - DNA, 297 bp, Homo sapiens
ttaaatcttacttgatcatttagagttttgcttttataaacaagccttttgatacagaggcagaagccagtgaaaaatacttttatagagatgaggtctttttattttatttttttatagagacaaggtcttgctatgttgcttaggctccaacccctggcctcaagccatcctcctgcttaggcctcccagagtgctaggattataggtgtgagctaccgtgctcaactgaaaaatagtttagaagacagtcctactcgacaaatattttctttttcttttctttttttttttttg

SEQ ID NO: 6708 - DNA, 262 bp, Homo sapiens
  misc_feature 146, 147, 155, 179, 185, 192, 198, 199, 202, 204, 205, 206,210, 213, 216, 218, 219, 223, 224, 227, 233, 240, 247, 249,250, 251, 252, 253, 257, 258, 261: n = A,T,C or G
ctcggggctccaggctggcttgcccgcgctctttcttccctcgtgacagtggtgtgtggtgccggaaagggtgatggacttagcattcacagacgacaccacacaccactgtcaaataaacagctatttaagggggaaaaaaaaannaaaaaaanaaaaaaaaaaaaaaaaaaaaacanaaaaanaaaaatnaaaaannaantnnnaaancanaanannaatnntanacaaanaaaaaangaggtantnnnnnagcnnacnt

SEQ ID NO: 6709 - DNA, 280 bp, Homo sapiens
  misc_feature 130, 135, 149, 151, 153, 155, 161, 166, 173, 174, 184, 188,189, 191, 193, 208, 237, 238, 240, 241, 242, 243, 244, 245,246, 248, 251, 253, 254, 255, 256, 257, 258, 259, 261, 262,263, 264, 265, 266, 268, 271, 272: n = A,T,C or G
gattctttcccaggccacaagacattttctgctcggaaccttgtttactaatttccactgcttttaaggccctgcactgaaaatgcaagctcaggcgccggtggtcgatgggaccctttgtggagtctgngatgntataggtttattcnanancnttatangctanagtaaannagttaacaanaacnntngnattcattttatgttncaggttcagggggaggtgtgggaggtttnntnnnnnnntnatngnnnnnnntnnnnnnanatnntttttttt

SEQ ID NO: 6710 - DNA, 300 bp, Homo sapiens
ctcatctctaccaacaacaacaacaacaaaattagctgggtgtggcagtgtgtacctgtagtcctagctacttggcaagctgaagtggcagcattgcttgagcccaggagttaaaggctgctgtgaattatcattgtgccactatacttcagccagagtgacaaaggaagaccctgtcttgaaataaaaattttttaataaaattaattaactttagttactataacattctttataacctttaaaaaattttaaatttttgactctttttgtaataaacagcttaaaacacaaacacat

SEQ ID NO: 6711 - DNA, 300 bp, Homo sapiens
ggcaggaggatggcttgaacattggaggtcgaggctgcagtgaactgagatggcaccactgtattctggcctgggtgacaaagtgagactctgtctcagaaaaaaaatactgtggaaagcctctatgtcccaatatgaaacaatctcctggatatactcttgtggaaaaaagcaacgttccacagagtatatgtagtaagttttatctatgtcagaaagaaggagaaataaaaatatgtgtatgtatttgcatatttttgtaaaaggtagacacaggaaggataaaccaaaaatgcaaat

SEQ ID NO: 6712 - DNA, 300 bp, Homo sapiens
gccgacctgtgggacctgatctttctctggggtagggccatcctgggcactgcagggggctgagcagtgtcgctggcctccgcctactttatgccaggagcacccttagtcatgacaatcacaaatggccccagacatcaaccagtgtgccctggagggcagagtctcccctggtgagacctccattcggtcactccctccacccccagggccacgctcaaagcctgtcccagaggagatcctggcctccgcctgatctcctctgaccctttacaaaagtttgctgacccctgacttaag

SEQ ID NO: 6713 - DNA, 300 bp, Homo sapiens
cagctcctccaccagcataatgggacccagcatccctgccaaaactcgggaggtgctcgtcagccacctggcatcttacaacacatgggctttacaaggcatgtatggagtttcttgtgggcttggcaggtggctgtgaaggccatcagtgtctgaagcctgtacttgcccctccccaggtcctgtgagtggagaggcacagagtgttctgggctagctgagtgtggaggctgggtggctctgatgctagccaatcactctacgctctaggctcacacctttccaccttcgacttcgcca

SEQ ID NO: 6714 - DNA, 299 bp, Homo sapiens
  misc_feature 115, 118, 119, 120, 122, 127, 129, 133, 136, 139, 144, 147,148, 149, 154, 160, 164, 177, 194, 195, 197, 205, 219, 238,246, 247, 249, 253, 259, 269, 272, 273, 277, 279, 282, 285: n = A,T,C or G
ttttttgccttttacctggtcccttgatcatgagttttagctcagataaccaggtattttgaagacgtgattgtccttggccctgccccatcccttccctttaaagggttaaatnttnnncntgccntncctntgnccngaatnccnnnatacnctgcangccntcctgggcaacancacactgagcagaccannangaaacctngggggctttgaccntgtggtctctgatggcttngggggtgnntntgcngtccangacaaccggntannctgnantgncgnttcctacccatgcc

SEQ ID NO: 6715 - DNA, 300 bp, Homo sapiens
ttgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagttta

SEQ ID NO: 6716 - DNA, 300 bp, Homo sapiens
taagggatttgtggcataccatcaagccaacccattatacacattatggaaagttcacaagaagaagagagaaaggaatgggcagaaagtttacttaaatagtgacccaaaacttcccaaatctgggaaagaaaatggacatccagattcaagaagactaaaggaccccaaataagatcaacataaacacacaccaagacacattataataaaattgtcaaactctcaaagacagtaagagaattttgaaaacaagaaaaaagtgacttgtcgtgtactagggaacacacatcagactat

SEQ ID NO: 6717 - DNA, 268 bp, Homo sapiens
  misc_feature 89, 97, 99, 100, 101, 108, 113, 116, 118, 120, 122, 126,128, 133, 134, 139, 140, 145, 147, 150, 152, 159, 162, 167,170, 171, 177, 181, 188, 195, 198, 201, 203, 204, 208, 215,216, 222, 223, 224, 226, 231, 243, 245, 250, 254, 258: n = A,T,C or G
  misc_feature 262, 263, 264, 266, 267: n = A,T,C or G
gagcagggatcttataaagggccagaaataagatgtgtggttcacatagatagtgagcgtaacatctgtattaaacataggatagaagntttttttngnnnttgattnctccnctngntncngttntnttctnnggttnngtctntnttntnacttttnttnttatnttnngtcttntttntgcttcnatgcttnttnttntnntttnttatttnnccttcnnntnttttntttttttttttntngtttntttncccntctnnntnnt

SEQ ID NO: 6718 - DNA, 300 bp, Homo sapiens
  misc_feature 141, 142, 148, 151, 155, 161, 167, 172, 175, 188, 194, 202,209, 213, 214, 216, 222, 226, 228, 232, 235, 238, 239, 244,249, 250, 252, 255, 263, 266, 268, 269, 274, 275, 279, 281,282, 289, 290: n = A,T,C or G
gataacagcagcctccgctctctcattgagaagccccctattctcagtagctctttcaatcctatcacagggaccatgctggccggcttccgcctccacactggcccgttgccggagcagtgtcatgtgatgcatattcannctgccnaanggangaatangcgcangcgcntanagtaggcggcccnggatcntgggccangagaaanacgnncnagatgngagngngacnagnggnngaatnggggnnanganagtggtgnggnannggagnngagngnnagcgggnngagggggagg

SEQ ID NO: 6719 - DNA, 300 bp, Homo sapiens
ctgccttccaacaaaatcgtcaagcgggcagaggagttggtggggcaggagttgccttattcgctgaccagtgacaactgcgagcacttcgtgaaccatctgcgctatggcgtctcccgcagtgaccaggtgcatcttcagcctgcatccccttcccaggagccaggccactccctcagctgccagaggctgggtccctgctggggccagggtgggatggaaatagacatgagcaagacaaaatagcagatatgaaactgttgtccttgagggtgtcacatttggggtggggacaagggt

SEQ ID NO: 6720 - DNA, 300 bp, Homo sapiens
gcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatg

SEQ ID NO: 6721 - DNA, 300 bp, Homo sapiens
gtcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggtcattcat

SEQ ID NO: 6722 - DNA, 300 bp, Homo sapiens
taacttaaaactgccttttcaatttccagcatgtatagaaaatatgattcgactagaataaagactgaagaagaagccttttcaagtaaaaggtgcttggaatggttctatgaatatgcaggtaggtattcatttgtatcatctaagactgatccttatgacaataaggagtaccttagagatgattaaagaatttaaaaatgtgtacatttcaaatttgggtgtgtgtgtgtgtgtgtccctgttagagggagagagggacatagctgtaacaaatcaccagatagcctattttatagc

SEQ ID NO: 6723 - DNA, 278 bp, Homo sapiens
  misc_feature 134, 141, 146, 153, 156, 158, 161, 164, 170, 181, 182, 183,187, 190, 191, 198, 199, 201, 206, 210, 211, 212, 216, 219,221, 224, 226, 232, 235, 236, 238, 243, 246, 249, 252, 254,255, 259, 260, 261, 263, 267, 270: n = A,T,C or G
gccatgggcactgtgagcctgggccagctccccctgccccccatccctcatgtgttctcagctggcactggctctgccatcctgcctcatttccatcatgcattcagataattgatttttaaagtgtatttttngtattcnggaanacgtatnatnantantcntaattnttataagattnnntttnggnnttttaanntntgtantatnnntatnttncnttntntatttntannanttttntanttnttnannagtnnntnactnttntaatttta

SEQ ID NO: 6724 - DNA, 300 bp, Homo sapiens
agaaagcagagtgtgcagttgtgttgactctttgtctcccggtgataaacccatgtgatattttaccaaagtagataatcaaaagaattgaccaaaaaatattaaagcaaagcaaagaaacaaaaggtgatactgccagaagtgaaatttgaatggaacataaatggaattacagaggaaatagcaaagagtgggaatgttggcactgctgttgttccagtgactctagatttgctgccagacaaacttagtgaaagcattgtgacataaaggatgaacaagtgacactggcataagatt

SEQ ID NO: 6725 - DNA, 300 bp, Homo sapiens
ggagaatcacttgagcccgggagttctgggctgttgtagtgcactatgccaatcaggtgtctgcactaagttcagcgtcagtgtggtgacttccctggggactcccaggggactgccagattgcctaaggagagatgaactggccaggtcagaaatggagcaggtcgaaactcccatcctgatcagtagtgggattgtgcctatgaatagacactgtattccagcctgggcaatatagcaagatcctgtctctaaacaaaataaaacaaaacataaaaaaaaccccttgtctggaacaac

SEQ ID NO: 6726 - DNA, 268 bp, Homo sapiens
  misc_feature 129, 134, 135, 143, 150, 152, 154, 157, 162, 163, 164, 165,166, 169, 171, 176, 186, 190, 194, 195, 196, 205, 206, 208,212, 214, 218, 221, 227, 228, 237, 238, 240, 243, 244, 245,248, 252, 258, 259, 263, 264, 265: n = A,T,C or G
gggtggcctgtccagctcagcatccttggaagtggccacgtacaccttcctccagcagctctgtccagactcgggcacaatagctgcccgcgcccatttgcgtcattgccccatggtctgcctcagctntgcgnntctgaccntagtggngntnctnattgnnnnncanancccanctatcgtgangatncttnnnttctgtttnngncatngntatntgntcttannattgcatanntntcnnngtncttntttttnntatnnnaaa

SEQ ID NO: 6727 - DNA, 300 bp, Homo sapiens
gttcagtgctccccgggattactctggctatcaacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttac

SEQ ID NO: 6728 - DNA, 300 bp, Homo sapiens
aaaaatatgggctgggattacaggcgtgagccaccacacccagcctttcttttagtgctttaaatatattggccctctgccttctggcctccaagtttctgatgaaaaatctgcttgtcattttattgaggatcccttgtatgtgacaagtttcttccctcttgctactttcaggattctaactttgcatttcaaaagttagactataatgtgtctcagtgtgggtctctttgagttcattttacttggagttacttgagctgcttggatgtttatatgcatgtctttcatcaaatttgg

SEQ ID NO: 6729 - DNA, 300 bp, Homo sapiens
ggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctca

SEQ ID NO: 6730 - DNA, 300 bp, Homo sapiens
ggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacagg

SEQ ID NO: 6731 - DNA, 275 bp, Homo sapiens
  misc_feature 242, 245, 259, 262, 265: n = A,T,C or G
gaaatactttgagcagctctgtggggtgtaaaccttctggtggggactgaaaatggcctgatgcttttggaccgaagtgtgcaaggcaaagtctataatctgatcaaccggaggcgatttcagcagatggatgtgctagagggactgaatgtccttgtgacaatttcaggaaagaagaatagagctacgagtttactatctttcatggccagaacgcagaatactacataatgacccagagngtnaaaatttaaatcanggnctntatcactgtt

SEQ ID NO: 6732 - DNA, 300 bp, Homo sapiens
  misc_feature 104, 108, 110, 111, 116, 119, 120, 121, 126, 127, 130, 131,135, 136, 137, 142, 144, 146, 150, 152, 155, 168, 169, 171,173, 177, 183, 185, 193, 195, 197, 200, 202, 204, 205, 207,221, 223, 231, 236, 239, 241, 246, 247, 251, 257, 265: n = A,T,C or G
  misc_feature 267, 268, 270, 275, 276, 277, 278, 279, 286, 287, 291: n = A,T,C or G
actaactgggggattttatttataagggctctagaaaaaacgagttattcacaccagcatcatcttaactaacattctgaactagttagtgctgctttttattntgtntnntcttnttnnnttttnnttnncttnnntttcnantntttntnttntttttatctcttnntntncttntttttntntttctttntntngtntntnnantattctattaggtntntcatttgngtttnctntnttttnntgtntcgctnttcttggncnntnttttnnnnnttatttnntttnttttggttt

SEQ ID NO: 6733 - DNA, 300 bp, Homo sapiens
gaacatcccacccccccgcagccagtgctccttgtcaagctccccccgtcactccaggtgggagccaccccggtgagggggtgtgccacttgtccccagggcactcctctgggcatcccgggtgggggattttggggccgtggggggcagtctctggtacctgtgtgcgtcagggatgctctgcacctgcaaccaggtgtcgtccacgggcgggggcatggtaacagtggtcctgttgatgtcaccgatgatgctgagcgcctccttcagcgcgtggtgcatgtgcagcatctcgtcgtg

SEQ ID NO: 6734 - DNA, 266 bp, Homo sapiens
  misc_feature 130, 132, 152, 157, 163, 175, 177, 180, 182, 196, 201, 214,221, 223, 224, 226, 227, 228, 229, 230, 234, 243, 244, 249,250, 251, 259, 264, 265: n = A,T,C or G
gaagccagccaacttcttggatcttggaggtggtgtaaaggaagctcaagtatatcaagcattcaaattgctcacagctgatcctaaggttgaagccatccttgtcactatatctggaggtatagccatnanaaggctgcaattaccaaggnatcancaaccnattgcattcatntnatncntcaggttcacgtgnaggcntgggaggtttaantagcaangnntnnnnnacangggctacanncaatnnnccccgtantatcnna

SEQ ID NO: 6735 - DNA, 275 bp, Homo sapiens
  misc_feature 137, 146, 148, 149, 159, 160, 165, 168, 174, 181, 182, 185,189, 192, 198, 200, 202, 203, 207, 209, 210, 214, 216, 219,221, 222, 223, 224, 225, 226, 230, 235, 236, 239, 242, 243,249, 250, 254, 257, 258, 259, 261, 263, 267: n = A,T,C or G
ggaggccacagtaaacctcctcacagcccactggtcctcaagaggtgccacgtctccacacatcagcacaactacgcagcgcctccctccactcggaaggactatcctgctgccaagagggtcaagttggacagtgncagagtccngnnacagatcacnntctanctnaatctncactcannctncagnttncttggncncnngtangnnaatngnaantnnnnnntttntttcnntanatnnttcttnnactnttnnncntngttnattttctt

SEQ ID NO: 6736 - DNA, 269 bp, Homo sapiens
  misc_feature 99, 102, 107, 114, 115, 116, 118, 121, 122, 123, 129, 143,144, 150, 156, 158, 161, 168, 173, 174, 177, 185, 186, 188,190, 191, 192, 198, 207, 211, 212, 213, 215, 217, 226, 228,234, 236, 237, 238, 239, 245, 246, 248, 251, 252, 257: n = A,T,C or G
  misc_feature 258, 263, 264, 265: n = A,T,C or G
actacttttatttataaggaaagtttctctattttgtttataaacattaaaccagtgctgtgtgaaggcacttaattggggggaggtgtgggaggtttncangcccntaccacnnntnacnnnccatanccccccattgttgnnaaaaanggggantnganttactancaganntanccacctanntnannncccccnccatgcccncatnnnangnggctgcctntnacgaanannnncctggnnanagnncctannccttnnnattt

SEQ ID NO: 6737 - DNA, 295 bp, Homo sapiens
  misc_feature 116, 123, 126, 131, 135, 136, 142, 151, 155, 157, 158, 159,162, 171, 176, 177, 178, 184, 186, 187, 189, 197, 215, 216,222, 223, 229, 243, 244, 245, 251, 253, 265, 266, 272, 275,277, 278, 282, 284, 286: n = A,T,C or G
aagagtgacaagcattggtaacagtgccttagaactgtgtcagttagtctgatttggaaatcctttatgtaaagctgagactggtcctggttttgttccctttggctacagacctnttgtccnagntctantgtnnccattncggcctttncagntnnntgnattcctccntatcnnntttctntnntncctttatnttcctgttctttattttnnctttanntcctcngtggatctctattnnnttctangnggcctcttcctnnttgganttntnntctntnantccttgtcc

SEQ ID NO: 6738 - DNA, 262 bp, Homo sapiens
  misc_feature 99, 102, 103, 104, 105, 107, 109, 111, 124, 125, 129, 130,132, 138, 139, 140, 141, 142, 145, 148, 153, 155, 160, 164,165, 170, 172, 173, 179, 183, 187, 192, 193, 197, 198, 200,204, 208, 214, 217, 221, 222, 223, 224, 225, 231, 234: n = A,T,C or G
  misc_feature 239, 247, 255: n = A,T,C or G
ctgtaaatgacaaaagaaaaagaaaaattgagccttgggacgtgcccatttttactgtaaattatgattccgtaactgacttgtagtaagcagagtttntgnnnncnangnattgtagactttnntatnntnattttnnnnnganttnctttntnaattncttnntaatntnnacattnatgnttcntttannttanngnttantttntattgnttntctnnnnntttttnttnctttnattttttntttacttnttatttt

SEQ ID NO: 6739 - DNA, 272 bp, Homo sapiens
  misc_feature 167, 174, 175, 176, 181, 189, 190, 196, 197, 199, 200, 204,205, 207, 208, 209, 213, 215, 216, 217, 226, 230, 235, 236,239, 240, 241, 242, 244, 245, 247, 249, 251, 254, 255: n = A,T,C or G
ggagaattcccttattgctcacttctctgagcttcaaggttctgaagcatccagataagaagttccgggttggccaggccctgagggccaccgttgttggcccagattcctccaagaccctcttatgtctgtccctcacaggtcctcacaagcttgaggaaggggangtggccnnngccgntcggtganngtgatnnannaacnngnnnctcncnnntcctcttcncctntgctnncannnnannancncnctnnttcactgaccgacttct

SEQ ID NO: 6740 - DNA, 300 bp, Homo sapiens
gatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcgga

SEQ ID NO: 6741 - DNA, 288 bp, Homo sapiens
  misc_feature 107, 114, 117, 119, 120, 124, 128, 132, 135, 141, 144, 145,147, 151, 153, 154, 156, 158, 159, 160, 164, 166, 170, 183,187, 188, 189, 193, 201, 204, 213, 214, 216, 217, 219, 221,224, 225, 227, 229, 230, 231, 232, 235, 236, 240, 247: n = A,T,C or G
  misc_feature 251, 252, 253, 256, 268, 271, 273, 275, 276, 279: n = A,T,C or G
ttttgaccttgaaacgatgatcctcaaggtccttctcagcactggtattccctgaaggcattggatgaataacggagattctaacagtctctgttaagacaggatgngtaaagnggncnntgancttnaatnttnttcctntannantttntnngnannnggantncttnatttttttggatngatnnntganattttaanttnttttgtttnnanntngnttnnanannnngcnntttntaggggngtannnttnacttttatttanctntntnnggnattttgttt

SEQ ID NO: 6742 - DNA, 259 bp, Homo sapiens
  misc_feature 116, 119, 127, 129, 132, 136, 138, 139, 140, 142, 144, 146,157, 160, 161, 184, 187, 189, 190, 193, 213, 215, 218, 219,220, 226, 227, 231, 233, 239, 241, 242, 245, 249, 250, 251,253, 257: n = A,T,C or G
gccatcttccagtaattcgccaaaatgacgaacacaaagggaaagaggagaggcacccgatatatgttctctaggccttttagaaaacatggagttgttcctttggtccttatatngcnaatctatntnttnggcnannntntncntgtttttttcnatnntttttttttttttttttttttgntcncnnagntttaataaaatttttttttnanccnnntattannctancntttatntnnaanatannncnattngt

SEQ ID NO: 6743 - DNA, 300 bp, Homo sapiens
  misc_feature 109, 110, 122, 129, 138, 152, 155, 157, 165, 167, 168, 171,172, 174, 185, 210, 211, 220, 229, 251, 282, 292: n = A,T,C or G
tgcccccagaactgtcctggctccttccgtattaaacgcatttgcattttgagaagtgtccttcccacttcagccctccggagagactaccctagtctttctggggtgnngatgaactaagntgaagcntggcctatntgctgagagggtangancngaagtganannggnntnaatgcccactngaatgaagctgagagagagatctannaaaagctanaactcatgntgtctatctttgaacttggganaaacccacaaggtgctgctgcttatatctgngaagcactancttattct

SEQ ID NO: 6744 - DNA, 270 bp, Homo sapiens
  misc_feature 151, 164, 165, 169, 170, 171, 174, 175, 176, 178, 179, 180,182, 185, 190, 191, 193, 195, 200, 201, 202, 203, 208, 210,212, 213, 214, 215, 217, 218, 220, 224, 225, 228, 230, 231,232, 233, 237, 238, 240, 241, 242, 245, 247, 252, 253: n = A,T,C or G
  misc_feature 254, 255, 256, 259, 261, 267, 269: n = A,T,C or G
agcatatgcttgtctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtnctgctttgattcnnttcnnncannngnnncntcntttanntncnttatnnnnccctngnannnncnntncctnngcntnnnnctcnntnnnctntntttcnnnnntcntnttttantnc

SEQ ID NO: 6745 - DNA, 300 bp, Homo sapiens
ctgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccag

SEQ ID NO: 6746 - DNA, 281 bp, Homo sapiens
  misc_feature 118, 122, 123, 129, 132, 133, 138, 145, 153, 165, 180, 187,188, 209, 211, 218, 237, 240, 257, 266, 268, 270, 271, 274: n = A,T,C or G
tccagtcgcaacggccagacctgacctgccagctccgggcgtggggtgaaatctcttgattcctagtctctcgatatggcacctccgtcagtctttgccgaggttccgcaggcccagnctgnnctggcnttnnagctnactgccnacttcagngaggatacgganccccgcaaggacaanctgcaanngcgagagtatcatggacactnanggactgntgctttcatgtacttccantgntggatcatggtatgacnacattttancnanntgncatttga

SEQ ID NO: 6747 - DNA, 273 bp, Homo sapiens
  misc_feature 123, 124, 125, 130, 131, 135, 147, 149, 152, 160, 163, 165,166, 168, 169, 171, 174, 177, 181, 183, 187, 188, 193, 197,201, 204, 208, 210, 214, 217, 229, 233, 236, 238, 243, 248,252, 255, 257, 266: n = A,T,C or G
gggatcccgagctgtcctgcagctgtaccctgagaactcagagcagttggagctgatcacaacccaggccacaaaggcaggcttctccggtggcatggtggtagactaccctaacagtgccannntatannaatnttcctttgtttnanatntgaccttnttncnntnntnctnttngctntntatnnacttnttcnaaanctncttngngtgntcngttctatctatntatnttntntctcntttcntttntgnanctttgattntatttat

SEQ ID NO: 6748 - DNA, 267 bp, Homo sapiens
  misc_feature 163, 165, 166, 167, 175, 178, 179, 180, 181, 182, 183, 184,187, 188, 189, 191, 192, 196, 199, 201, 206, 208, 209, 211,212, 213, 215, 217, 226, 228, 229, 230, 241, 242, 243, 246,247, 248, 251, 252, 254, 256, 257, 259, 263: n = A,T,C or G
cttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggatgagtgctncnnnataatggntcnnnnnnnttnnntnncttnttntntaaantnnannnancntgaatttancnnnattcataaacnnnatnnntcnncntnntntaantcta

SEQ ID NO: 6749 - DNA, 252 bp, Homo sapiens
  misc_feature 141, 142, 144, 151, 158, 161, 162, 165, 168, 172, 175, 176,185, 188, 189, 191, 193, 197, 199, 200, 201, 202, 203, 204,205, 212, 215, 216, 220, 222, 230, 232, 233, 235, 238, 242,246, 247, 251: n = A,T,C or G
cccaggatgcccttgagggggccctccgacgcctgcttcaccacctttgacgctggggctggcattgccctcaacgaccactttgtcaagctcatttcctggtatgacaacgaatttggctacagcaacagggtggtgganntnatggccnacatggnctnnatngantatnaanntgggatgtnccnngngnatcnannnnnnncgattcnttnntttnantttctgtntnncnttnaatntcgnntttnt

SEQ ID NO: 6750 - DNA, 260 bp, Homo sapiens
  misc_feature 130, 134, 135, 139, 140, 150, 151, 152, 153, 155, 157, 159,160, 171, 172, 173, 174, 177, 179, 180, 185, 187, 189, 193,194, 195, 204, 205, 206, 207, 210, 216, 221, 223, 225, 228,231, 232, 234, 235, 239, 242, 243, 244, 250, 252, 253: n = A,T,C or G
  misc_feature 254, 257: n = A,T,C or G
aagactttctcctaatgcttggaaaaccataactgacatagttctaaatggcacagtcttcgtgacactagatattggaaaacaactaattaaagctcataaaggagcagcattcctttttatttctacnattnntgtnnatactgtatnnnntnantnnttcctatcctnnnnttntnnatttncntntttnnnttattcttnnnntantattgnatttntnanttnaanngnnctgntgnnntttttngnnnttntat

SEQ ID NO: 6751 - DNA, 266 bp, Homo sapiens
  misc_feature 120, 130, 142, 143, 150, 155, 158, 165, 166, 167, 168, 169,171, 175, 180, 182, 183, 184, 188, 199, 200, 205, 212, 215,216, 224, 225, 226, 228, 230, 231, 234, 239, 242, 243, 245,250, 251, 252, 256, 259, 262, 265: n = A,T,C or G
attttcaatttggagcattaactaaatgctcatacacagttaaataaatagaaagagttctatggagactttgctgttactgcttctctttgtgcagtgttagtattcaccctgggcagngagctgccangctttctggtgnnttcttgntcccnctntctattnnnnntncttntccgncnnncctnttcctctgganncttcnttctctnctnntttgtctnnntngnnctnttctnctnnanctttnnntttntcnccnctng

SEQ ID NO: 6752 - DNA, 291 bp, Homo sapiens
  misc_feature 159, 164, 167, 168, 174, 180, 190, 201, 202, 204, 206, 211,217, 219, 220, 227, 229, 235, 237, 240, 244, 257, 259, 261,262, 267, 270, 274, 275, 276: n = A,T,C or G
gtggagctacagatgaagatgatggagcttgctaataaatcccttcccaccccaagcttcctttatgactgataactagctccagctgcctttaagttcagtatccctagtgagctgactttccccatcttgctctcttctgcctacttttctgctccntctanacnntgttgnctctcntttagcggcngcctactctanntncnttttngtttangnncctaaananccgggntnacnaatncttgccttgatcntncnnctttnggngttnnntttttaattttggaa

SEQ ID NO: 6753 - DNA, 264 bp, Homo sapiens
  misc_feature 168, 196, 198, 202, 215, 217, 218, 225, 245, 247, 263: n = A,T,C or G
ctttggaaacaatatgcaatgtgaagcggtcgtgttgtgagtttagtaaggctgtgtacactgacacctttgcaggcatgcatgtgcttgtgtgtgtgtgagtgtgtgtccttgcgcatgagctacgcctgcctccactgtgcagacctggtatgtggcatgaacatnaggaaggcctcttttcatgatcatggcntncaanagtgctccgagcncnntctttgncatgatacaaaccgatgctntntgactgatgactctgnt

SEQ ID NO: 6754 - DNA, 300 bp, Homo sapiens
  misc_feature 143, 146, 147, 149, 156, 157, 158, 160, 161, 162, 172, 173,176, 177, 181, 185: n = A,T,C or G
ttagccaggatggtctcgatctcctgacctcgtgatccacctgccgcggcctcccaaagttctaggattactggcatgagccaccgtgcctggccagcaattagaattttaacactggcagttatgaataatatgaaggagangtnnanatctgannnannntggattagcnntcnnttgngctnctttccgttcatctcatccacagctttctgtgcatcttcatgcctttcaaagcttacaaatccaaatcctttggattttccactttcatcagtcattactttcacacttaaggca

SEQ ID NO: 6755 - DNA, 270 bp, Homo sapiens
  misc_feature 104, 115, 117, 123, 125, 126, 128, 132, 133, 135, 138, 145,146, 147, 151, 157, 158, 163, 175, 176, 183, 184, 186, 191,192, 193, 194, 195, 198, 199, 201, 202, 203, 210, 219, 223,228, 229, 243, 244, 246, 247, 248, 249, 253, 257, 259: n = A,T,C or G
  misc_feature 260, 263, 264, 266, 269: n = A,T,C or G
aattagggctgctgtgatattgtcagcttgcattaacaattagaagatagagaacccgccatcagggtgtctacctaacttctcagggactacacttggtagcnttccaccattnanagaacngnnanctannanccntttgccnnnttancccaanngcttnctcacttctcannttccttnngncctannnnnatnntnnnatctttncccctagtncctnccttnncgccatcttctttnntnnnnttgncttnannttnntntcnt

SEQ ID NO: 6756 - DNA, 266 bp, Homo sapiens
  misc_feature 118, 156, 162, 163, 167, 181, 183, 188, 191, 192, 193, 194,196, 198, 199, 200, 202, 203, 213, 215, 218, 219, 223, 236,242, 244, 247, 250, 251, 254, 255, 257, 259: n = A,T,C or G
aggacagaaaaatgggtggtattggagggaattttggaaagtaaagtgtatgggttagggactactggacatactgggagtacagtttggttaatgagcctgaagtcctggactaagnggtaagttccatctggctttttaacaggtactaattgntgtgtnnagtnagggagttttttgntnttttnttnnnntntnnntnntcttttttantnttnntctnccacttctccttntttttntnttntcnnttnncntntttttct

SEQ ID NO: 6757 - DNA, 266 bp, Homo sapiens
gttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtcca

SEQ ID NO: 6758 - DNA, 300 bp, Homo sapiens
agaagaagcagttgaacagttctttagagttgggtgaaaaaaaatcatagccccaactaaaaatgctggggtcacaattgaagaggaaaaaaattcacaattgacctgaatagtaaattctctaatgtgggatcttgcattaatgaaagatctgggttaagccctcaagtctaatgattgataccaaggaaggcatcctgcagtattgccagaagtctaccctgaactgcagatcaccaatgtggtagaagccaaccaaccagtgaccatccagaactggtgcaagcggggccgcaagca

SEQ ID NO: 6759 - DNA, 264 bp, Homo sapiens
  misc_feature 236, 237, 239, 245, 246, 248, 251, 254, 255, 257, 259, 262: n = A,T,C or G
ctgcactgtgaacctgggcactccgcgccgatgccaccggcctgtgggtctctgaagggaccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaaaaaaaaaaaaaaaaaaaaaaaaaaaattaaatataatttaatannanaaaaannanaanaanntntntanat

SEQ ID NO: 6760 - DNA, 147 bp, Homo sapiens
gctcggtttgagggctcggcgcggggtttcctgttcctccttctgcgcggctgcagctcgggacttcggcctgacccagcccccatggcttcagaagagctacagaaagatctagaagaggtaaaggtgttgctggaaaaggctact

SEQ ID NO: 6761 - DNA, 280 bp, Homo sapiens
  misc_feature 173, 175, 184, 185, 187, 190, 195, 196, 201, 211, 212, 216,221, 223, 225, 226, 227, 229, 230, 240, 248, 251, 255, 258,266, 268: n = A,T,C or G
aattcaaggcctgtcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtatccattatatgctgcngntaaactagnnancanctacnnttgcnttcattttanntttnagttntntnnntnntttttgttgnttttgttntantttnctntctttatntntttttttttttt

SEQ ID NO: 6762 - DNA, 288 bp, Homo sapiens
  misc_feature 246, 261, 272, 274, 275, 279, 280, 281: n = A,T,C or G
gtaggggaggggctcctttccataaatccttgatgattgacaacacccatttttccttttgccgaccccaagagttttgggagttgtagttaatcatcaagagaatttggggcttccaagttgttcaggtcctctgacaccttttggtatcgttaattttactgatttgtgtagaatgtcagttgtattttaccagctaatatctagaaatgctggcaagaggggtttactccagctttagattgnaggtatgctaccttntttcatacagngnnttannnttactga

SEQ ID NO: 6763 - DNA, 163 bp, Homo sapiens
  misc_feature 151: n = A,T,C or G
tgaaattcagctaaccgagcagctacggtccctcatccccaacgaggatgtgagaaagttcatgtctcatgttatctggaccttgaaaatggaatgttcagaaacacatgtgcaagggagctgtgccaagctcatgtcgcgaacaggcctnctgatgaagctt

SEQ ID NO: 6764 - DNA, 262 bp, Homo sapiens
  misc_feature 138, 139, 140, 144, 149, 154, 164, 169, 172, 174, 176, 179,182, 184, 185, 187, 188, 191, 192, 202, 203, 206, 207, 208,210, 211, 220, 223, 226, 228, 231, 233, 235, 236, 237, 238,239, 241, 244, 246, 254, 255, 260: n = A,T,C or G
ataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgctgaannnatcnttcanacccntggactgtgntaacngtncntntcntcntnncnnttnntacctcttcnnggnnncnntccctattnggnatntnttntngnnnnngnctnanctttttannttttntt

SEQ ID NO: 6765 - DNA, 291 bp, Homo sapiens
  misc_feature 203, 207, 215, 216, 218, 223, 225, 233, 234, 235, 238, 241,243, 244, 249, 252, 257, 262, 263, 270, 274, 276: n = A,T,C or G
accaagtgcatttagttgaatgaagtcttcttggatttcacccaactaaaagtatttttaaaaataaataacagtcttacctaaattattaggtaatgaattgtagccagttgttaatatcttaatgcagatttttttaaaataaacataaaatgatttatctgtattttaaaggatccaacagatcagtattttttcctgtnatgngatttttnnantttgncncattttannntanttnanntgttnatnttttntctanntcttatntttntngcttatttttttttt

SEQ ID NO: 6766 - DNA, 264 bp, Homo sapiens
  misc_feature 139, 140, 141, 147, 154, 155, 160, 165, 166, 169, 170, 174,175, 176, 179, 181, 183, 184, 186, 191, 194, 202, 205, 207,212, 215, 217, 223, 229, 232, 235, 237, 238, 239, 242, 243,246, 247, 250, 252, 253, 254, 256, 257, 262: n = A,T,C or G
acaagaaaaatgattcaaaaaactgctgagccacttttggataaggaatcaatttcagagaatcctactttggatttaccttgttctatagggagaactgagggaactgcacattcatccagtacctcagatgtggatnnnccgggngcttctnnggctntttannttnnttcnnngtncntnntntgganttnttattctnttncntcgtncantngtgccnttactnttntcntnnnccnntanntgntnnnannggtcntt

SEQ ID NO: 6767 - DNA, 261 bp, Homo sapiens
  misc_feature 184, 185, 186, 187, 190, 192, 193, 196, 197, 200, 201, 202,203, 204, 205, 206, 212, 213, 216, 220, 225, 226, 227, 230,232, 239, 240, 241, 242, 243, 248, 249, 250, 255, 256: n = A,T,C or G
gctcactgaagcttaagtgaggatttccttgcaatgagtagaatttcccttctctcccttgtcacaggtttaaaaacctcacagcttgtataatgtaaccatttggggtcccgcttttaacttggactagtgtaactccttcatgcaataaactgaaaagagccatgctgtctaggctacaacnnnnttntnnaannggnnnnnnngctttnngcncccntttgnnnccngnggggaannnnnacccnnnaaccnnttttt

SEQ ID NO: 6768 - DNA, 251 bp, Homo sapiens
  misc_feature 220, 232, 247, 248, 250: n = A,T,C or G
attcatttctctaacagcagtaatattaataattttcatgatttgagaagccttcgcttcgaagcgaaaagtcctaatagtagaagaaccctccataaacctggagtgactatatggatgcccctcaccccacaaccaccaccaccacaataaacaagttgctgacagcggaaaaaaaaaaaaaaaaaaaaaaaaaaaaaaaaaaaaaaaaaaaaaaaanaaaaaaaaaaanaaaaaaaaataaatnntnt

SEQ ID NO: 6769 - DNA, 300 bp, Homo sapiens
ctgggtttcaccatattggccaggctggtctcgaactcctgacctggtgatcccctgcctcggcctcccaaagtgccaggattacagacgtgaagcactgcacccggcccacactgtagtttttttagcagacagtttcatggcctacttcactaagtagatggagatatccccccatcttccatggaaatgtctttcttacttgcctcttatttctctatcttagaaaaagaggaatccagtcgggctcggtggctcacacctataatctcagcctcctgagtagctgagactacagcc

SEQ ID NO: 6770 - DNA, 267 bp, Homo sapiens
  misc_feature 121, 126, 128, 133, 144, 147, 149, 150, 152, 155, 158, 160,163, 168, 170, 174, 176, 178, 179, 180, 181, 184, 189, 190,193, 194, 195, 203, 204, 207, 210, 211, 212, 214, 217, 219,220, 221, 224, 228, 229, 233, 234, 236, 243, 249, 250: n = A,T,C or G
  misc_feature 251, 254, 256, 258: n = A,T,C or G
accagattgttttgcttcagcctcaggtgatcagactctgagaatatgggatgtgaaggcagcaggagtaagaatcgtgattcctgcacatcaggcagaaatcttgagttgcgactggtgnacatncnatganaatttgctggngancnntncgnttnanttnttttntntttntntnnnntgnctttnntcnnntatttttnntcnttnnntnacncnnntcnagtnngtcnngnatctctnttttgnnnttntntnttgtccgtt

SEQ ID NO: 6771 - DNA, 266 bp, Homo sapiens
  misc_feature 147, 148, 153, 155, 158, 159, 161, 170, 173, 175, 176, 186,188, 191, 193, 195, 197, 203, 204, 206, 208, 209, 210, 218,220, 223, 224, 227, 230, 231, 232, 237, 238, 240, 244, 250,254, 259, 264: n = A,T,C or G
ctccaaggttggctccacggaaaacatcaagcatcagcctggaggaggccgggccaaagtagagaaaaaaacagaggcagctgctacaacccgaaagcctgaatctaatgcagtcactaaaacagtcggcccatttgccaaattgcnntttcntnttnntntatattgtnttntnnttgttttaantnttntncntntaactnntntnnnttcttttnangannttnttnnnatttnntncgtntttttnattnaattngtttntt

SEQ ID NO: 6772 - DNA, 300 bp, Homo sapiens
agaaagattctcgcttaaaaaaatgtatttattttatggcaagttggaaaaaatgtaactggaatctcaaaagttctttgggacaaaacagaagtccatggagttatctaagctcttgtaagtgagttaatttaaaaaagaaaattaggctgagagcagtggctcacgcctgtaatcccagaactttgggaggctaaggtgggtggatcacctgaggtcaagagttccagaccaggctggccagcatggtgaaaccccgtctgtactaaaaatacaaaaaattaactgggcatggtagtg

SEQ ID NO: 6773 - DNA, 300 bp, Homo sapiens
ggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggt

SEQ ID NO: 6774 - DNA, 291 bp, Homo sapiens
  misc_feature 97, 99, 100, 105, 109, 111, 120, 133, 140, 142, 143, 144,149, 150, 151, 156, 158, 160, 162, 174, 177, 187, 189, 194,199, 205, 209, 231, 242, 245, 251, 259, 264, 265, 269, 270,276, 278, 284: n = A,T,C or G
gagagagagagagagagagagagagagagagagagagagagagagagagagagagagagagagagagagagagagagagagagagagagagagagananngaganagananagagagagngagagagagaganagagagngnnngagannnagagngngncntcatctgctttntcncacgcactcncncctgnccctncgtttnttgnttcctgatctcacttccgtctngctcactctcnctngctggngattctgncctgnnaacnnatactnantttttntcttatg

SEQ ID NO: 6775 - DNA, 297 bp, Homo sapiens
  misc_feature 154, 185, 187, 188, 190, 211, 232, 252, 253, 256, 259, 262,269, 276, 279, 281, 284, 285, 289: n = A,T,C or G
gagtcaggaaggtaaggcggggagtgactgaataaactctgccttttaaattgagcatctgggccgggcatggtggctcacgcctgtaatcccagcactctgggaggtcgaggtgggacgtgtcatgctgatccagtttgtgaacgtgctgctncaggtcctggtccacaagtcccatgatcttntnnangaggagattggcatcgccatntacaacatggcctcagtcaantttgatggctcgtttgccgnnttnctnccngagttcntgacccnctntnatnntgtngattcctg

SEQ ID NO: 6776 - DNA, 266 bp, Homo sapiens
  misc_feature 247, 256: n = A,T,C or G
gaacctcatcaggaggactgaaggaaaggagccaggctgcagccctctgcctgcccttccgtgccatcatctccaggattaatgaaagggccattcaggaaacagcacagggagctacaaatttacgggttcactggtgattgatcttttcatccagcacaatggacagaagtctaaggaacgtccttgtggtttcctttgggttcctgcttctctttacagcctatggaggtctgtagagcctgcngagcagtcngtacagttag

SEQ ID NO: 6777 - DNA, 259 bp, Homo sapiens
  misc_feature 127, 133, 150, 176, 181, 184, 185, 186, 190, 191, 192, 195,197, 201, 202, 204, 206, 211, 212, 213, 214, 216, 217, 218,224, 226, 231, 234, 238, 239, 240, 241, 243, 244, 245, 255: n = A,T,C or G
ggacagcacttagtagctgtggaggaagatgcagagtcagaagatgaagaggaggaggatgtgaaactcttaagtatatctggaaagcggtctgcccctggaggtggtagcacggttccacagaatntagtanaacttgctgctgatgangatgatgacgatgatgatgaagaggnagatnatnnnttgnnnatntncttnntntnttttnnnncnnntgttgntnttttnttncccnnnntnnnataaattgtntttt

SEQ ID NO: 6778 - DNA, 295 bp, Homo sapiens
  misc_feature 245, 247, 251, 252, 263, 264, 268, 273, 274, 277, 278, 279,282, 285: n = A,T,C or G
cctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtctcagcggnangaanncctatcagtgnnaggnatgtnngannngcntcnctactccctc

SEQ ID NO: 6779 - DNA, 300 bp, Homo sapiens
actataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagaaaagacctacttaaagtcttcatttatattctttcaaatcaaatctttatttaataactta

SEQ ID NO: 6780 - DNA, 291 bp, Homo sapiens
  misc_feature 137, 152, 154, 163, 164, 166, 197, 209, 234, 255: n = A,T,C or G
aatttggctcgcagcgcagccgtggcccgtgcttcctctcactcatcccagacacagggtgggggcagcgtcaccaaaaagcgcaaactggagtccactgagagccgcagcagcttctcacagcacgcacgcactancgggcgcgtggtcgngnaggaggagnncntagggacgtatctgctatgaaaatcccaaanttttcagatagngccctaaaaacaattttatatgccncactggttggtattcttaggntattcccacacttgactttatcattggtactactag

SEQ ID NO: 6781 - DNA, 300 bp, Homo sapiens
  misc_feature 131, 132, 136, 137, 142, 144, 146, 159, 165, 173, 183, 187,192, 194, 198, 201, 205, 208, 215, 226, 227, 229, 231, 234,236, 240, 257, 263, 266, 267, 276, 278: n = A,T,C or G
agagagagagagagagagagagagagagagagagagagagagagagagagagagagagagagagagagagagagagagagagagagagagagagagagagagagagagagagagagagagagagagagagnnattnnctctntntnctcctctctctcntttttntccccctnttttcccttntttnttcgntntttntcnttcntcnttctctntctcgtctccnntntnttncntttncctctccttttttcttntctctnttnntccttcctncncttcttgttctcttctttcttt

SEQ ID NO: 6782 - DNA, 238 bp, Homo sapiens
gaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccag

SEQ ID NO: 6783 - DNA, 285 bp, Homo sapiens
  misc_feature 227, 228, 229, 230, 231, 232, 233, 235, 236, 237, 246, 247,248, 252, 253, 254, 256, 257, 258, 259, 261, 262, 267, 268,269, 270: n = A,T,C or G
cgagccacaagctgcactgtgaacctgggcactccgcgccgatgccaccggcctgtgggtctctgaagggaccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaaaaaaaaaaaaaaaaaaaaataaannnnnnncnnnaaaaaaaannngggnnntnnnnannaaaannnnaaaaaaaaaaaaaac

SEQ ID NO: 6784 - DNA, 253 bp, Homo sapiens
  misc_feature 227, 228, 229, 231, 232, 233, 235, 237, 238, 245: n = A,T,C or G
cgagccacaagctgcactgtgaacctgggcactccgcgccgatgccaccggcctgtgggtctctgaagggaccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaaaaaaaaaaaaaaaaaaaaaaaaannncnnncntnnaaaaaanttgggggg

SEQ ID NO: 6785 - DNA, 262 bp, Homo sapiens
  misc_feature 104, 105, 128, 129, 135, 137, 143, 154, 157, 158, 159, 160,164, 167, 169, 173, 176, 178, 180, 187, 189, 194, 195, 196,198, 204, 206, 207, 208, 210, 211, 214, 220, 223, 231, 235,236, 240, 241, 242, 248, 249, 250, 251, 253, 256, 260: n = A,T,C or G
ccagcattcaaaattcccatgcttagggaatccattgggacttctccccaggatgtactgaattcaaggaagctttctctaggtgtagcagaaactgctgctgnnatgtctctgctcaccaggacgtnngttctntntacagncctttatttgnttnnnntggnggnantagnttntngnccctggnanctagnnnantggggntnnnannttntggtanttngcgtcatnttcnnttgnnnattacnnnntntgntgcntt

SEQ ID NO: 6786 - DNA, 300 bp, Homo sapiens
acaccttcattgtcgtatctccggtgtgtatcagctctccaactctatgtcataattcagttcatggggatcttgattacctttcccttccacaaaatattacactgattggttatatcgatgacattatgctgatttgacctagtgagcaagaagtaggaactacattagacttagtggaaagacatttgcatcagagggtaggaaataaatatgactacaattcaagggccttctaccttagtgaaattggtagggacccagtgacatggggcatgttaggatatttcttctacggtg

SEQ ID NO: 6787 - DNA, 264 bp, Homo sapiens
  misc_feature 245, 247, 251, 255, 259, 260, 262: n = A,T,C or G
atagcactgatgctgggccaacaattagccccatttgtacctttttacaaactttttgacaattgccaagaatcgtccaccttccctccccattgaattaaatacacttcttgtctcatggatactcagaataccaatcaaggtaacagatgcctttattttaactaaggacacagtacagatctcacagggacactccttattccttgcagagtttcagacactactgagggtcaccatagcancntttnatcngaanncnca

SEQ ID NO: 6788 - DNA, 300 bp, Homo sapiens
ggataccgtatcgacgtggggcctccggttgctgctaaatgggaaaaacttagcttagtactgatagatgactttattgaaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaaagcacatggaagatctttttgcacttc

SEQ ID NO: 6789 - DNA, 282 bp, Homo sapiens
  misc_feature 138, 144, 151, 152, 154, 168, 170, 174, 190, 196, 197, 198,199, 202, 203, 205, 210, 211, 217, 232, 239, 240, 243, 244,245, 246, 248, 258, 262, 264, 270, 274: n = A,T,C or G
atgaaccatctgcttttaatgattttcagaggccagccatttattacatgatgtcattcagggattggtatgagatgcaagatgctggaattacttcagactcaatgatgaagaacttcttctttgtgccttcttgcnttcacntgagccnnanacgctcgcttttcngntgcngcttaaactggccttnccgctnnnntanntntgctnntggacnccccatacgtacgcntcctttnnctnnnngnccaggtcatngatncnttcctnaccntcaaattt

SEQ ID NO: 6790 - DNA, 300 bp, Homo sapiens
  misc_feature 144, 145, 157, 160, 163, 164, 165, 175, 176, 178, 179, 191,196, 199, 233, 246, 247, 255, 263, 271, 272, 281, 285, 291,293: n = A,T,C or G
cccaagccccatctcatcctggcacgccctactccactgccctggcagcagcaggtgtggccaatggaggggggtgctggcccccaggattccccgagccaaactgtctttgtcaccacgtggtgctcacttttcatacttccnnaaattacctagnccncgnnntaacatgganngnnctgttgccttanctaanggnacaaccataacctggctgcccatcatgtggtccnacccaatcaaggnnagaatgangaatgctngactgganncccctgganccanatggcnanagggtga

SEQ ID NO: 6791 - DNA, 300 bp, Homo sapiens
  misc_feature 110, 126, 137, 139, 142, 151, 184, 241, 260, 261, 265, 290,292: n = A,T,C or G
gcctggacactgcaatatacatacatacataaacataaaccggaaatccatatgagcttggaggtagaggagtgggtggtgttggatttggtggtgggtgggaccctttntgggtccttcctggtnccctgagggcncnatnaggagtccnttacttcctttcttccttcatattttacaggcngatgcttttcttataatctaattacatctttttatttgttatatattacaaaccatnacacttataaatacttccnngaantgcttttttgaagtgtgaattaatntnaaatgggg

SEQ ID NO: 6792 - DNA, 255 bp, Homo sapiens
  misc_feature 152, 156, 162, 168, 174, 178, 185, 187, 191, 193, 208, 210,213, 218, 219, 222, 224, 226, 228, 231, 232, 233, 235, 237,241, 242, 243, 245, 253: n = A,T,C or G
gccccttgttcatctgtgtcttctgcaaactagtctcatgaagaattctggcgtgcagccagggtagctgaagtttgggtctgggactggagattggccattaggcctcctgagattccagctcccttccaccaagcccagtcttgctacgnggtncatggnataccngactcncttngggcctnanttcncnctttctttttgtgtngntcntaatnnatnantntnttnnntntngttnnntntctccttntt

SEQ ID NO: 6793 - DNA, 293 bp, Homo sapiens
  misc_feature 170, 172, 174, 183, 187, 188, 191, 194, 195, 218, 219, 222,223, 229, 230, 243, 253, 255, 256, 262, 273, 279, 285: n = A,T,C or G
cgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgttgncnangatgcactnattnntgnccnnatttggccccatgaacagacggnncgnntgtcannatctggccctagnatacggctgnannatacancgtgagacagntgtttncataanagtggctg

SEQ ID NO: 6794 - DNA, 257 bp, Homo sapiens
  misc_feature 146, 153, 154, 158, 159, 161, 163, 166, 167, 168, 170, 171,172, 173, 188, 193, 196, 197, 201, 202, 207, 209, 210, 212,215, 217, 219, 221, 222, 223, 224, 225, 228, 237, 239, 240,243, 244, 248, 251, 252, 253, 254, 256: n = A,T,C or G
gacaacgaaagttacttgggcttcctgaggattacttgtatggacaaactaccacatatctgacatataatgacttcatcaacaaggaacttatcttgttctcaaattctgataacgagagatctatcccttctatggtggatggnttgaacnnttannananaannntnnnntattcataattacanccctnacnnacanntactnanngnacncnanannnnnatnaattacatntnnatnntatnctnnnncnt

SEQ ID NO: 6795 - DNA, 300 bp, Homo sapiens
  misc_feature 161, 169, 175, 184, 193, 196, 202, 204, 205, 210, 216, 219,220, 223, 225, 227, 235, 237, 239, 240, 241, 243, 246, 248,252, 253, 256, 259, 269, 274, 276, 277, 278, 283, 287, 288,289, 292: n = A,T,C or G
caaaggggactatcctctggaggctgtgcgcatgcagcaagatctacgtggatgatgggcttatttctctccaggtgaagcagaaaggtgccgacttcctggtgacggaggtggaaaatggtggctccttgggcagcaagaagggtgtgaaccttcctggngctgctgnggactngcctgcttngtcccacancgnctttcnanntctgntgtctnctnnatntntngtgtggtncntnnntnttncnttannttnctnctactttttngtgangnnncccantgannnaanccttgtcc

SEQ ID NO: 6796 - DNA, 255 bp, Homo sapiens
  misc_feature 152, 154, 158, 164, 169, 180, 184, 192, 205, 206, 207, 209,212, 214, 217, 222, 223, 224, 225, 228, 240, 241, 242, 243,247: n = A,T,C or G
ctgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctgnancgantgtccnttgangagaaattgancctntgccggangtactacctggtnnngnttngnttnatctnnnngtncttatctgtctnnnncttntcctcatt

SEQ ID NO: 6797 - DNA, 300 bp, Homo sapiens
acttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaa

SEQ ID NO: 6798 - DNA, 300 bp, Homo sapiens
gtgaattgcgggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccg

SEQ ID NO: 6799 - DNA, 262 bp, Homo sapiens
  misc_feature 155, 170, 171, 175, 178, 179, 198, 202, 207, 209, 213, 220,224, 227, 228, 230, 233, 235, 237, 238, 239, 241, 242, 243,246, 247, 248, 249, 253, 254, 257, 259: n = A,T,C or G
tgaggctcagtacgtattcctgcatcagtgcatcctgcggttcctccaacagtcagcccaggccccagccgagaaggaagtcccgtatgaggatgtcgaaaacctcatctacgagaacgtggccgccatccaggctcacaagttggaggtctaantgacgagggggctgnncggnatnncaggcattctcatgctctngacncccantngagnccatatntttngannantanangnnngnnntgnnnnattnntgntntgc

SEQ ID NO: 6800 - DNA, 300 bp, Homo sapiens
ggtgaagaaccggatcactctgcaggaagtggtctcccactgcaagaagctgaccaagaggaataaggaacagctgtcagatatgatggttctggacaagcagaagggtttaaagtcgctgagcaaagagaaacggcagaaactagaagcataccaacacctcttctacctgctccagactcagcccatctacctggccaagctgatctttcagatgccacagaacaaaaccaccaagttcatggaggcagtgattttcagcctgtacaactatgcctccagccgccgagaggcctatct

SEQ ID NO: 6801 - DNA, 241 bp, Homo sapiens
  misc_feature 140, 153, 162, 163, 166, 168, 169, 170, 172, 174, 178, 181,184, 186, 187, 190, 191, 196, 200, 201, 202, 206, 207, 209,210, 213, 219, 222, 223, 224, 225, 226, 227, 228, 229, 231,232, 238: n = A,T,C or G
ctatagtgtgcactctgaaatgtactcagtgaaaatttgttttgagtttcattaatgctatttcaccagttagacataattacttctaccgatgtgaatgatacggatgccggcagagcttccagatctttcagactcanctgctaggtcaantactttggnntantnnnantntttnttnaananntgnnctttntttnnncccnnanntanttttanaannnnnnnnanncctttnaaa

SEQ ID NO: 6802 - DNA, 300 bp, Homo sapiens
ggaatctggaaaaccaggggctcatgtaactgtgaagaagctgtttgttggcggaattaaagaagatactgaggaacatcaccttagagattactttgaggaatatggaaaaattgataccattgagataattactgataggcagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaat

SEQ ID NO: 6803 - DNA, 300 bp, Homo sapiens
  misc_feature 288: n = A,T,C or G
aattcaaggcctctcgagcctctagaactatagtgagtcgtattacgtagatccagacatgataagatcattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggtttttcctatgggcatgggtggcttcaccaacgtgaactttggccgctcncgctctgcccaa

SEQ ID NO: 6804 - DNA, 298 bp, Homo sapiens
  misc_feature 156, 173, 175, 177, 183, 192, 200, 201, 206, 207, 216, 230,238, 242, 243, 256, 261, 262, 272, 276, 278, 282, 285, 289,291: n = A,T,C or G
agacgctggtggccctgtggtgggagaggaaaggaaggagagggtgttggcagtcctttcacactggctttgaagtcctgagatgaggaaattcccagtctggccttgctgggctgtttgctgctttgagtgtgtcctcatctgccggatggtggnggaggctgaattgatcntngnctttcnatatgccangccccttnnatcanngctgctganagcccttctcctcntaatcctntttnnctttcttcttgtnccatnntcctttttgntgcncnctangcntttngntcttgtg

SEQ ID NO: 6805 - DNA, 274 bp, Homo sapiens
  misc_feature 244, 245, 246, 247, 251, 253, 259, 260, 261, 262: n = A,T,C or G
aagaagctgcggaagcccagacaccaggaaggtgagatcttcgacacagaaaaagagaaatttgtgagtccacagcttttaccaaaaatcaaagctattcctcagctccagggctacctgcgatctgtgtttgctctgacgaatggaatttatcctcacaaattggtgttctaaatgtcttaagaacctaattaaatagctgactacaaaaaaaaaaaaaaaaaaaaaaaaaaaaaaaaaaacnnnncccntnaaaaannnngggggggttttt

SEQ ID NO: 6806 - DNA, 295 bp, Homo sapiens
  misc_feature 280: n = A,T,C or G
gatgacctcaacactgcctcttgatttgtttgatgcatgtcactttcattaattttccccctcctttttgaaagtcctgtggcagtactaatattttcattttatgtaatctctggtgctgctttccagtcactgtatgaagtgtctccccaacactagcaaatctaggtcctactaaatacaaatctctgggtggatgatcttctagtactgtatttttaaattaaggagttttagttataatgaaattgatttgtagtctgttttgccgtaaacttgnttttctttaaattgt

SEQ ID NO: 6807 - DNA, 254 bp, Homo sapiens
  misc_feature 201, 204, 208, 212, 219, 221, 223, 227, 229, 231, 237, 239,241, 242, 246, 248, 251, 252, 253: n = A,T,C or G
gaaaaggcaagcaagccacagacagagagaaaatagtcacaaaacgtatctgacctccacatcctgtaattagaattattgtggtctggtacactgcacccagtttctgcaggagtactttctgggtgtctctattgagtaagagagggccccatgggatattcctacagttcccagatgaacagtgggaaagactctacnttncaantccngggtacntntntctngngncctttntnanngtcnanacnnnt

SEQ ID NO: 6808 - DNA, 298 bp, Homo sapiens
  misc_feature 156, 159, 177, 179, 181, 194, 199, 205, 206, 211, 213, 219,220, 222, 223, 247, 252, 253, 254, 260, 261, 266, 267, 275,278, 281, 283, 288: n = A,T,C or G
gagcggccttacaagtgcgatgactgcggaaaggccttgtcccagagcttcgacctcatccgccaccagcggacccacgcggcgggccggcgctgacctggggccccagcaggggtgggaggtgagggcagaagataaggggccagggagctaatngantctttagggaggatatangngngaatccccaatanaatgnaggacnnttatntnctggannannacattgatgctgtaagtgatgtcnggacnnncctggnncctgnncacccagnagnaangnggcanttcttacctg

SEQ ID NO: 6809 - DNA, 265 bp, Homo sapiens
  misc_feature 159, 165, 166, 168, 169, 179, 184, 188, 189, 197, 205, 207,209, 212, 214, 215, 232, 233, 234, 235, 240, 243, 244, 246,248, 250, 251, 254: n = A,T,C or G
gaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgtntttatnngnntgttcagagnttgtncttnntggatttntttctttntngnttnanntgggtcgtgttttttannnnctttnttnncntnanntcnggtcgcttata

SEQ ID NO: 6810 - DNA, 300 bp, Homo sapiens
ctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagct

SEQ ID NO: 6811 - DNA, 300 bp, Homo sapiens
ctgagccaggtgcgggatataatcttgtggtgcgccgttttttaagccggtccgaaaagcgcaatattcgggtgggagtgacccgatttcccagctcagaacctgaggacgcagccatggagcggtcggccttcatggagctggatgctgggagcaggctggtgatgcatctccgcgagtggccagccctgctggtcagcagcacgggctggacagagtttgaacaacttactcttgatggacacaaccttccttctcttgtctgtgtgataacagggtcggtggacctgggtgtctgtc

SEQ ID NO: 6812 - DNA, 300 bp, Homo sapiens
ggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagtt

SEQ ID NO: 6813 - DNA, 300 bp, Homo sapiens
tttagatgttccagagtcctcagagtccatgaaaggactcacagtggagaaaagccctatgaatgtaaacaatgtggtaaagccttcaaatattctagtaacctatgtgagcatgaaagaactcacactggagtgaaaccttatggatgtaaggaatgtggtaagtcgtttacttcttccagtgcccttcgaagccatgaaaggactcatactggagaaaaaccctatgaatgtaagaaatgtggtaaagccttcagttgttccagttcccttcgaaagcatgaaagagcttatatgtgg

SEQ ID NO: 6814 - DNA, 300 bp, Homo sapiens
cggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttctcctccacccctgacaaccactcaccattttactacttctatctttttgactttccaagaatgtcctagagttggagtggtacagtatgtgggtttccagactggcttctttctagcattatgtactttaagttccttca

SEQ ID NO: 6815 - DNA, 300 bp, Homo sapiens
actcagcccacctgcacccaggtgaaataaacagctttattgctcacacgaagcctgtttggtggtctcttcacacggatgcgcatgaaatttggtgccgtgacttggatcgggggacctcccttaggagatcaatcccctgtcctcctgctctttgctccgtgagaaagatccacctacgacctcaggtcctcagaccgaccagcccaagaaacatctcaccaatttcaaatctggcacccactggaaatcagactgcccagctcgcccgacagccactcctggagcccctaaagctct

SEQ ID NO: 6816 - DNA, 234 bp, Homo sapiens
  misc_feature 198, 220, 222, 223, 229, 230, 231, 233: n = A,T,C or G
atacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgcctgacagtggagcaggccgngctgctgtcactcctggaggangnnttccannntnt

SEQ ID NO: 6817 - DNA, 300 bp, Homo sapiens
  misc_feature 161, 167, 169, 173, 174, 176, 180, 188, 192, 194, 198, 200,205, 207, 209, 210, 211, 216, 217, 225, 230, 249, 250, 263,265, 278, 287, 288: n = A,T,C or G
gtggaagaagaaaagtttcctacacaactgagcaggcatattaagtttggtcagaaatcacatgtggagtgtgctcgattttctccagatggtcagtatttggtcactgggtctgttgatggattcattgaactatggaactttactactggaaaaatcanaatggntnttanntnccangcccactntacntntatnangatgnangnnnccagnntacagtcntgatntgtctccagtctccacctnncactgtctggttncngttggtactatangacccatgnntacaacttttgt

SEQ ID NO: 6818 - DNA, 261 bp, Homo sapiens
  misc_feature 209, 210, 217, 218, 220, 222, 223, 224, 225, 229, 238, 239,242, 243, 244, 246, 247, 253, 257, 258, 259: n = A,T,C or G
gttaattcattcctttccctgaaggagactgggctctgggctccctgcgtggtgaggatgaggagcagaatagagctgcagtcagcagggagcagggctcattctggggagcagagacaaatagagaacagtatctcttgctatatgcagggcactgcaacttacaaatcacagcgcatggcgaggacgagggttggggtggttcctcnnaccatgnntncnnnngttntaccccttnntcnnngnnactctnactnnnaa

SEQ ID NO: 6819 - DNA, 275 bp, Homo sapiens
  misc_feature 171, 174, 176, 178, 184, 191, 194, 196, 200, 206, 210, 216,218, 219, 226, 230, 231, 234, 235, 237, 238, 242, 246, 249,251, 255, 264, 265, 266: n = A,T,C or G
gtggcaaagcttcatccagtctaggtcttcaggattttgatttgctccgggtaataggaagaggaagttatgccaaagtactgttggttcgattaaaaaaaacagatcgtatttatgcaatgaaagtttgtgaaaaaagagcttgttaatgatgatgaggatattgattgngtncncnacgganaagcatngtntntganccggcntttnttcatntnntttcccncttnncgnntnntttnctcngcngncccngattttatnnncggtcctat

SEQ ID NO: 6820 - DNA, 280 bp, Homo sapiens
  misc_feature 166, 170, 171, 174, 179, 180, 181, 185, 186, 188, 189, 190,191, 196, 197, 199, 200, 202, 203, 204, 205, 206, 209, 210,216, 225, 226, 227, 228, 230, 233, 234, 235, 236, 237, 238,239, 240, 243, 250, 251, 253, 258, 259, 260, 261, 263: n = A,T,C or G
  misc_feature 268: n = A,T,C or G
agaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggactccatgantatnncgntatannngatnncnnnntagcnntnntnnnnntcnnccccanctgactttnnnntnccnnnnnnnnccngctaagnngnttgcnnnntnccccncgcagctccccg

SEQ ID NO: 6821 - DNA, 276 bp, Homo sapiens
  misc_feature 238, 240, 241, 246, 249, 260, 266, 268: n = A,T,C or G
gtgacgcgcatgaatggatgaacgagattcccactgtccctacctactatccagcgaaaccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgctttcttgcatttcaaagaggccgggccntnnaccgntcntgaatttcccngccgancnttttaaaa

SEQ ID NO: 6822 - DNA, 300 bp, Homo sapiens
  misc_feature 76: n = A,T,C or G
ccgtgggactagggcggcgatggtgtcccatgcagagtgccgtcctctgggagtgtttgagtgtgaactctgtacnttgacagctccgtacagctatgtgggacagaagccccccaacacccagtcgatggtgaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcat

SEQ ID NO: 6823 - DNA, 300 bp, Homo sapiens
  misc_feature 194, 196, 202, 203, 211, 212, 218, 221, 246, 250, 262, 278,285, 288: n = A,T,C or G
ggaagctccacgtgtagctgagctgcatgcaccaggcctcagtttgccccaagtcccctgtgtactctctcatggcctgtggccaagaaatgtattctctcactttggacttaggagtccaaagagaagcccagaaacaaaattgcttgaacttgaatttgtgtgcgtgcgcacgtgtgcacgtggtggtgaancnatattnnttccaccnntggctnatnccatggcaccttcaaggcttgatancggnaatcttgtcatnaatggaaatcccatgncttcttncangatcgagattcc

SEQ ID NO: 6824 - DNA, 298 bp, Homo sapiens
  misc_feature 161, 166, 180, 181, 182, 186, 187, 188, 196, 197, 202, 217,222, 224, 227, 232, 235, 238, 241, 243, 244, 246, 249, 251,253, 254, 260, 264, 266, 267, 268, 270, 277, 278, 280, 284,286: n = A,T,C or G
gttattgctctcggtgttcctaatcctcggacttccaatgaagttcagtatgaccaaaggctcttcaaccaatccaagggtatggacagtggatttgcaggtggagaagatgaaatttataatggttatgatcaagcctggagaggtggtaaagatatggnccagngcatttatatggcnnnatannnatctgccnnagaanatgtatggccgatgnccgtntncgncaccntgnttnatnannanatncntnnaccacnctgnannntntgtttcnnancccncnccgactttggat

SEQ ID NO: 6825 - DNA, 245 bp, Homo sapiens
  misc_feature 157, 170, 173, 177, 181, 186, 187, 188, 190, 195, 197, 199,200, 201, 204, 205, 206, 210, 216, 217, 218, 225, 227, 228,234, 237, 239, 242, 244: n = A,T,C or G
gcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtngggatggctttcntgnattngttncttannnangtatntntnnnaannntgantgttannnttttttntnncttttnttnanttntnt

SEQ ID NO: 6826 - DNA, 299 bp, Homo sapiens
  misc_feature 173, 174, 175, 176, 177, 178, 181, 184, 187, 191, 194, 195,196, 197, 198, 200, 202, 210, 215, 216, 219, 220, 227, 229,235, 241, 248, 258, 267, 269, 280: n = A,T,C or G
atttgaagcaccaaaccaggagaaagtttcagactatgaaatgaagttgatggatttagatgttgaacaacttggaattccagaacaggagtacagctgtgtagtaaagatgccttctggggaatttgcacgtatatgccgagatctcagccatattggagatgctgctggannnnnntgngcntgngacnggnnnnngncntctgcatntgcannatnngctaagncnactttnatggcntctttgncgccttcctnccatagttncngaccagctgtnatggtgtggatgcctgcct

SEQ ID NO: 6827 - DNA, 298 bp, Homo sapiens
  misc_feature 231, 232, 239, 245, 254, 275, 279, 282, 284: n = A,T,C or G
agacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagattttggcgtgtcctnncccatgncactgnattttatanccttgtgactgtgtcatatanatanctncntatatatatacata

SEQ ID NO: 6828 - DNA, 300 bp, Homo sapiens
gtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgagccgccaccggcaactaacctatg

SEQ ID NO: 6829 - DNA, 267 bp, Homo sapiens
  misc_feature 196, 217, 221, 231, 232, 234, 241, 243, 244, 247, 248, 250,260: n = A,T,C or G
cattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacaccttcgtggatgangagacagttctctgtacccantctnaaagctggtnnanaaccacngnntanntnagatatttgngccaact

SEQ ID NO: 6830 - DNA, 300 bp, Homo sapiens
tcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactg

SEQ ID NO: 6831 - DNA, 300 bp, Homo sapiens
gtgactccaagcccacgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgccca

SEQ ID NO: 6832 - DNA, 281 bp, Homo sapiens
ccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtata

SEQ ID NO: 6833 - DNA, 295 bp, Homo sapiens
  misc_feature 232, 237, 242, 251, 260, 262, 265, 268, 271, 272, 273, 280,283, 287: n = A,T,C or G
gccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgatcgggaacggtatgggaaccgtaatgatgatagngatantagtnaccgtgacnggatagagngnggnagnagnnnttttttnttntatntttttttg

SEQ ID NO: 6834 - DNA, 300 bp, Homo sapiens
cagacagccaaacagaccttctgtttcatgaacaggcgtgttatatctgctaacccatatctagggggcacctccaacggctatgcccaccccagcgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaag

SEQ ID NO: 6835 - DNA, 300 bp, Homo sapiens
tctgggccctaggcctccacaggagcaagtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccgga

SEQ ID NO: 6836 - DNA, 299 bp, Homo sapiens
ccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgattgacatcagtcaagagattgcccagttacaaagagagaaatattcactggaacaagacattcgagaaaaggaagaggcaatcatgacagaaaacca

SEQ ID NO: 6837 - DNA, 300 bp, Homo sapiens
ggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaa

SEQ ID NO: 6838 - DNA, 300 bp, Homo sapiens
agttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagca

SEQ ID NO: 6839 - DNA, 300 bp, Homo sapiens
ggaacgaggctttgctccatggaagtgtctaccagtctgagtacatagacctctctgaaaaaattaaacagggagatagtagcctggagtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaat

SEQ ID NO: 6840 - DNA, 300 bp, Homo sapiens
ggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaattggcttcagctgttctggaggctgtggaaaacaatactctaagcattgaaccagtgggattacaacctatccggtttgtgaaagcttctgcagttgaatgcggaggaccaaaaaaatgtgc

SEQ ID NO: 6841 - DNA, 300 bp, Homo sapiens
aaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacg

SEQ ID NO: 6842 - DNA, 300 bp, Homo sapiens
ccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcg

SEQ ID NO: 6843 - DNA, 300 bp, Homo sapiens
gggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgt

SEQ ID NO: 6844 - DNA, 300 bp, Homo sapiens
atacagcagagcctagaacaagaagaagctgaacataaggccacaaaggcacgactagcagatgggaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaat

SEQ ID NO: 6845 - DNA, 300 bp, Homo sapiens
gaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaca

SEQ ID NO: 6846 - DNA, 300 bp, Homo sapiens
ctattactcggcttcttagcattcgcattcctgctctcttacccccagcgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagagagtcatactccttagctgctggcttggccctgggcatggtctgcttggggcatggcagcaatttgataggtatgtctgatctcaatgtgcctg

SEQ ID NO: 6847 - DNA, 300 bp, Homo sapiens
gaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaagg

SEQ ID NO: 6848 - DNA, 292 bp, Homo sapiens
  misc_feature 100, 104, 119, 125, 126, 127, 133, 137, 146, 152, 157, 169,177, 178, 190, 195, 198, 200, 203, 204, 221, 222, 232, 236,238, 241, 242, 245, 247, 249, 250, 253, 257, 260, 262, 263,266, 268, 274, 276, 279, 283: n = A,T,C or G
aaattagctgggtgtggtggtgcacgcctgtgatcccagctacttgagaggctgaggcaggagaatcacttgaactcgggaggtggaagttgcagtgagntganatcgtgccactgaangatccnnntgagcnacanaatgagatnccatcncaaanttcagtacctanatccttannttagagattgtnttganacntnaanntcctggaccttatctgnngctcccctangctngngtnnctntnannttntttntantnngcntnttgctnanatnatantccagtgca

SEQ ID NO: 6849 - DNA, 290 bp, Homo sapiens
  misc_feature 195, 196, 205, 209, 219, 221, 228, 248, 251, 258, 262, 268,269, 270, 272, 275, 278, 281, 282: n = A,T,C or G
aattccgttgctgtcgggtttcaccatgttggccacgctggtctcgaactcctgacctcaggtgatccaccctcctcggcctcccaaagtgttggtactacaggtgtgagccactgcgcctggctggatctaactttttttcctccttggtttactcgctcactttgatggattatgttgtcttgtgttttcccnntattagaantcangggaaatgantnttttganaactttcatatgtggctganttnttgatcnatcntttaannnanatnagnatnnttctgact

SEQ ID NO: 6850 - DNA, 259 bp, Homo sapiens
  misc_feature 106, 112, 115, 123, 136, 138, 143, 144, 152, 156, 159, 163,165, 175, 186, 191, 194, 199, 201, 207, 209, 211, 212, 213,214, 222, 223, 226, 231, 238, 242: n = A,T,C or G
aattccgttgctgtcgctgattaatgcactttgaagttctctggaattaattattttaacttggcctagcttcgactgtcaaggtggctgttataaatttgactcnattgtnagnggatgaancctaagtcagctnangactnnatcatatntttnccntgangnctgtctgctngctcatgtatnacttnctntatcnanttgacngntnnnnattctganntgntggtntgtactntacnacaatcagagctgccct

SEQ ID NO: 6851 - DNA, 257 bp, Homo sapiens
  misc_feature 102, 108, 113, 114, 116, 122, 123, 128, 138, 140, 144, 145,146, 150, 151, 152, 154, 156, 161, 162, 164, 168, 170, 173,174, 175, 177, 180, 184, 185, 186, 187, 188, 189, 193, 197,198, 201, 208, 210, 211, 220, 224, 229, 231, 236, 242: n = A,T,C or G
  misc_feature 247, 250, 255, 256: n = A,T,C or G
aattccgttgctgtcgcaaactcctaggctcaagcggtcctcccactgtggcctcccaaagtgctgggtggtgtgagccaccgtgcctggccagttaatttnttttancgtanntntttttnnttctnatatttatcngntgcnnnctannntnanattanntntttnanatnnncnccnttcnnnnnnaccngtgnnttngcatttnannttttctaantatnttaancntgatnattttnctgtnaanttttnna

SEQ ID NO: 6852 - DNA, 234 bp, Homo sapiens
  misc_feature 228, 229, 230, 233: n = A,T,C or G
aattccgttgctgtcgaaaaggcttataacttagggtttagagaacagttatgaggcattctcattgctaaatcatgctctggggaagtctgccatttaatatgtcatagactagggctacctagttgttactgatggtgtttgagctgaagaaaatgcgtgtgtgtttctgtaaggtaagaggagcttgacattcactaaggagataatgaggcattgacaggctgnnntgna

SEQ ID NO: 6853 - DNA, 300 bp, Homo sapiens
  misc_feature 31: n = A,T,C or G
ctactccttctttttgcaggcatcccatttnattcgaattccgttgctgtcgctttataatgcaatttccagaccctttatcatccttgctcttgatagctgtttgtcagcatccctcttaaaatgtggttcccaggagtggacatgctgtgtcaacatatacactgagacagttgacctctttgttctgggccgagctcattaacttagggactgggggtccagagtgtctgtcaagtccctgaaattaactgtaaatttttgtatgtctagacatatttatgggaggaaaacttattg

SEQ ID NO: 6854 - DNA, 300 bp, Homo sapiens
aattccgttgctgtcggcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgc

SEQ ID NO: 6855 - DNA, 300 bp, Homo sapiens
cgttgctgtcgggaatccctgccaaggtaacttgacagtcggcctaattctgttgacagaaaatgaagccttgacggttctaattatccaaaagtgggttttcatcaggacgtacagtcagagtgtgagtgcattctaatgaaaacttcttcagccctcattcaattgcatacaaaagccctcaaagagaacatacagtacagcagttttgtaaaaggcaacaatacgatttgtacagaccccgacactccaatcctatagatcaccacgttgctcctctgtccccagcaccccttattt

SEQ ID NO: 6856 - DNA, 300 bp, Homo sapiens
aattccgttgctgtcgaaatttgtttagcttctcaattcatgttccttagaggatggtaaattaaagttagcattcctggacagagcctttcatacattgaagacaacccggtgagtctcaaggggagaggtgtgggagagatgaaaggatttctccaggcctgttcggcagcatggactgttcttttaggtaattaagggagaccatagaagacaattgtgtgagtccatttacctttcacttgggggtcttaagtctttggttgggcttctttaaccctgtgtgtcacccacggactc

SEQ ID NO: 6857 - DNA, 300 bp, Homo sapiens
aattccgttgctgtcgctccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaa

SEQ ID NO: 6858 - DNA, 293 bp, Homo sapiens
  misc_feature 194, 199, 202, 228, 230, 233, 234, 238, 240, 244, 246, 247,254, 257, 260, 267, 269, 274, 275, 277: n = A,T,C or G
aattccgttgctgtcgaaacgcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgagaccacgagccctggttcagncaccnagngaagccacccatcggctcatgaatcntnaanncttnangcancnnatgcctngcngcntggaatnancttanngntttgacctgatgcacc

SEQ ID NO: 6859 - DNA, 300 bp, Homo sapiens
aattccgttgctgtcggagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccac

SEQ ID NO: 6860 - DNA, 300 bp, Homo sapiens
aattccgttgctgtcgcttgtcctgttgtgatcagagtttcacaaagtgctctcagtgcctaaggcaaactggcacattctctatgaaaaagacaattattgttcttggtcaggtggccagttggcccagttgattttggagcatagtgttaataaaggttagtctcttcagatatgagccagttgacttggctatataaatagctgctgtcacgggcaggtcagaggtatgtgtgtggatagactggatctgtaaccaccaatcagaaatcaatcagcaatcatttactgagcatttgc

SEQ ID NO: 6861 - DNA, 300 bp, Homo sapiens
aattccgttgctgtcggctctacgatggagtcaaggccagattgggctctatttccacaaccccctaaggagtagctcaccagtgtcctaagtggctgtttcctgggtgaacatagtacatatttgctgtcacgctgggaataccagtgagaatctcatgcatggacagaggacatgatcatctttatgtttgtaacctcgggcctggaacagtctccttttgtgttcacttgattctgaaaggtcagtgttttagaacaggcttttcacatggttcaccaggaggccagttagatcctg

SEQ ID NO: 6862 - DNA, 265 bp, Homo sapiens
  misc_feature 192, 210, 221, 223, 224, 232, 234, 238, 240, 256, 257, 258: n = A,T,C or G
aattccgttgctgtcggtgagaaagtatgccactctttaattagctcttataattggagggttattccctgagtagagattaaaagctggggaaatgttgaatcctacaaaattcttgtgttgccgtcactccaggttgctacaacactttagatattcgtatgagggagtcatatttgttttacactaacnggaaactatgacaataantatatgagtancnncattatantncttnanaatccaccaagtgagnnnctgctat

SEQ ID NO: 6863 - DNA, 296 bp, Homo sapiens
  misc_feature 120, 127, 129, 136, 141, 147, 149, 150, 165, 171, 172, 173,175, 176, 177, 178, 184, 186, 187, 189, 191, 194, 195, 203,206, 219, 221, 225, 226, 246, 249, 251, 254, 262, 269, 272,280: n = A,T,C or G
aattccgttgctgtcggttactgagttagtactgtataatgtagtgagtagtgatgatgagcatggattgattattggcttatcttctttgtttttttgcttttgattttctttattttnttttganangcattgncctantgaacntnnaaactgaattaaggncccccnnnannnncacttncnntntnccnngggaaaangcnccgaacccccatntnaaanncaccagctccaacacacgantancnttnatgagganttggctnacnatgagaanccccgaaagaagtaac

SEQ ID NO: 6864 - DNA, 267 bp, Homo sapiens
  misc_feature 181, 183, 185, 201, 202, 205, 206, 207, 218, 224, 225, 226,228, 231, 236, 241, 248, 253, 254, 260: n = A,T,C or G
aattccgttgctgtcgggtaatttgacactgctgctggcagtagttctctattcaccattttaaagcccattcaggttctctcttcctgaaaagaactgattgctgtgtttacatgaaatgacattggagtcagatggtctgttttaaagatttctatgacagcctattttcctgagttgnananattggaggttccctgnntcnnntaaaactgaanaacgcnnngnaanaggcnatgancgatctnctgcnnagggcntttgatg

SEQ ID NO: 6865 - DNA, 269 bp, Homo sapiens
  misc_feature 106, 110, 113, 118, 119, 122, 123, 126, 131, 132, 133, 137,140, 142, 143, 147, 149, 153, 154, 158, 159, 160, 161, 165,166, 168, 170, 175, 176, 177, 184, 187, 189, 199, 203, 208,217, 219, 223, 224, 225, 234, 240, 242, 256, 259, 260: n = A,T,C or G
  misc_feature 262, 266, 268: n = A,T,C or G
aatttcgttgctgtcggacccagcaaattttttgtatttttagtagagatggggtttcaccatgttggtcaggctggggtcttaccacccccttgaaagcctaccncccnccncggcnnctnnaanagccnnnagtntangnnagtncnaccnnaccnnnnctanncncngtccnnntccatgnggncntatacccatncatnctacnccatctctncncccnnncagtcatcnctaccntntctcacaaactccnccnntncttnang

SEQ ID NO: 6866 - DNA, 300 bp, Homo sapiens
aattccgttgctgtcgggtttctgtagaggaatgtcttccaggtgggagaagaatggctttcatttttaacaaccacacactataaacaaagcatcccgagagcacgggtacctagcagaagaagaacgaagtagccaggaaacaagttgcttttcagcatccccactgaaatgatagggtactttagaaagcgggtggtggcattctttccacaagtacagcaagtgtcactgtggggtcttaattctctcgaatctgcctttagaaggcagaaggcagaatgatcagctctgctctga

SEQ ID NO: 6867 - DNA, 300 bp, Homo sapiens
cattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaa

SEQ ID NO: 6868 - DNA, 206 bp, Homo sapiens
  misc_feature 84, 86, 93, 117, 127, 130, 137, 141, 151, 156, 157, 160,161, 166, 167, 170, 174, 177, 181, 185, 187, 194, 195: n = A,T,C or G
aattccggtgctgtcgctgattatccgaatgagtaagcagatgtctcactatgtggatggtccgttacctgggatattctgggntnctgtagntgaactatgacagaggaaccagantcataatgangcntctgatnaggngaggcgtatngagannatnnctccnnccnttanctncctnacantntaaattnntaatatacatt

SEQ ID NO: 6869 - DNA, 300 bp, Homo sapiens
aattccgttgctgtcgaaaaaggtcattcccagtctttttagactcctgttttccagggagacatcctctgatcctttgagcttcatgatgaatcacctgaattctgtaggcgacacatgtggactagagcagattgatatgtttatacttggatactcccttgaagtaaagataaaagtgttcagactgttcaagtttaactccagagactttgaagtctgctacccagaggagcctctcagggactggccggagatctccctgctgaccgagaacgaccgcactaccacattccagtc

SEQ ID NO: 6870 - DNA, 300 bp, Homo sapiens
aattccgttgctgtcggtcacttatgcctataagcgggcatacaacaggggcacaataaatgtttgttaagtgaatgagggctttgagaactagatgggatcttagtccaactctcttatttaacgaggtccacagaggttctgcgattgtctaagaaagaaggctgtgttcatggcctttgttgtttacgtggccctgtgattctcttggctccgtgaaagtcctgatgcagacattccggccatctagaaaggcatgcagacaagccatccagctggcatgatcctgagtccagcttt

SEQ ID NO: 6871 - DNA, 300 bp, Homo sapiens
cagagcgtggcaggagctcttggctggccctgctgggagtttcgtctcctagcaggtacggaaagccatgagggatgctgctctcagcaacaattctgccttaacagagaaggcagaccagtcctcaggacctggagggaggtcatgttgtggacttcatagctggaaaagaacactggattttaggaacacggtcgcagaaagtttagactaagaagtagattcttctgggttggagcatatttccagaagagatgataaagttacaaggatgataagatggtaatagatgccttgatt

SEQ ID NO: 6872 - DNA, 292 bp, Homo sapiens
  misc_feature 182, 196, 204, 206, 208, 210, 221, 222, 230, 232, 235, 236,240, 244, 248, 250, 252, 254, 258, 261, 262, 263, 268, 269,272, 276, 278, 279, 280, 283, 284, 285: n = A,T,C or G
aattccgttgctgtcgattcattttgtataatcatgtatcctcttgtgtgctggtagagattttaatcctgatttttccataaaacatgagtattaagaaataattcctggtttggagaaactggataaatcacccttttaaggaagaaacactggaaatttctgctaacaccaagatattnaagagtggacatantaggtgcntnancncattaattganngaatgaangnttnnaaanactntcanancncntatnctnnnctaannctnttcnannnacnnnatttttt

SEQ ID NO: 6873 - DNA, 299 bp, Homo sapiens
  misc_feature 280, 292: n = A,T,C or G
aattccgttgctgtcggggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagattccttatgcntatgtgactganagaggac

SEQ ID NO: 6874 - DNA, 293 bp, Homo sapiens
  misc_feature 157, 159, 160, 177, 191, 193, 194, 198, 200, 210, 215, 217,218, 220, 224, 228, 242, 246, 248, 249, 251, 252, 253, 261,262, 266, 273, 285: n = A,T,C or G
aataccgttgctgtcgaagatgtaaagccacattgattcactcagccaaccagatcaatggctcatttgcactcaatttaattcatggaaagacgaaagcagagacagaacaagccaaaagtgagtttcccttttgacttattatcacttccacatntnnctggggagcagattgtncagagagagaaacngnnagcnantgtgtcaagngttancnncnggangaangcctcaaaacgacntaangnngnnnaagcagcnngaancagctcnctgtggtgaacncagaagtg

SEQ ID NO: 6875 - DNA, 300 bp, Homo sapiens
  misc_feature 123, 129, 143, 151, 153, 158, 160, 161, 166, 168, 169, 170,172, 176, 181, 182, 185, 186, 187, 188, 194, 198, 199, 200,205, 212, 213, 214, 217, 230, 232, 235, 236, 238, 240, 243,246, 248, 251, 255, 256, 259, 262, 264, 266, 270, 272: n = A,T,C or G
  misc_feature 274, 278, 280, 282, 283, 286, 291, 293: n = A,T,C or G
aattccgttgctgtcgcgaggctccatgatgcagcttacgtcggggacctccagaccctcaggagcctattgcaagaggagagctaccggagccgcatcaacgagaagtctgtttggtgctgngtctgnctctactgcatacnggtgcaantntcggntnnttttngnnnanggtngcttnngtnnnnttgtantttnnnttatntcttctnnnttnctctttaatatcntnttnntntngtnctnanttntttnnctnaanancncatntnantttncncnngtnttctntnctttctt

SEQ ID NO: 6876 - DNA, 300 bp, Homo sapiens
aattccgttgctgtcggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaaccgtttctgatggacaattaccaggaaattctgaa

SEQ ID NO: 6877 - DNA, 280 bp, Homo sapiens
  misc_feature 163, 166, 176, 182, 189, 199, 203, 210, 214, 224, 226, 228,229, 231, 233, 238, 251, 259, 260: n = A,T,C or G
aattccgttgctgtcggcatatacagcaaattaaaggacccagaaagctggatccaatagtgacctgggtacaccaatcggaatattgaatttggggaagtcaagggctgggatcaagaggtggattggaactaatgccatgtaggatggtatgactaggcancantgtgttgttntctgtntatatantggtgtcctncctntcttgtntttntccttggtgntntnntncnactanatagtgactcctnagtcgggnncgctgcccctgttgaatttt

SEQ ID NO: 6878 - DNA, 262 bp, Homo sapiens
  misc_feature 129, 150, 151, 155, 156, 173, 185, 186, 187, 188, 189, 190,194, 195, 200, 201, 203, 207, 211, 212, 213, 215, 217, 219,221, 225, 234, 236, 242, 243, 245, 246, 247, 248, 249, 250,251, 260: n = A,T,C or G
aattccgttgctgtcgttaagttgttggctcagtgtatgctggggacaaagaaaaactaacaagccgacctgcctttatgataaattctagtgtgcttacaagggatgacttcctgaggtgtgatctgnccaccttgaagaactccacanntgannaaggggagctgtgatancgagaattgggnnnnnncatnnggttnnancaangggnnntnangntnaaanatccctgantnaaatgnncnnnnnnnaaaaaattntc

SEQ ID NO: 6879 - DNA, 299 bp, Homo sapiens
aattccgttgctgtcgctcaaacaaaaaagggacatttatgtgcagttgggacagcaaaccaagtcctggacgtaaaatcgaataaaagacacattcatatccaatagagaccacacctgtattcatatgggaacaatctggaatagtgatatcctcaaggggtaaaaaatatataaatatatatatatatgacaaaaggtatgaaatgcaaaaaagaaaaaaaaaggtgacagccgcagttgatgctgtgatggccgtgaagtgtcctgggcctcccgaggcctctgacaaataaaca

SEQ ID NO: 6880 - DNA, 261 bp, Homo sapiens
  misc_feature 137, 141, 145, 147, 148, 149, 155, 156, 157, 158, 164, 171,176, 188, 198, 201, 203, 211, 214, 219, 220, 221, 225, 230,231, 232, 234, 237, 240, 241, 242, 254, 255, 256: n = A,T,C or G
aattccgttgctgtcggatttgtgtcttgaccaggggccagatacagagaatgtccccatcatgtacatctgccatgggatgacgcctcagaacgtgtactacacgagcagtcagcagatccatgaggccattctgngccncacngnnnatgatnnnnacaccngatacancatgntgtagtgccctnctacagacantgncnatcagtgnccncttannngacnccaannnanttnccnnngtgtccctttannnacaag

SEQ ID NO: 6881 - DNA, 300 bp, Homo sapiens
aattccgttgctgtcgcttgtttttcagacctcgaactatggagaacaggaattgaagcccaggtggatggtccaatgccagaccatggatcatcagcctgggacaccaaagtgccacactctcagagtgaggatgatttttaggaagtcagctctaccaccctccataccaggaagtgcaagcagactcatctcatgatcgagcagaatatgagaatccttttgaagttataagtctgtatggatttgtagcacatgttcatacaattagatgggaccaaatcccttaatttattaaga

SEQ ID NO: 6882 - DNA, 262 bp, Homo sapiens
  misc_feature 169, 170, 175, 177, 179, 183, 186, 187, 193, 195, 201, 204,207, 208, 212, 215, 217, 225, 226, 236, 238, 246, 247, 248,251, 254, 258, 259, 261: n = A,T,C or G
aattcgttgctgtcggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtanntaatncntnttgngcnnacatgngnaagaancgntcnntggnaananctgttccnntcgaagattncnttgagctnnnaanccnttgnntnt

SEQ ID NO: 6883 - DNA, 300 bp, Homo sapiens
aattccgttgctgtcgcaagggtcttctctttcactcaagctgccattctcctagccatttgtggcttgacaccccaagagctttattctctcttttcattgcttgagtccaccaagataccaagttaggtcaccttttattttaaatcagccccaacgagggtcccctccttttcacttttactcctctgctctaatccaggtcttcataaatttttgggcttttagctgatttccctgcctgcctctttcaaagccctttacccactgcggaatcatatttaccatgcaggactgcca

SEQ ID NO: 6884 - DNA, 285 bp, Homo sapiens
  misc_feature 141, 144, 146, 151, 169, 171, 172, 176, 177, 178, 185, 186,188, 189, 192, 196, 203, 204, 206, 207, 212, 214, 218, 228,229, 230, 231, 233, 236, 239, 240, 241, 245, 247, 248, 250,251, 253, 255, 257, 263, 265, 267, 270, 271, 275, 276: n = A,T,C or G
gacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctnttntnattcnttggacacttcaatttcntnnatannnttattanntnntgntttnattttanncnntctgntngctntttaaatttnnnntntcntannngttntnnanntnananatactntntnttnnactnntattttaca

SEQ ID NO: 6885 - DNA, 266 bp, Homo sapiens
  misc_feature 173, 179, 181, 185, 186, 191, 192, 196, 198, 199, 200, 201,202, 203, 205, 206, 207, 209, 210, 216, 217, 219, 220, 228,231, 236, 239, 240, 242, 250, 259, 260, 262: n = A,T,C or G
gtccgacgcgcctggctaggagcgccgaccgcagggcctctacggaccttactagaaaaatgaaacctgatgaaactcctatgtttgacccaagtctactcaaagaagtggactggagtcagaatacagctacattgtctccagccatttccccaacacatcctggagaaggnttggcntngagnnctctnngaangnnnnnncnnngnntggganntnnactgtctnttncattngtnntntctttgantttctattnngncacg

SEQ ID NO: 6886 - DNA, 300 bp, Homo sapiens
  misc_feature 8, 12, 16, 18, 27, 29: n = A,T,C or G
cctggcantttnccananatctctaantncgaagctgtcgaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtcttttttttttt

SEQ ID NO: 6887 - DNA, 292 bp, Homo sapiens
  misc_feature 139, 143, 147, 162, 169, 174, 178, 184, 205, 208, 213, 217,224, 227, 230, 247, 248, 252, 258, 260, 266, 269, 272, 273,279, 280, 284: n = A,T,C or G
aattccgttgctgtcggccgctctctgtaagtgtttgcttgtgcaaaagggaatagtgccgtggaggtgtgtgtgtccatggcatccggagcgaggcgactgtcctgcgtgggtagccctaggacgcagagtgaggccnccanccanagtcagaccctttgnacctggnacatngtancattanacactttatatacctgagccnatnagccntgtncctcaancancanccctgacttggatatgnngaanaggacnantttggngcntcnnatactnntttngcttactc

SEQ ID NO: 6888 - DNA, 300 bp, Homo sapiens
aattccgttgctgtcgctcactacctttggaccagccagggctgtttataagtgctaaagcccgaacaaaccaaagagttggggagaaaggcctaactaacagctgagtgattgtctaacagactgtcttttaggccagtgactctggcatagggcaggctgcatagccagcaacatcccttaccacaggtctagtgattcctctgggctcaaatgtggaggctacacacccactccttagcagaggttggcctggcacctgctggtgccccaagaactatggcatggttagaccctggc

SEQ ID NO: 6889 - DNA, 300 bp, Homo sapiens
aattccgttgctgtcgtccattctttggacacccaaactcagcccccttaaagagtggaaacaaaacaagctgcactttgcagaggtggtaaatgaaaggactcttggcctaacttcaagagtcccctggggtttgaaggggcaaagtttgagtctggatggaacctgggctgaggtaccttaagcttccccccgcaacaccccagcctcagggattgcgggagttgtcagagatctgatggatccgaaaggggcagggccaggggattaggtttggggtcagaggttctgttttccagg

SEQ ID NO: 6890 - DNA, 260 bp, Homo sapiens
  misc_feature 72, 74, 94, 103, 105, 111, 113, 115, 118, 122, 128, 131,133, 136, 137, 138, 143, 149, 151, 153, 162, 163, 166, 169,172, 181, 185, 193, 195, 200, 201, 203, 206, 210, 220, 224,225, 228, 231, 242, 244, 255: n = A,T,C or G
aattccgttgctgtcgcggggaagtggaagcgccgggccctgctgcgggggggaggtgtgggaggttttacnanatgggacttgggtatatttnttattaaantnattatnantnttntatnactatnttntnatnnnatatnttttantntnttccttacnnttnttnctnttaaatttntttnctatactntntttanntntgntatntatttttttntatnnttntanttatattaatntnttttacatatnttaaa

SEQ ID NO: 6891 - DNA, 300 bp, Homo sapiens
aattccgttgctgtcgcctgtatatcccctaaactcctcacctatatcacaaaaacctgccaaggcagaatacattcccttgggaaaggagctttggcgggcaagcaggcatcgggtcccatctgacaccagcgtgatcgccacaggagccatctaggaaaggggaatggaaactgagatgctggcactttgggccctgccaatgagctaaagcagtgtataattaaggaattgcacaggcttccttccccaggacaaagcagcgcacagtcttcttggattactgtcctcttacagcaa

SEQ ID NO: 6892 - DNA, 300 bp, Homo sapiens
aattccgttgctgtcgcttgggtataacctaacccaaagaaaagtggcatgtgctgaaactgagtgtcacagagctgtgaggttgggtctttgggattagcttcattttccagggtttgccctttgcccttcaaccaaaggacaaagtcatgttaacagctgctactaagtctatatgcccattcgttcataccacaaaacaggcatctgactcctctggtcaccatggaatcaaggcactgtcaagtggtggggggtccacaggcacagtgggcttcactctggaacaggattactggg

SEQ ID NO: 6893 - DNA, 300 bp, Homo sapiens
aattccgttgctgtcggccaggggaggtcaaggctgcagtggactgagattgcaccactgcactccagcctggataacagagtaaaatcttgtctttaaaaaaaaaagtatgactcagcagatggaggagcctcccatttggtctttcctttccgtttggtttgtcttccaaatctcctccagcctgctgtgtattcctcagcaactcacttcaagcaccagcctgatcctgtagatgaaccctgcataactttctccgtcaacaaacacctgaggatctgctgtgtccccagtactagg

SEQ ID NO: 6894 - DNA, 300 bp, Homo sapiens
aattccgttgctgtcgacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatag

SEQ ID NO: 6895 - DNA, 259 bp, Homo sapiens
  misc_feature 116, 122, 123, 130, 132, 135, 136, 144, 148, 156, 157, 160,164, 167, 179, 188, 192, 193, 200, 204, 206, 217, 222, 225,234, 235, 237, 240, 241, 248, 258: n = A,T,C or G
aattccgttgctgtcgggaaagtagcaaaagagtaggagatggggaaatagggatggggagagcaagccccgcatgtccatggcgagtcaggtggggagcacgggtggaagggccngctgtnnactgatngnctnncctgtgtnttcnagtgaganntcngtantcngggtgcactccntgctgtacnctcnnccctatnctgngnctactctgatnatgantcnacccttatnngnctnnctgctcntttgctctcng

SEQ ID NO: 6896 - DNA, 300 bp, Homo sapiens
atttttagtttttcgagtacaccgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagc

SEQ ID NO: 6897 - DNA, 300 bp, Homo sapiens
aattccgttgctgtcggccaagggctccactccagtcccttgcctgtcaatcagaagatgctcagaggagaggcttctgcatcatcttcatcttgacattccaagagcagtaccgggtcagcatccacaaaagcacactgtaaaactgggaactgtgtcttacccttcctgagtgaaaagggaaagtttatgcctcagcctgaggcaggtgggccccttgccatgcacacctttgtcctgcagccagggatccacttggctgggctcaacccttccccgtcagggacgactgcacagaaa

SEQ ID NO: 6898 - DNA, 300 bp, Homo sapiens
ggttcctgccggctgtattcgggccttggactggactgagaagctacggtgcggatccagctggggtggagaccatccatggaaaagaacccccctgatgatacgggccccgtgcacgtgcctttggggcatattgtggccaatgagaaatggcgcgggtcacagctggcgcaggagatgcaagatgctgcattctttatgtcaccgaagctgatttggtggcaggaaatggctacagaaagaggcttgttcgggttagaaattccaataatcttaaaggaattgtagtcgttgaaaaaa

SEQ ID NO: 6899 - DNA, 300 bp, Homo sapiens
aattccgttgctgtcggctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacag

SEQ ID NO: 6900 - DNA, 300 bp, Homo sapiens
aattccgttgctgtcgagaggtcagtgggtttgccgccgtgcatatcacgcccttcccccacgttccccctaccccaggacctccttgggacttacacggaggcccgaggtcagaaagcacttctggtccaagctgaggcaaggccgccccccatcccccaccccctgcctgcctcgccactcaacaccctggcgttccgaacaccctccatggccaaagtgaccactccctgtctgctgaagtgttttcatccccatgctcacatggacacccagccaccagcgtggtctcaggcacat

SEQ ID NO: 6901 - DNA, 300 bp, Homo sapiens
aattccgttgctgtcggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgt

SEQ ID NO: 6902 - DNA, 300 bp, Homo sapiens
aattccgttgctgtcggcctgcccgaggtgcgggccgcgggtcagggccgcgcatggcatccccgacctggcccaaaagctccatttctatgaccgctgggctccggactacgaccagtgctgggattataggcatgagccactgtgcctggtcctgctccatgaatgtagagaagagaggcatttccaagaccaggtgaggaatccacatggggtgcaccctaaggcagaaaggagaggggctgagcatgagaacgaggaggcgctggctggctgcaggacaggaaatcatagaggtgg

SEQ ID NO: 6903 - DNA, 300 bp, Homo sapiens
aattccgttgctgtcgctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaagg

SEQ ID NO: 6904 - DNA, 300 bp, Homo sapiens
aattccgttgctgtcggaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgcgttctgaccagatgggcaaaccaacatcagctgatctgaagctcgggttagccactggtcctgtcctgtttgcctgtcagcagttcccagaaatgaatgctatgatcatgcgacggttcagtttgcctggagatg

SEQ ID NO: 6905 - DNA, 300 bp, Homo sapiens
aattccgttgctgtcgccctagtcttccattagctctttcactggaatttgagtatattgtacatgaaggttggttttcaatttgaacgtctagaaagatactcatttctaatacctatgcactgtagtttcaggtttacttgcagacaccctggtagggttaagaggaggatatttccaagttattttaaattgagtttacttttaactggggttcttgactctagtgtaattgctccaacaactacgtagaagtcaaaatgagtgactttagtgaagcttctgtactttacaatacat

SEQ ID NO: 6906 - DNA, 300 bp, Homo sapiens
aattccgttgctgtcggaagggtgctgctattgggtctatggaagcttatctatcaaaggagcaaacgtccagaaaagtgtttataaagcaaatgtattgcctctgtttagagatttgcccagctgttccagttttaaacattaaaaaataaactcagttgccatggcaaaaatagaatgcacagcttacttataattttccatgcagtatagcataaggatttttgacttgaaacaaccaaagaactcctccttaacgagacagttcaaattcctgaattagtatttcttgactatcaa

SEQ ID NO: 6907 - DNA, 300 bp, Homo sapiens
aattgttgctgtcgctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgctcatcccttgttggcagctccagttcaggccgtggagggacgtgatgctgggctgtg

SEQ ID NO: 6908 - DNA, 300 bp, Homo sapiens
aattccgttgctgtcgcattaactttcagtttccccatgttacttttgtaacagggatttgagaccttaaactgttcatcaaagtaagccctaatagaaaggcagagcaataagagcacatgctgatgtaattctcctttgcaaggagaatttcatttagttccattgtcatatagaccagtgtcaccccttttccctgattcctactgataacaactatttttcagtgcctttgaagatactgacccttctacctgcccagctgtttttaaacagctggagcgtgatgatggtcataaa

SEQ ID NO: 6909 - DNA, 300 bp, Homo sapiens
gctagattttcccatggtgccgttcctttgcagacagaggattcggagagccctaggagacaggcctgcaggaatgtgcttcattagctgcagtgcgctggtgctgcctaacagaacgcacactggctgtcactaggaagcgccatacggttgctatcacccaacatggtgaaagggtgatggatttcactgtgaatatgccaaggacacctctaaacttcccccatgtcagtcagatgaagttactactatatttcaccaccctgcaggtaactgaaactcaattaccgctgccgctca

SEQ ID NO: 6910 - DNA, 300 bp, Homo sapiens
aattccgttgctgtcgcagggtggctgcacaattggcccctctatgctattgaacccccttaagggaggctccttgctagccctctggtttgtggtaatgtctgctgggacatattttacattttgcatgaagccatgttggagattcctttagctaaatataacatctggagaaagtagcctcctgttcacagcttaaaaacagactgactttgtctaggacgagagggaaaattgagcccgtttggtgctcctgacatctcctttcatgtaatgaaagctcagtctgtctaacctctg

SEQ ID NO: 6911 - DNA, 300 bp, Homo sapiens
aattcgttgctgtcgcactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctct

SEQ ID NO: 6912 - DNA, 300 bp, Homo sapiens
aattccgttgctgtcggtgctgtcatcgagtcccaggtcacatcgtcacactcatcagccctctgcggccagtgtccccacctcctgccatgtttccctagtagcttggtctttatccagaactgtgaggctgctgtggggtgcagcgtccttaggagggtcctgctggagcagtggccctaagtgagtctggactgtgtgaggcaccccagccctccacggcaaggccggggcctgggggtgctggtgcctgtgtgcagcctgaaggctgccctcttgctgcttcagcgagtgggaagc

SEQ ID NO: 6913 - DNA, 300 bp, Homo sapiens
aattccgttgctgtcggccgtctagtttggtgtgcaaggatgatgtttggagcaataagaacgtcgctttgtttttttccttttatagaaagagcaaggttcagggtaggcattagggcgggtgtaggtgtagaaggaactggattattggtttattgcatttagaatgtcagtctggtccttgcggtgtcaagatgaactcacgtgggatgttaattcacttgtaaaactgagggttatacatatgtgctcaggtattgggctgaacaggtgctttgggggtgcttttatgtgcccgac

SEQ ID NO: 6914 - DNA, 300 bp, Homo sapiens
  misc_feature 263, 267, 268, 270, 278, 287: n = A,T,C or G
aattccgttgctgtcgagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaanttcnntntttacaancctaaactntttaaaatccaaa

SEQ ID NO: 6915 - DNA, 300 bp, Homo sapiens
aattccgttgctgtcgaaggttgcgtagctaataagtggcagaactgacatgcaaaaccagtctgtctgcccccacagatgcatgttctttaccatcacgtaggtcaggccaggatgtcaaggagagcaaccccgaactagtcctggtgatttagactagagcgtctttcactgctgtgattccttcattggcactttcttccagttgtacagtgtctgtctttgcttggtctttgcttgttctacccttagtttagcagatatccctctctccatgaacaaggtgagtgagctcttttt

SEQ ID NO: 6916 - DNA, 300 bp, Homo sapiens
aattccgttgctgtcgccaaacaaacattgcagggttgatcctagtcttgaaagttcgggcctttcctcttggcctgtttctggaggaaatgctcatgaggtgggtgagaggcggatgacatcctgtcgctctggcctcaccctggggatgccacatgacagcaccgcagcattttcaataggtgacccacctgcgaggaggaaggaaaaatgtgcccaaggccattatggagaacaaacacctatgcagttggagaatgctgaagacacccaagggtgttgtcctctccctcctgagag

SEQ ID NO: 6917 - DNA, 300 bp, Homo sapiens
aattccgttgctgtcggcactggtggcaagaggctgctgatccccgttgtgcctggtgtggacagcctcaactcggccatggcggcaagcatcctgcttttcgaagggaaaagacagctgcgggggaggtctgggaagttgagcagggacaggagttaccactgaggacgcagaagtgacttctgcttgaggacgtctgcagctcctcctacaccagcacactggtgggaggctggcggagtcagtgactatggcccacgttcaggaggaaggtgtgatgccgtcatacagttacaggaa

SEQ ID NO: 6918 - DNA, 285 bp, Homo sapiens
  misc_feature 180, 182, 203, 206, 210, 213, 215, 221, 222, 227, 230, 232,233, 236, 239, 240, 241, 244, 250, 251, 257, 264, 271: n = A,T,C or G
aattccgttgctgtcgctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggantncctacagggcttactagaganccnatcnccngngacctnntggancancnnaanccnnntancgaacnnagagcncaccaanaggcctnaccaccatccatcc

SEQ ID NO: 6919 - DNA, 300 bp, Homo sapiens
aattccgttgctgtcgcaaatctttgccacttctaaagcccaaaaattactattccggatcatagattggttactgctgccacatgcagtattacagcaagagaaggaactgcctgcacctatgttgtcagcaattcagaaaagtcttcctttgtatctccagggcatgtgtatcgtgtgttgtcaatctcaaaatccgaatgcctatttgaatcaattgctagggaatgttattgagcagtatattgggcgatttcttccagcttcaccatatgtttcagatcttggacaacatcctgt

SEQ ID NO: 6920 - DNA, 300 bp, Homo sapiens
aattccgttgctgtcggaaaagagaacaacatgagattaaaaatgagactaaaaggagtagcactgtagatgggttaaggaaaagacccctcatcgtatttgatggaagttcaacaagtacaagcataaaagtgaaaaagacagagaatggagataatgatcgactgaagcctcccccgcaggcaagctttaccagtaatgcctttagaaaattatcaaattcctcttcgagtgtttcacccctaattttgtcttccaatttgcctgtgaacaataaaacggaacacaataataatgacg

SEQ ID NO: 6921 - DNA, 300 bp, Homo sapiens
aattccgttgctgtcgcctaaactcggagcagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatc

SEQ ID NO: 6922 - DNA, 300 bp, Homo sapiens
cccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggag

SEQ ID NO: 6923 - DNA, 267 bp, Homo sapiens
  misc_feature 192, 220, 221, 222, 226, 227, 232, 233, 234, 236, 242, 243,245, 246, 247, 248, 250, 253, 256, 258, 261, 266: n = A,T,C or G
aattccgttgctgtcggtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgnttttcttgggggatggggtggggtttcnnntccnntattnnnantgtttnncnnnnanctntgncnctntacanc

SEQ ID NO: 6924 - DNA, 300 bp, Homo sapiens
aattccgttgctgtcgcattttcaacaaaacatccctggagtcagattttgagttggggtgggctaatcagggagtcggggctctctgcgtgatgtcagttctatggctaactggtttttctaaaccagccagctgcctatcaaaacagtacaacttttctaggaaatgcaattggcaaagacacttacgatgctgagaagtacacaaggtgaaactgctccagtttttctcatagcagggtcagcaggaaagcaagtggtgcccctggtcccatctcacacaggtgagactgcaccgag

SEQ ID NO: 6925 - DNA, 300 bp, Homo sapiens
aattccgttgctgtcgggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtccc

SEQ ID NO: 6926 - DNA, 298 bp, Homo sapiens
  misc_feature 288: n = A,T,C or G
aattccgttgctgtcggtccatcttcctcttctctgcccctgcatttccatcccaggaggaccactgggcacaaggaacatcagaaaccagggagcagtgtgcattgggattccttccagacgctgagagctgagaagtcgtccccctttcataaccttgctcagactcaggaggttgaggcagaagaatcgcttgaacccaggaggcagaggttgcagtgaaccgagatggcgccaactgcactccagcctggtgacagagcgagactccgtctcaaaaaaaaaaancaaaccaaaa

SEQ ID NO: 6927 - DNA, 292 bp, Homo sapiens
  misc_feature 222, 226, 228, 230, 236, 252, 259, 263, 280: n = A,T,C or G
aattccgttgctgtcggcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccgntctntncnacgacnacttgatgaccaagtntgtcatnatgngaatgaataactactanagactaaactat

SEQ ID NO: 6928 - DNA, 196 bp, Homo sapiens
aattccgttgctgtcggtttatatccaggatccgtgcctttccaccgggtgtggtgggcccagaggcagccaaggagtgtgctcttctgtccagatgagccttggagcccagaatggaaaacaaatcaagcatcggccctaagaggaactgaaagcagccacccaactctttcccagggccctcattctgaataga

SEQ ID NO: 6929 - DNA, 300 bp, Homo sapiens
aattccgttgctgtcgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaa

SEQ ID NO: 6930 - DNA, 300 bp, Homo sapiens
aattccgttgctgtcgatttttcattatgtctacggaggagtgtctctgttatatcagtaggaaatcaaggtggctttttcagagactgtgttggttcctttcaaatatttgaaacactgacagaaggagacattttagatttcctcaaagtttacactgcccagttttggggggaggcatgcctagtttctttgaaactggctatgttttccttaatacctgatttgcctttctctgtaatccttaaaataaaatttgttaaaagtgttcttcattatggaaacaatatatatgtggta

SEQ ID NO: 6931 - DNA, 300 bp, Homo sapiens
aattccgttgctgtcgtttaatacttttttttgctaagtgctgctgggaaacacatggaggagaacaaaacccgacaagcctggtgctgctcttactgtatctgtggggtggggaatggggaagttctgaaaatttacaggtgtgtctcagactaaagggtttcaaaacactgtgctgaagcagtgcgtgttgaggtagaaggcacaggagtgttcctgtggttgggagagatatcctgtgtccagaatttgaggcaggagatagaggttttgctggtgggattgtggtgagactcctag

SEQ ID NO: 6932 - DNA, 300 bp, Homo sapiens
gccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacc

SEQ ID NO: 6933 - DNA, 300 bp, Homo sapiens
aattccgttgctgtcggagatggcggagttggacatcgggcagcactgccaggtggagcattgccggcagcgagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcga

SEQ ID NO: 6934 - DNA, 300 bp, Homo sapiens
aattccgttgctgtcgattttgaggaggatggatgaacagagaccgaacgtcgaggaacagatgtggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtt

SEQ ID NO: 6935 - DNA, 300 bp, Homo sapiens
aattccgttgctgtcgctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcact

SEQ ID NO: 6936 - DNA, 300 bp, Homo sapiens
aattccgttgctgtcgcacacctcctgccccactgccctgcttggactctgactcccactcactctgggaagcctcctcctacccaacatggacgatctcctcatgcctgcttgggcactggcctccattctcgggggccctaatgcttagacatgctcctcaccctctgcagctctgacaccctgtgttgggatgccctcacatgggtaccccctcattctgcctgtgcttcaacaccccaggcccagctgtgctgtgcgtgaatacccttccaccccactcaggttctgacttcccac

SEQ ID NO: 6937 - DNA, 300 bp, Homo sapiens
aattccgttgctgtcgggatagacaaggtaaagccgtatctcccaatgatcatagctcctttgtttcgggaactcaacagcacctattcagagcaagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggagtttgtaactaatcctgatattgctgccaagaaaaaaatgaagaaacacaaaaataaa

SEQ ID NO: 6938 - DNA, 300 bp, Homo sapiens
aattccgttctgtcgggttcccctgatccccagccccttgtcatcagcagtgcccctgatcctacctcaggccccttcaggcccatcctatgccatctacctgcagcccactcaagcccaccaaagtgtgacgccaccccaaggcctgagcccaacggtgtgcaccacccactcttctaaagctactggctcaaaagactccacagatgccaccactgagaaggcagccaatgatacctcaaaggccagtgcctctaccaggcctggaagcttgctgccagcaccagagaggcaaggggc

SEQ ID NO: 6939 - DNA, 300 bp, Homo sapiens
aattccgttgctgtcggctcagccagtggaaatcccgccaagcagaggcagccagtatggggggccaggctggccttcgtacggggaggacgaagcggggcgaagagaggccacacacatgctcggacatcaagagtattcttcttcaccgctatttcaggtgccaaggacttcaggcagggagccctcagctccttccgggaacctcccccaccggggactgcagggccctgggctgggttaccccaccagctccacggaagacctccagcctggccactcctcggcctctctcatcaa

SEQ ID NO: 6940 - DNA, 300 bp, Homo sapiens
aattccgttgctgtcggtcttggccggcgctgacgcagccatggcggaggcggctttggaagccgtgcggagcgagttacgagaattcccggccgctgcaaggggtgggagctgccctggggtcaggtgtgagcagtgattactggcatctgggcatgggctgagtgtccattcctctagagccacagtgggctccacagaggtgagtgtggccgtgaccccagatggttacgcggatgccgtgagaggggatcgcttcatgatgccagctgagcgccgcctgcccctgagcttcgtgct

SEQ ID NO: 6941 - DNA, 300 bp, Homo sapiens
aattccgttgctgtcgatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgcagtggctccagcgtgggccacaacaacctgattcctttagggtcctccggcgcccag

SEQ ID NO: 6942 - DNA, 300 bp, Homo sapiens
aattccgttgctgtcgggtgcagctgccgccaccgccgcttctgcaaggtctcagggacgggctgcagccatgtcctattgccggcaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccacta

SEQ ID NO: 6943 - DNA, 300 bp, Homo sapiens
aattccgttgctgtcgcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactc

SEQ ID NO: 6944 - DNA, 300 bp, Homo sapiens
aattccgttgctgtcggaaaatatctaaattttgcacaggagagcaattagagaggcttaaacaggaaggaagtcttctaattccttaaaagcattatctcatatttgaagagttcaagtttgatgcaacataaactgataaagtttgaaataaaaagagacaggttggtaggaaagaccattcatatcctatccccaaactggcttaagtccactcccactgcccccagctaccacctttttactttattctacctgctatttctttggccaccggaataataagcctgatgtaaattc

SEQ ID NO: 6945 - DNA, 300 bp, Homo sapiens
gaaagaactccctggctgtagctcctatgtaggtttaggttgagactctggattccacaatttttaaaggttaccatctgaggtttctgatcatagtctacttttgaagcagctgctgctatttctttattccattgaacaccctggaattgacataattttatctatcagcatttctccccttttagtttatttaataattaacccggtctccagggcagttttcatatgaccatgtgtatattcactgctcacgaataagtttaatgttagattaccaaatttaatatagttacagaa

SEQ ID NO: 6946 - DNA, 300 bp, Homo sapiens
  misc_feature 48: n = A,T,C or G
aattccgttgctgtcgagaactttcatttctaagtacgcttactggcntcaatataagaaatcactccaggcagacagaagacctaacaagcactgagatgacagaaaagagaattagaaaagttctacagagacacagattatcaggaaattgccacatggttacatttcaacttgaatttcagattctggaaattcaaaataaggagagattatcttctgctgttactgacctcaacataataatggagcccacagaatgctcagaattaagtgaatttgtgtctagagcagaagaga

SEQ ID NO: 6947 - DNA, 300 bp, Homo sapiens
aattccgttgctgtcgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgc

SEQ ID NO: 6948 - DNA, 300 bp, Homo sapiens
aattccgatgctgacgagtttgcatctaaataatgcctatgagttgtgtgaagctcttggctttttttccaacgttactttggaactaatgagggtggatgttcattgtagtttatttatttggttctttacatggaggaatttaaaaaatcaaatttttctcttcacctttatgacttgacatttccttgatctgttggaggctaaaagtaggtataaatgatattgaatgttgggtatagtgatactctgccatagtccttactgcatgaagagaacgagaagtcacacaagttcacc

SEQ ID NO: 6949 - DNA, 300 bp, Homo sapiens
aattccgttgctgtcgaacttgtccaagttccagatgaccaacaaagacagctatagacactctaactctgtgccaattacccaaggccttcagggccctgggacctattccatgatagtggtaccctaactgaacccatttcagccactcagattgatagggtggaaaagacagggcaggtggtagcagctgtgaagaaaagaggaaagcagaagggtggcctataatctacaggcatgtagagaggactacataggcctctgttctttgcctcaggagcccccttcctgtcccttgga

SEQ ID NO: 6950 - DNA, 268 bp, Homo sapiens
  misc_feature 145, 153, 156, 159, 163, 172, 176, 182, 184, 187, 192, 198,200, 206, 208, 211, 212, 214, 215, 216, 218, 220, 223, 228,229, 231, 232, 237, 239, 241, 244, 246, 248, 249, 250, 253,254, 255, 256, 257, 258, 259, 260, 261, 262, 263, 266: n = A,T,C or G
aattccgttgctgtcgggtgcagctgccgccaccgccgcttctgcaaggtctcagggacgggctgcagccatgtcctattgccggcaggaagggaaggatcgaatcatatttgtaaccaaagaagatcatgaaactccaagcagngcagaatnggnggntgangaccccaangatncatacnangancacgnctagtnanagtcananggnnannnancnagnaacanncnngccangngnaananannncgnnnnnnnnnnnaanag

SEQ ID NO: 6951 - DNA, 300 bp, Homo sapiens
aattccgttgctgtcgaaacatctggccaacctccaaagtattttcatttatcacattctgcctctgtgtccaactgtccttgactgttcgtggtaatgggaaactcactactctggaggtagctattccattgttggaaagcgctgagatttaaaagctcctcatgttgaattgaaatcccatttcctgaggtttgtgcaaccagtgtatgatatttctagaggctgcctaaaagagtccagtttagacctgttaccttagaaggccccctccaaagttagttgatctgttcagaaaag

SEQ ID NO: 6952 - DNA, 300 bp, Homo sapiens
aattccgttgctgtcgctgcacaggacacttatgccaccctcttgccagatgcctttgaagaaagagtcagactggtccaccctcccccagcccctggggctccttgagcctctctccagccttggcaggaggaggaaaagcagcacctccctcagacagctggaaaggccctcttccttcccagctcagtgggtccggccaagggtcaccagacgggtatttgtccccacctccctaccaaccccaagaacacactccacacccctcttcgctgctgcggtgtgaagcttcagcctaac

SEQ ID NO: 6953 - DNA, 300 bp, Homo sapiens
aattccgttgctgtcgggagaaccaggaccccagagaggtggggccactgaggctggtgcagttgcgctcactcatcagcatggcccggaggctggggggcatcgggcataccccagcaggcccctatgacggtgtgtgaccaggccagcccagtgacctttctcctgctgcacttggagggaggggacatacacacagtctcccatctctcctcccctccccctggggtggcccaccgcatgggtacagggggttccaggaatccaaatccagcatggcttggaggagctctgttggtg

SEQ ID NO: 6954 - DNA, 300 bp, Homo sapiens
aattccgttgctgtcgctcacgccccctaactcgcagggctttgccccccactacgacgacatcgaggccttcgtgctgcagctggaaggtaggaaactctggcgtgtataccgaccccgagccccaaccgaggaactggctctgacatccagccccaacttcagtcaggacgacctcggtgagccggtgctgcagaccgtgctggaacctggagatttgctgtattttcctcggggcttcattcaccaagctgaatgccaggatggagtccactctctgcacctcaccttgtccacgta

SEQ ID NO: 6955 - DNA, 276 bp, Homo sapiens
aattccgttgctgtcgctcttaatttctttctgggtagtaaaaagaacatgtttcattctttgcataaatacttgactctaagcattgacctttgaaaacgcttgtattaacaatttttattaagaaagtgcactctatataacatcttcttgcattacgatagctcattagccaatacacatgcagctatgtaagccacaacagcagacgtcctatccttttgcttttgtttttaagggatcaaaatatttcaagggataccatgaggaagggtg

SEQ ID NO: 6956 - DNA, 300 bp, Homo sapiens
aattccgttgctgtcggttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgt

SEQ ID NO: 6957 - DNA, 300 bp, Homo sapiens
aattccgttgctgtcggggttgcccacccatgggagagctgctctgtattttcagcagaatagggtgtgttagtgtcagagcctttataagaaacaggccagtaacccagcccccttccatggaattcatctcattcgttgtgacacatgatttcctcccaacccagtttggctttctaaatttagtcctccataatgggaagtagagatctttagttaatggattagcaagtttttgcagttctgctatggtggtaaagggggagtaggagaataacattaagtggcaatagtgcattt

SEQ ID NO: 6958 - DNA, 296 bp, Homo sapiens
  misc_feature 224, 226, 227, 231, 233, 240, 241, 243, 248, 253, 256, 257,259, 264, 269, 273, 280, 281, 282, 288, 289: n = A,T,C or G
aattccgttgctgtcggagctttccattacatgagctgtctcaaagcccttaagaactaggtttagaaggtgcagagaccagggcaacttcagggatccaggtagcaggaaggaatcggtagcctctaaacctagttcttaagagctttccattacatgagctgtctcaaagccctccaataaattctcagtgtaagcttcaaaaaaaaaaaaaaaaaaaattncnngggncngtttttnncnaaaanccaanctnnanaaaanccttngagnatttggnnnaacccnnacttaaa

SEQ ID NO: 6959 - DNA, 300 bp, Homo sapiens
aattccgttgctgtcggttgagaagtgctggcttattagagactctggctgaaggtcatgtgcgaactcaggaaactgctaatcacgggtcgtgtttttcagcccctgtcttcaggaaggcttaactctaagggagggttgttttgtgtcatctccagagctctcatttctcctgtgtggcttggtgccgaagctcattcgtcccctcgctgtctgttcggcccttgtcctacctcccctttctctttccacgcttttgtgtaaagtagccctctttcaagctgctcctctgcctttgaa

SEQ ID NO: 6960 - DNA, 300 bp, Homo sapiens
aatccgttgctgtcgaatctgtaaacctttatgacattaggaactaagaaacttagtcccttcgttagggggataatgaaatgtatttagtgtttgtgaaacatagatggtatgtatttggacaattctgtaactttgctttttttatttttatttttccatagcttattggggaacaggtggtgtttggttacatgattaagttctttagtggtgatttgtgggattttggtggacccatcacccaagcagtgtacactgcaccctatttgtaatcttttatccctcgcccccctccca

SEQ ID NO: 6961 - DNA, 286 bp, Homo sapiens
  misc_feature 191, 198, 201, 210, 213, 215, 219, 221, 224, 228, 241, 244,246, 247, 250, 251, 255, 259, 260, 262, 267, 275, 276: n = A,T,C or G
aattccgttgctgtcgaataaagtccatctctcaatacttatactttctaaattcatctcagaatattagcagccatattccacagttcctataatttttactgggggggatttgtgataggaaagtccttgggaaacatttccaatctttcaaaatattatcgcggatcttaagaagcatcggaacttgnatgttgnaanggtgcatgntanancttncnccntctnctacgacccgccnttntnncgnncccnccanntngacgngccccccnncccccccctc

SEQ ID NO: 6962 - DNA, 292 bp, Homo sapiens
aattccgttgctgtcgggttttgctaatctggattcctgtggaagggcctcctctctctgctcgtgttttatagcttggcaactctagtgctagttctgcaatattcgaatttgagtagccagaagaatttgctgccagggtggccttgcccttgactttgaaatgaactcacccgagacttcagcttgatgcctcctttggctaatgctgggttctgggctttggccgccgcctgcctgtccatcacaaggggccatgctctccaatcaggacagaagttttaacatttta

SEQ ID NO: 6963 - DNA, 300 bp, Homo sapiens
aattccgttgctgtcggggcagcccgggttaaaggcacactcactcaaggccggctctcatttagtggcaccgcaggttaaatgctgctcccaggccttgggtcccagtgaccaggaaagttttgaaaatgagaacatgtgttgaccctaggactaggacaacagcgcccttgattttgcggaagtcttccctggaagttgggcgtgcttgatattgagacgctgcactttgtgtttcttgacggctttgctgcaaattctcacacaccttgcgcttgagtaaaaccccaaggattccag

SEQ ID NO: 6964 - DNA, 300 bp, Homo sapiens
aattccgttgctgtcggtctgctgcacgtgttcgcgtgcgcctgccccggctgtagcaccggcggtgcgcgcagctggaaggtgttccgctcccagtgcctgcaggtgccagagagagaggcgcaggacgctcagaaacagggaaacagccttgcagctgaggactggtgtgaaggtgctgatgactggggaagtgatactgaggaggggccttcaccacagtttaccttggattttgggaatgatgccagcagtgccaaagacgtagactggactgctcggctccaagacctccgcctg

SEQ ID NO: 6965 - DNA, 300 bp, Homo sapiens
aattccgttgctgtcgcagacaccttctcctatggtgggcatgaagacttttcaaaaatgattgatgaagctgagcccctgggctacccagtcgtggtgaagagcacacgaggccaccggggaaaagctgtttttctggcaagagataaacatcacctctctgacatctgccatctgatccgccacgatgtgccctacctgttccagaagtacgtgaaggagtcccatggaaaggacatccgggtggtggtggtagggggccaggtcataggctctatgcttcgctgctccactgatgga

SEQ ID NO: 6966 - DNA, 300 bp, Homo sapiens
aattccgttgctgtcgaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagacctt

SEQ ID NO: 6967 - DNA, 300 bp, Homo sapiens
aattccgttgctgtcgctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggc

SEQ ID NO: 6968 - DNA, 297 bp, Homo sapiens
  misc_feature 150, 156, 158, 159, 160, 170, 172, 177, 186, 202, 206, 214,218, 222, 228, 230, 234, 235, 241, 243, 246, 250, 255, 258,260, 264, 266, 267, 272, 279, 283, 284, 287: n = A,T,C or G
gtggtggtacacgcctgtaatcctaagtactcgggagactaaggcaggaaaatcgcttgaacccagaaggcggagtttgcagtgagcggagatcacaccactgcactccaccctaggcaacagagcgagactgtctcaaaaaaaaaaaanttaccntnnnttttttaggncntttcnaaataaaanggggatttttttttcntgtntaaaaatntaanctanttgttncnttannaaaatngnatngggngggtnagnanatgngnncttgnaacagtntccnnggntcctttatcc

SEQ ID NO: 6969 - DNA, 300 bp, Homo sapiens
aattccgttgctgtcggaaccatagactcaatccttcctaaaagctcaaggctttctggcttggtaattttgtggggaagcacttgcaggaaaaacactttgaaatatgaagaaggaaatgtgattccggtggtttctttataggccctaaatcagtacaggaagaaataggacaagaaccagagaagattaactttctgaaactttacaaacagcctaattcccaagtagagaaaagtatattttaaagaatgaatactgggggaggaaatgaaggaaggtgaattaagccttcacagt

SEQ ID NO: 6970 - DNA, 300 bp, Homo sapiens
aattccgttgctgtcggttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcagatatttggcataaatctgtactcttcattatagttttggggggagagaagattcagtcagaaaacttattcaaagtacctaagtattataaaggagtcaaaaaggtacaaagagaaaa

SEQ ID NO: 6971 - DNA, 300 bp, Homo sapiens
aattccgttgctgtcgcaactgcctttttaagaaatttcacttcttgcctaattttctttcccttctgctatagaaatattatgggctggatacaaaatggggtgacatcgagcagtggatggtaggccttgaatataattttgtttttactcttccctccccacttgaatacagtgttgagacttaaatggtttataatgtaattcttacgcagtttaactatgtagatagattcctattgcaccataatttaatactgagagattttcttccggggatttctgcatctggtctctgtt

SEQ ID NO: 6972 - DNA, 300 bp, Homo sapiens
aattccgttgctgtcggtgggatggctccccctatgaaagttgtccagtgagcagggtcaaggtttaggtttggggtacggacatgagtgcaggagccttactctcctgtgtgttgtcagggatggataaaggggatgaagttggaggggtttagtgaatggttgggacagcaaatttcagagaagagcatttggaaataattttctcaaatatatatttttaaaatccatatttgatttttttccctcagggattcccaagcatagtagagctaaaatgaattaatttgggtaaaagta

SEQ ID NO: 6973 - DNA, 279 bp, Homo sapiens
  misc_feature 210, 211, 212, 218, 252, 253, 257, 271: n = A,T,C or G
agctaacaaagtgagttcacagcttccaagaccccaggctttccaggctaataaagagctgaggttataggctctccttatcaaacgctctttggcagctgccataaccattccaagtctagtcctagaatagaaatgacgcggtttcaggagctgacagatggaactttaagccttccttcctgccacatctgaagttcttttttaaannnataganaaccatgacgataaacactccttgaatgccctgnngaanagtgtacttctcanaattcact

SEQ ID NO: 6974 - DNA, 300 bp, Homo sapiens
aattccgttgctgtcggtcttctcaacctcctattgttgttataaaatctctgtgaaaggcagcagcctcctctgccttccatattaaccagcactttccctgtccagaagttattccatcttacggatattgagaagataaatggaagtgattagaatgtactttccaaacataaaacattgtactgtaggagtttgtcaaaggggattaatactaccacatatctgtagaagaactttatgaagaccctgtgtatctctcaaccttaatgactaagattgtagatatgatagaaatct

SEQ ID NO: 6975 - DNA, 274 bp, Homo sapiens
  misc_feature 205, 210, 223, 235, 242, 243, 245, 255, 261, 263, 264: n = A,T,C or G
aattccgttgctgtcgggccaacaaggcttccagctggatgtgtgtgtagcatgtaccttattatttttgttactgacggttaacagtggtgtgacatccagagagcagctgggctgctcccgccccagcccggcccagggtgaaggaagaggcacgtgctcctcagagcagccggagggaggggggaggtgtgggagggtctgnccggnatgttggacttcncggtcaatgtcnttttgtnntncctggaattngcttgnannggtacttcct

SEQ ID NO: 6976 - DNA, 300 bp, Homo sapiens
aattccgttgctgtcgcaaactttcttttgtttcaccagtgggaaggaaaaaataaatgtgaaccaaagcaaactccctacatttagctcatggggttgattccttcgcttcttgcagtggtcttggccttttgtttgcaggccaggagagctattggtgatacccacctctgggctaggatgtgatgggaggtgggatgtaggggcccagggagaaagggttgcagccagcggtcaggctgggagcagagacctccaggcgggtccctggtgttctgggcagtcacgcccaactgccaa

SEQ ID NO: 6977 - DNA, 262 bp, Homo sapiens
  misc_feature 129, 130, 136, 137, 141, 143, 145, 149, 152, 153, 154, 158,161, 170, 171, 175, 178, 180, 182, 184, 185, 186, 188, 190,194, 195, 196, 199, 202, 204, 206, 214, 215, 219, 222, 223,224, 225, 230, 236, 237, 238, 242, 246, 248, 249, 250: n = A,T,C or G
  misc_feature 252, 255: n = A,T,C or G
aattccgttgctgtcgcatttatgttctattgtgcgcactggcaaacgtatgtttctggaacattgcgatttggaataattgatgtgactgaagtgcaaatcttcataataatcatgcatttgctggcnncgattnnaggncnantttnctnnnccanatnatttcagtnnttgntantntntnnnangnattnnntgnatntnantttagtgnntaanttnnnnttttntttgcnnntttnaatntnnntnttntttcctt

SEQ ID NO: 6978 - DNA, 300 bp, Homo sapiens
cttctgtagatactgaagaaacaattgaaccttatacaactgaaaagatgagtcgagttcctggaggatatttggctttgacagagtgctttgaaattatgacagtagatttcaacaaccttcaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctataccgtgtattttt

SEQ ID NO: 6979 - DNA, 300 bp, Homo sapiens
aattccgttgctgtcggtttatggattcgtgggctgcttccacctgctaggagggtggtgtactctaactcagggacagaagcccctgtctgtgctcaggactcttgcagacctctttacctggctgttcatcttccataatcaactggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggcc

SEQ ID NO: 6980 - DNA, 300 bp, Homo sapiens
aattccgttgctgtcgataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaagcctt

SEQ ID NO: 6981 - DNA, 300 bp, Homo sapiens
aattccgttgctgtcgagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaaga

SEQ ID NO: 6982 - DNA, 300 bp, Homo sapiens
aattccgttgctgtcgggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtat

SEQ ID NO: 6983 - DNA, 300 bp, Homo sapiens
aattccgttgctgtcgttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggt

SEQ ID NO: 6984 - DNA, 300 bp, Homo sapiens
  misc_feature 230, 235, 240, 248, 258, 261, 262, 265, 266, 268, 275, 281,285: n = A,T,C or G
aattccgttgctgtcggaaaattgggactgagctagagaaagaaggatcttaaaaccttgctagagaaagagacctgattccatcttcaagacatttgaaaccaaagacatttgaactggaactaaaaggttcaactcagataaactcctagttagattgaagagatatattcttcactctactcttggcaggaaacaaagcactttctctgggagaacctattttcttntttantggtncttttatnttccatggtntanntanncnaattttntttganactntatgttttgaatttt

SEQ ID NO: 6985 - DNA, 300 bp, Homo sapiens
aattccgttgctgtcgggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggacttgctgtacctttgcctggctgcctttgagtacaaggggaaaaaggcctttgaacgcatcaacagcctcacat

SEQ ID NO: 6986 - DNA, 300 bp, Homo sapiens
aattccgttgctgtcggcagggtgtcctaggctctgagtctacagcagggaaacaaggagcctgctctcatggagctcacaggctcaaaggatgcagccacatcattggacctttcagtaggttccctgtgctgttaaagctcccgtgtgtgcacgtgattcaggctccaacaattcctggccaagataacagcacagaggccctggaccacctctgggtgttctgtacagtgggcccttgggggcctggctttcacccactggggtgcaatataaaccctcttcagatgccagaaccaa

SEQ ID NO: 6987 - DNA, 259 bp, Homo sapiens
  misc_feature 200, 201, 203, 206, 209, 211, 213, 214, 221, 229, 232, 237,240, 242, 244: n = A,T,C or G
attccgttgctgtcgcccttccctcctcctcagggtggggtgaacaaggctcctatcccaccccaccccaaaaagagaaaaatgaaaaactcatagtttggagccaggaggcagggtgtcctacagggctgcacagccctgaggggtcagtgctgggatctggttggttggtttgtctttttgtcttttttttttttttnncncantcntnanngaaattngttttaanccnccagngtngncnttaaaccaaagggca

SEQ ID NO: 6988 - DNA, 287 bp, Homo sapiens
aattccgttgctgtcgcgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaacca

SEQ ID NO: 6989 - DNA, 300 bp, Homo sapiens
aattccgttgctgtcggtgccatccgtgctcaggtcccagtgccccaggctgacccacctctggtcagtgagtctcctgtgcctgagtgagggatatcgggacctgggggccctgccccgagcacctcccacccactgctagtgctggggctttgtgagtgttccaacttcatagccgagagttggaggacaaggctggggcagggccgaggaacggattgagtcctgcctaagcctcgggacatctaaacagctctggctctgccagacctcaggtgtgaccctgagccattttccttc

SEQ ID NO: 6990 - DNA, 300 bp, Homo sapiens
aattccgttgctgtcggctactttaaaaagtcgttcatttttgttctcagatattttctctccagtatacctatcactgttgaatgttccccccaacttcccagtagtttggtttttagccatttcataccaatttatacttgtgctatgataacttttctaaagtctaaaacctaaacaaatagctggtggtgatattactttatgttcctgaggtgtagaaagctcttcagaatagcttctgctctttgtgagctccatatggcagtcaaaattaatgaaattaaaaaacaccatgcc

SEQ ID NO: 6991 - DNA, 275 bp, Homo sapiens
  misc_feature 138, 140, 142, 156, 161, 165, 168, 171, 172, 173, 185, 189,190, 194, 195, 205, 212, 214, 218, 233, 242, 244, 249, 253,259: n = A,T,C or G
aattccgttgctgtcggtcaccagtcctcttccttcacttcttgttgtaattgcagccattttcattggattctttctagggaaattcatcttgtagagtgaagcatgcagagtgctgtttctttttttttttttctntngnccaaaaaaaaattngttanccanccnttnnntgggaagaaggncccnngggnnccattttttngggggancngggncaaaaaggcttggcnttaaaggancnttaanggtnaaaaancccattaaaaccaaac

SEQ ID NO: 6992 - DNA, 300 bp, Homo sapiens
aattccgttgctgtcgaaagacctctagactgtgagctcagttatggagaacaaaaacagcttcatagtgagtagaacaccgaggataaacactggggccatgggtcctttctgaggcagcgccacagaagatctttgtggtccttccgtagttctgtaagtctgtctcctaagtatgggtagagaatatgtagcctgttgtgtgtctcccactacttgtaaacagagcatcacattaggggcagggaggaggtggaatgatatttgaggtgcttaaccctactcgaggaattaattatg

SEQ ID NO: 6993 - DNA, 300 bp, Homo sapiens
aattccgttgctgtcggcagtagggggaggtgtgaaaggacttctgcatcagggcatagcatatgtttctgagatcactggaagaagctagcagtgccaggagcctaaagccagctcactgtttggtcgtccagtggagcaggtacagctcacagtccctaagccagggaaacctggctgacttccactaaagtcaagcaagcctggtcggcctcgattagccaaggtgtggactcttcctccaaagcccacctcagcccacctctgccagggcagagaagccaaaatggtcacattgca

SEQ ID NO: 6994 - DNA, 177 bp, Homo sapiens
aattccgttgctgtcgaaagagattgccgatgaagaccccagcctcgtgaacttggataatggggacggtgcgacgccactgatgctagcagctgttacggggcatttggctctggtgcagctgttggtggagaggcacgcggatgttgacaagcaggacagcgtgcatggctggac

SEQ ID NO: 6995 - DNA, 300 bp, Homo sapiens
cttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaata

SEQ ID NO: 6996 - DNA, 300 bp, Homo sapiens
aattccgttgctgtcggctggcactgctgctgtcaagcacaggctcctcgggctcccaaacagccctggcccaggttctgcaagaggttgcgctttccttctgagtaggctggagtgaggccctccagcccacagcccaggggaagaagcacacgtgcactttccaagccccacggcccaaagtaggccactgttaatgtcacagacagaaatcatggccaacactggaagggggctttccagtgagcgcccctagcaagcctgatctcccttcgtgttgactcttccggccagagagcc

SEQ ID NO: 6997 - DNA, 300 bp, Homo sapiens
aattccgttgctgtcggaactgtttatcttatcctcctcagtgatacatcatgaagttgtgtgctttgcctaaaatgcccagttacctgaaattgtataaattcttgccaaaagtgtttgaacttaatacaaacttcccatctcttacctcttagcactgtgctcatcttgaggggacatagtcccaattttgtattttatataatactgttagtgaatatgtgtagacttcatatggttgtgggtaagagaatactgcattcagatagaaaagatgctatatagctaagttgatccagg

SEQ ID NO: 6998 - DNA, 300 bp, Homo sapiens
aattccgttgctgtcggtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggc

SEQ ID NO: 6999 - DNA, 300 bp, Homo sapiens
aattccgttgctgtcgattggaagcaaaactaataatactattagcaatgacaccagccgagcagttgcagatccctctcgtatagaatctgaaatgtggatgatgctgttataaacagcaaagttagccatagcaacataggcactggtaatactgtgggtgggtctaagggtaacactgttccctgatcttactgtcatcatctgcaatctaagtaatgcagataataatggtgccccttggacttgacgccaatctcttggtcctattagaaccatgtaggcagagctattccaata

SEQ ID NO: 7000 - DNA, 300 bp, Homo sapiens
aattccgttgctgtcgaaatactcctctaaagtagataaactccttgagtaaagagaagtttaccatagcaactttcagtagtacttcaaagaagatagctgtataaatgtcatcaaactatactatgtagagaatcttaagtgataaccagggtcacggattccaaacatgtcattataaattgttttatatggtgctcactggtgcatttttccttttggataagggaaaacattattccacttactgtttttgctttaagcagcctgcatatattggttagtttgttcagatgttgt

SEQ ID NO: 7001 - DNA, 296 bp, Homo sapiens
aattccgttgctgtcggagaagttgagtggttgggacagtggtccccttcgtggtggaaagaacactgcctcagataatgtgtggctttcctctggtcagaggcccaaatgagtggacaagtactgtgatttctcaagcccctatgcagtgttagatgccactatgaaatacgagccattgaaagagatctcttcaacttattattttttatcacgaacgtacatatcagttatttatgagatttttttttttaaatatttcattttttttcacgactttttctgccattgaatta

SEQ ID NO: 7002 - DNA, 300 bp, Homo sapiens
gtggtaatatggggtgttcagtccccataagatataatagttcatgcagtttatatattaaagtatccagtggaactaaatgtacaatatattcctaagtgcttgcctttttcactgtgctgaccagctgttcaagccacttcagtttgagtacaacataccaacatgacactactcacccacaaaggacagcattgggatcaggctttcagatgacctctaagatttttcccatttattgtactcttgttacaaagtactttttaacacatgcagtcaatggctataaaaactattctg

SEQ ID NO: 7003 - DNA, 200 bp, Homo sapiens
aattccgttgctgtcgctttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtgggaggtttt

SEQ ID NO: 7004 - DNA, 300 bp, Homo sapiens
aattccgttgctgtcgcttgtttttccacacagtggagctgtaactgcactaagatggagcaaacagatttccaaagaggaagattcagtaaattatagtgagaattgacaagaagtttctgtttatccattgaccagagaagggaaataattcatcaagtttagtttgaaggtctcaggatgttgaaatcagacttttacatcttaatccagtgagaatgaaaaatgaactacttatagtgtctgcccatgacaagtcatttctttgcttagggatgcaaatcgtatcacacagtggtc

SEQ ID NO: 7005 - DNA, 300 bp, Homo sapiens
aattccgttgctgtcgaatcattaaggcatgaaccttccaccaacctaactgtcagaggtgcctctcccctctccaactccagattccttccccacatacctggctattcagtatcttctagcatttgctactcatttgtccaagaacaaggccctctactcccctgcctttttggttgttgttgttgtttttgacagagtcttgctctgttgcccaggctggaatgcagtggcatgaacacagctcactgtagccccaaccttccaggctcaagtgatcctcctacctcaacctcccta

SEQ ID NO: 7006 - DNA, 300 bp, Homo sapiens
aattccgttgctgtcgactttatccttttagattctcagtctctttgttgcttgttgcaaataaatcatctagcaacatttacatttaattaggaaatctaacttgcttttaaaagttacccacgttgcatataaaaatcttgctattccttgtgtcttggctttacataagcacttttgctcatgtgactttgcactttgcacttattttaatcctctttaaagggctacaggcaaattctactttgccataatcacactaaggcatggaagaacaacttgcccagaatctagcaggtt

SEQ ID NO: 7007 - DNA, 300 bp, Homo sapiens
agaatacaagccaaaacatggcttcaaaaggtcagctgcatcttcactggattacagaattcttgctgactctcagaagaaattgttggagagaatagtcatacctactttaaaagagaataaatagcctttcctaaattcctctgcttcgctcctttcctggcgttgctctggaaccttgttggtgtctgtgacccaatgactgttagggtcagctagcttcaattgcccctgcactggaagcaaggtttgtcagtaacaccaattaaaatactaccagtgtaagtagaaggtgtgttt

SEQ ID NO: 7008 - DNA, 300 bp, Homo sapiens
aattccgttgctgtcgccatggttaggaagaactgttccacatacacctgacattggagtcagtttattgatatgtttggagattggcctttcaacagttttcatatttgaagaattagaaatgaagtccgttcagattctccaaagaacctccagccactggtgggggacattcttaattcacattcctatcagttggtatctcctgtccctgaagacactgatgaggcttgggaggagaatcccacctttccctgcagggggttaggctgggcagggcagggaggtgagggcgctggt

SEQ ID NO: 7009 - DNA, 300 bp, Homo sapiens
aattccgttgctgtcgattcaagcactggtccttgggtgtctgacctctacattctagtttatgcaatgtctttagagaattttgtgcactggccactgtgatggaaccattgggccaggagtgctttgagtttatcagtagtgattctgccaaagttggtgttgtaacatgagtatgtaaaatgtcaaaaaaattagcagaggtctaggtctgcatatcagcagacagttttgtccgtgtattttgtagccttgaagttctcagtgacaagttttttctgatgcgaagttctaattcca

SEQ ID NO: 7010 - DNA, 300 bp, Homo sapiens
aattccgttgctgtcgctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatga

SEQ ID NO: 7011 - DNA, 299 bp, Homo sapiens
  misc_feature 215, 226, 227, 231, 244, 255, 260, 263, 276, 282: n = A,T,C or G
aattccgttgctgtcggctcatcctgagaaagatgagttaatcctttttggaggtgaatatttcaacggccaaagaacttttttgtataacgagctctatgtctacagtacccgaaaggacacctggaccaaagttgacatacccagtccacctccgaggcgctgtgctcaccaggcggtgataagtgccctcaaggtggcggacagctgtggcnctttggaaggnngttngcatctaccaacngagagcaaatntaatnctntgacggtatgctncttccngttgcccacttcctctg

SEQ ID NO: 7012 - DNA, 299 bp, Homo sapiens
aattccgttgctgtcggcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttcctttttttttttaagaagaatataggtaaacaggtaatgattcttgattggagataccatttgactcttgatgaaagttgtacgaagatggaaatgagggatgattccaggcgttttagggggaaggctgca

SEQ ID NO: 7013 - DNA, 300 bp, Homo sapiens
ccaaagtaacacaaatgctgccttcaaaatgaaaaccagttttctgtttattcttgctaaatgtttatgtaatataaatgtagtatgggttctggttgatgttttgtgaaaattatgttctgtttcatccagcgcaagtatttacttgatctgatttcttcttgatacaggttaaatgggccagggaaaactatcaccataacattggctcaccatattgcttacggttagcttctgctgatgtcaatgggaagatcatcgtctgggatgtagcagcaggagtagctcagtgtgagatcc

SEQ ID NO: 7014 - DNA, 300 bp, Homo sapiens
aattccgttgctgtcggaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaa

SEQ ID NO: 7015 - DNA, 206 bp, Homo sapiens
gagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatcta

SEQ ID NO: 7016 - DNA, 300 bp, Homo sapiens
aattccgttgctgtcggcgcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgc

SEQ ID NO: 7017 - DNA, 294 bp, Homo sapiens
  misc_feature 175, 177, 180, 187, 193, 195, 197, 198, 203, 204, 217, 229,236, 249, 250, 254, 262, 265, 267, 271, 276, 279: n = A,T,C or G
aattccgttgctgtcgctgtgtttacacagtagtttggatgtacaattattattagtggctttctaaaaaatgaaacagtgttaagcgaactgttgttcctagctttgtactccatgttgtcaaagcatcaacaatgaaaattcgattaggaaactttatttaaaattttaggcntnctntattcantcgtantnanngccanncttaacccattgnatgaaaatctangactgtnttgaagcaagcanncatnacatcttntangnaggnaatantcntgcctttgcataaaa

SEQ ID NO: 7018 - DNA, 300 bp, Homo sapiens
aattccgttgctgtcgcccacacagtttggcatgaaatggtcacttccgcatctagagcacacattatttttctgaagcaccctgttgaatgagaggaatacatacgtgccatcataggttgaaaaagtgatcttttcagcataaattggtgggtgtttgagagcattacttgcacagttcaacaatacagagctggaaatgcataaagaggacattccctgctagtcaacgaatacatagatctgtagctggaaattagttttaactttcaagtagtcaagaaacttttatgtccaata

SEQ ID NO: 7019 - DNA, 300 bp, Homo sapiens
gggaagggacctgaaggctacacagccctgatgatcagtttctgaggggacccctctgggggaacagctccctcctctttcccagagctgactggaaggtctgtctcattctacacactgcatttgttacagaaagggaccaagtggggaaaataaagaacatggaacaggctgagagagagggcagctccattcaaaggacctaggtgtatgccaaaaatgagaatgaagattgaccagcgacttctttggcagagacctgggcaggctggctgatggagagctggggcctgtgaatac

SEQ ID NO: 7020 - DNA, 300 bp, Homo sapiens
caagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcct

SEQ ID NO: 7021 - DNA, 300 bp, Homo sapiens
aattccgttgctgtcggaaagactacgtgctggcttgggcattttacatgacatagaaggcatccgctatgaaccaaaatgtcctcttggagtagacatatcaaaagaagttggagaagcttccataaaagtaccacaattaaaaatggagatatgatttctgctgttcaaaaaagtccctaaagggtctcactctctgacctcagctggagtacagtagccagatcacaactcactgcaaccctgacttcctgaactcaagaaatcctcctgccttagcctcttgaatagccgggacta

SEQ ID NO: 7022 - DNA, 300 bp, Homo sapiens
aattccgttgctgtcgcctgaacctgaaaatcccaggtgggcgtcggggactagtagggtggggaagccttggctccagccttcagggcagtgggtgcctttgggaaccaagtttaggcatggcccagaacacagtatccaagtcggctgtgctgaccttttcatttcacttcatttcattatgttcttctatgtttattttcacagagtctcatccaagaaaaacaaatgtttaccttgctacctttttcctcttccaaataaaaatagctttattgtgtcacatgggggaaacgtaga

SEQ ID NO: 7023 - DNA, 300 bp, Homo sapiens
ttttgcttgcattaccccaaagtttctttgtcacttacttcctgtgcagaagttgtctacctattctagattatggaaataactcagatgaggtagacaacttctgcacaggaagttgtctacctattctagattatggaaataactcagatgagcttcgtcagcaagaaggaagatgcatttaacattttttcccaaggctaaactatgtactataagttattcgaattagataaaaacaggaaaaaaatatatcactatagaatgtctagaaaagtggtttatgtttgttcaactgtt

SEQ ID NO: 7024 - DNA, 300 bp, Homo sapiens
aattccgttgctgtcggatcagccagtttagaggacctgtgggaaaatctgagtttaaagcctgccaactcccctcatgtaaatatctctacaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcag

SEQ ID NO: 7025 - DNA, 300 bp, Homo sapiens
aattccgttgctgtcgagattttggagtttgacttgaggggtataccactggacttttcatcttccggttgggattattgtgaaggattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccagg

SEQ ID NO: 7026 - DNA, 259 bp, Homo sapiens
  misc_feature 107, 110, 121, 125, 129, 133, 135, 139, 140, 142, 143, 145,147, 148, 154, 162, 166, 174, 177, 178, 181, 190, 191, 192,195, 196, 208, 212, 214, 216, 218, 222, 223, 225, 227, 229,231, 232, 233, 244, 246, 248, 253, 254, 258: n = A,T,C or G
aattccgttgctgtcggttttacattctatgattgaaaaaaattttttgaaaactttttatttcattctttcctgtaggattttgctacaaataactttgggaatgnatnaagtggaatgntaantttncagngngccnnanntntnntttttntctcgtanttgngaattcgnttnnttntgttttttnnnttnncaattttctttntaantncntngtgnntntnancnnntggtttgggtntnanattgnngttna

SEQ ID NO: 7027 - DNA, 300 bp, Homo sapiens
aattccgttgctgtcggagattgttgtcttgaactctggcactgtacagtgaatgtgtctgtagttgtgttagtttgcattaagcatgtataacattcaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttga

SEQ ID NO: 7028 - DNA, 300 bp, Homo sapiens
aattccgttgctgtcgtcttggagctttcatttactaatgaggaacaaatgatagtcatgttatgacaatgtgttataaattaacaatcctcttttaaactagatttataaaacctacacacttgagggtttccatttgttctatctagatgtattttgagaaatctgaaacaaaagcttgtttttttgtttgtttgtttgttgtttgaaacagtcttgctctgtcacccagcctggagtgcagtggtgcgatcttggctcactgtaaactcggcctcccagattcaagcgattctcctg

SEQ ID NO: 7029 - DNA, 300 bp, Homo sapiens
aattccgttgctgtcgggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttactttta

SEQ ID NO: 7030 - DNA, 300 bp, Homo sapiens
aattccgttgctgtcgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggc

SEQ ID NO: 7031 - DNA, 291 bp, Homo sapiens
  misc_feature 135, 136, 138, 139, 141, 142, 149, 150, 151, 159, 161, 162,169, 175, 178, 184, 185, 192, 202, 208, 209, 210, 226, 227,232, 234, 236, 242, 243, 249, 258, 260, 261, 262, 263, 266,270, 272, 282: n = A,T,C or G
aattccgttgctgtcgcaaaggatagctgtggttgcattttttcctgagaatggagtaagtgattttcaaaaagcacaaataattggcagtcagagagaaaatggatggccagtgggtgttgagtcagattttgnncnntnncacacannnataacaanannttttaangatccngcncctacnngctttcntactgcgganacctgnnnacatcttactattccnnctctncntncaccgnngccgantacctacgnannnngtnatcntncttgcgcatntttgaacct

SEQ ID NO: 7032 - DNA, 300 bp, Homo sapiens
aattccgttgctgtcgaaggaatggttgttcgcattaaatccatcatcttgagcactctcactctgcttttatctaatgttcccctttttttctctgttgctttcctgaagtagagagtgattttgtataagtgtaggataaaatgtttgagcagatgacaagaaagtctccattctgagtctctgttctttccaaattattaaactgcagggaatttgcccatatccctgggcaggtaacactacacaagagggagtgggttgagcatattatgtatatagatgtgaaatacagctgga

SEQ ID NO: 7033 - DNA, 300 bp, Homo sapiens
aattccgttgctgtcgtatctatccatactatgattattaaatcttatgcggtacctaaacacaccacacccttttgtgttatttctgttcttttctacacgttcttcccactgattggagcacccctctgactcactggctaactgctactttttgttcaaaaatcagctgagagggcaactcatctgtgaattttttcttgacttccctcctcccaggctgggttaggtgcctccctatctctttttttacttaaattttttttctttattatttctttatttttttgagatggagtt

SEQ ID NO: 7034 - DNA, 300 bp, Homo sapiens
aattccgttgctgtcgaaataagaagaagcaactgtacaaaccatgtaagtaaacactcaaatacttaagaaattgatagtttgacataaaaggatgtctctcttgatttctttaaattacaatgtggacctggtggtggtagcatggacctctttttgtggattttctaaatctcttctattttcctgagtattaaatttatccagaaaagtgtttagtttagcgtgtccaccttttaaagatttctgacatttaagttaaatttcaatagtctggttcaaaagatctgccttacggct

SEQ ID NO: 7035 - DNA, 300 bp, Homo sapiens
aattccgttgctgtcggcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacag

SEQ ID NO: 7036 - DNA, 300 bp, Homo sapiens
aattccgttgctgtcgggaggacatagccagggcggacaacatcttcacggccactgaacggaaccgcatcgactacgtcagctccgccgtccgtatcgaccacgccccggaccttccgcggccagaggtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggct

SEQ ID NO: 7037 - DNA, 277 bp, Homo sapiens
  misc_feature 143, 158, 161, 166, 175, 176, 177, 178, 180, 181, 183, 190,196, 201, 204, 206, 208, 209, 210, 211, 213, 214, 216, 217,220, 223, 225, 231, 232, 234, 240, 244, 245, 250, 252, 256,262, 264, 266, 268: n = A,T,C or G
aattccgttgctgtcgctcagcttcaagttcctaagataagggctttcttaagctttcaggtgtatgtatcctctagatgtagacaataatgtcccatttctaagtcttttccttttgcttctccttaaattgattgtacttncaaatttgctgttanggnaattntctaatacnnnnannanttagatnctctantcganctntntnnnncnntnnctntantntatacnntnatattntctnntaaantncctntctctntncnantagcatctg

SEQ ID NO: 7038 - DNA, 235 bp, Homo sapiens
aattccgttgctgtcggggagaggatggaaaaggcaccattacagaacaggtttctagccaaactttctagatactactggtgtcaaagatgaaggtcatgtgcagccatgtaagattagcccaaggagccagctcaaaccatgcacatccagggcccagcttggaattcatgttctggaggccttggctgggaggcagaatctgtgaattttaaaaacactttcatgaatccaa

SEQ ID NO: 7039 - DNA, 280 bp, Homo sapiens
  misc_feature 202, 208, 215, 225, 228, 230, 231, 235, 252, 255, 256, 260,261, 266, 267: n = A,T,C or G
aattccgttgctgtcggacgaattggaagtgctaagtattactatttcatgtggaagtctgaaaataactgcaccgaagtgttctgataaataactaaattgagctagtgagggggaaatttcagccgtctagagagtgtttctcttaaatattttttctctcaagtggaaaggagtgagggggagagcgaggatcacctangcctcncgcctgngcctctgccngancnngacncaacctccttcaacccncgnnaacnnaaggnngagcaccttcccc

SEQ ID NO: 7040 - DNA, 300 bp, Homo sapiens
aattccgttgctgtcgagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctg

SEQ ID NO: 7041 - DNA, 300 bp, Homo sapiens
  misc_feature 278, 279, 290: n = A,T,C or G
aattccgttgctgtcgatttaacttcaagtgtgctgcgagaaaacttcataatagttcctaagatgtgctaaaaagtaaagtccaaaaagatcataaagtctgtagagaagttctaagagtgcagtcagctataaaaacctagcaatttaatttcttagaaaaatgtagctggagttcaaactgtagtaacaaaggcaagtaaattaagttgtgggcaggtgtaattaagttaataggaatggcagggatgaatataaatcagaacaggactaacagnntgaaacattanatattcaaat

SEQ ID NO: 7042 - DNA, 253 bp, Homo sapiens
  misc_feature 121, 127, 138, 149, 152, 158, 163, 167, 168, 169, 180, 181,182, 185, 190, 194, 199, 201, 202, 203, 210, 212, 219, 221,224, 226, 227, 231, 236, 237, 238, 239, 242, 243, 244, 245,246, 249: n = A,T,C or G
aattccgttgctgtcggtttgttgaaatgaatggacaaactcttaggataaatcctaatttgttggcaactgttatttgattttagaaggcaaactgattttattttagagaggggaaggngagggnaggctcattancctcttggaanaangaggantattnctgnnnatgaataggtnnncancttangtantgacngnnnttacttntnattatgnantgngnnttgncgttnnnnagnnnnntanacgt

SEQ ID NO: 7043 - DNA, 300 bp, Homo sapiens
aattccgttgctgtcgcgccccggcccccttcctgccccctcttcccgccagcccgcctggagcaccagcctcgcgcgtccggaggaaccttggcttggcgccccatcctggtagccttaaacttcatagcactttgtggtttttcttaaaactctgagcctgtgcccgggcggatcacctgaggtcgggagttcaagaccagactgaccaacatggtgaaaccccgtctctactaaaaatacaaaattagcccggcgtggtggcgcatgcctgtgatcccagctacctgggaggctgag

SEQ ID NO: 7044 - DNA, 300 bp, Homo sapiens
cgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaagatggagt

SEQ ID NO: 7045 - DNA, 300 bp, Homo sapiens
ccctggtaccccctgcccgcgccgatataatgctttttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatgggggctggacccctatccccccaactggtgactttcccattccccagtgtggcatccagtgcccctcccctgactg

SEQ ID NO: 7046 - DNA, 297 bp, Homo sapiens
  misc_feature 275, 282, 290: n = A,T,C or G
aattccgttgctgtcgagaaatttgaaaccagttgtcagttttcaggtgcccaggagcatgacaatatgcccgagggaccgtaacaggacttgacatggagctgggtctaaagcagatgacctggtggctgcagcgtgttccacacaggcgagcactgtgaggccaaaggactggtgttgagcagaatgaaaaagcacagtgttggttaatcctgaaaagtgaagcctgcaagaaatgaacttcgaccttggagtgggggtgggacaggggctanaaggaanagaggctnggaagtg

SEQ ID NO: 7047 - DNA, 300 bp, Homo sapiens
aagcaacgggtccctctagctttgtgttgcagagactaaattccaggagggtccagccaagaggtcagggactccctacacccaacttccactctaggtggaggctttaccataggtatggcaggccaagacacagggccttgatcaccctctccatacctcactcaagatggattttccatgccagaagtaagccaagaacaccagaggctattgtctcaactgagcccataaagcaggcatgtaactcccagagagtcaggccgctttcctcactcctagctccagagtgtaatgccc

SEQ ID NO: 7048 - DNA, 300 bp, Homo sapiens
aattccgttgctgtcgcttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgt

SEQ ID NO: 7049 - DNA, 300 bp, Homo sapiens
aattccgttgctgtcgcttgtacagtatttctactttttattctaatcaactggactgttgcattatttttatgtagattgctaacaaggtttttgaagaaacactcttaaaagtcataaaagggaaaatcttgacagttctgggatattgccacccttgaccttttggagaaatgtagacagcatctcccaggcatgacgcctagggatcgtgtttatctgtcatcagttggtgactccatgtttattgagcactggctataagccagacttggtgagggactgaaacaattacaagac

SEQ ID NO: 7050 - DNA, 300 bp, Homo sapiens
aattccgttgctgtcggaagaattgaaagagcaagtcatggaagtagaagaagatccgcaaaccataaccactgaggagacaatggaagaagacaagagccagtcggatgtagattttcagtcttgtgaatcttgtaccaacagtgatagagcagaaaatgaaaatggctctagatgcttttctgaagataataatgaaacaacaatgttaattcaggatgatgaaaaccattcagaaatgtcaaaggattggcaaaaagagaagatgtgcaataagattaataaagtacattctgaagg

SEQ ID NO: 7051 - DNA, 276 bp, Homo sapiens
  misc_feature 215, 220, 229, 232, 235, 237, 250, 253, 266, 267, 268: n = A,T,C or G
aattccgttgctgtcgcccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagncaagnggccatggnacnaananacggcgccacggntgncccacaccgaggnnngaaccctg

SEQ ID NO: 7052 - DNA, 247 bp, Homo sapiens
  misc_feature 182, 186, 188, 189, 190, 192, 200, 202, 205, 206, 209, 218,219, 221, 224, 226, 232, 233, 234, 236, 238, 240, 241: n = A,T,C or G
aattccgttgctgtcggtggacacctctgatgaggaaagcatccgggctcacgtgatggcctcccaccattccaagcggagaggccgggcgtcttctgagagtcagggtctaggtgctggagtgcgcacggaggccgatgtagaggaggaggccctgaggaggaagctggaggagctgaacntgangnnngngatcaggngngcnnggncgatgatgnngnagncnagtctnnncngntnntcccac

SEQ ID NO: 7053 - DNA, 300 bp, Homo sapiens
aattccgttgctgtcggtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaattttcaagttttgacaagaatgatagccgaggccaggaagcaatctccaaacgcttgtcagttgtatcaagagttcctttcactgaagaaca

SEQ ID NO: 7054 - DNA, 280 bp, Homo sapiens
  misc_feature 230, 258, 264, 269, 270, 271, 273: n = A,T,C or G
aattccgttgctgtcgctgtgagccaacattgtatgtgtgtggatatttacaaatgcaccgttggattctttgtcgttcaagtgaatgttgactatttacaggtaaagaactctcttgtctttgtagatatcaggttatttgaatcaagtaatatttgcctatctatttatacattaatatgtttaaaaagaaatttctccaagaagaacattcgtcattcattatttgnttgatgagatgatacttacatttttatngtgtantcatnnnanatctaat

SEQ ID NO: 7055 - DNA, 300 bp, Homo sapiens
aattccgttgctgtcgcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctc

SEQ ID NO: 7056 - DNA, 300 bp, Homo sapiens
aattccgttgctgtcggaaaaggcaaattcttagaattttaaagggttttctctcaagtagttttaaaatttcaaatgatggtgttgtatcccttcccttcagacctggaatcacattttcccctcaagacagaaagggctctgcggcaggttgtgcctgggaaggggctgcttctcatttgtggccacctctctgcccaggagctggtgaggaagggtgaactaggggatgcctttcagaacaaaggaggtgaggagatgagcccctccacatctgccccaaatagagaccggcgtact

SEQ ID NO: 7057 - DNA, 300 bp, Homo sapiens
aattccgttgctgtcggagcaggcatggtggtgcatacttgtagtcccatctacttgggatgctgaggcaggaagatcaccggagccaggactttgggattgcaatgagctatgatcatgccgctgcactccagcctgggcaacagagcaagaccctgtctcaaaaataaacatagtattagtacaatgaaaagacaaatcgagaatagataatacaaaaatagccttatagtaaccagacttactgatgaatgccacagacccggagtatgtcacatggtttatcaggtgaattaataa

SEQ ID NO: 7058 - DNA, 300 bp, Homo sapiens
aattccgttgctgtcgccttcatggacctgccagcctagttggggagaaggactgggcccaataccagaagctgatccaaagtggtcagaactggggaaggagacctgtgagctgaaagcaggtaaaggaagtatccagacagaggcactggtaaaagacctggagctgggaagggtctagggaccagggacaggttgtactgtaattctggaaaccttgtgaggctcaaagaaaggggcagagagctcagtgggaaatagaaaaggcacctgaacagtccagggatggctttcgactac

SEQ ID NO: 7059 - DNA, 300 bp, Homo sapiens
aattccgttgctgtcgctgtggccatctttccttacacgtggggaggaatcagcctgagaatgaaaccatcacaggaaagggctgaaagacggcaagttttcactgggtcttacccgacgtgagcccccactcctccatatggacctgttttggaccaatgaggcatcctcttctgtagtcctcaacacgcggagctccaccactcctgagcagtgtgacctcaggtgcttgctgcagaggcatcgggggtctctggccagaggtgacatctgaagcaatcgggatcctgtttggttttg

SEQ ID NO: 7060 - DNA, 300 bp, Homo sapiens
aattccgttgctgtcggtataaggtgtctcagcacctgtttgccttctattccctttagaaggtaagtaaaagtaatgggggaaaggattaggtggagcctgtctaaacattctagtgtgtcttggcaaacatagcctgaaatgattcttaaagaactggcattgtttaatcaaatatttttaagggagattccttaattgggaagtttagtctgtttggggttcaaagagtaaatgaggattagaaaatcatggagagaggctgggcgcggtggctaacgcctgtaatcctagcacttt

SEQ ID NO: 7061 - DNA, 300 bp, Homo sapiens
ctgctttgaagaactaggttggaaaaccaccaagggtttagtccactctgcccccaaatcctgagtctgctgaaccagcaccaccgccttcggtgttggttcaggaagttgcccttgtctggtagggagggtgagcctctgaaataagggttgggagtcatgcagtgtggccttggtccctggggggggtgttaaaactcaagagaagggggaggaagggctggggcactgccctgaagccatttccctcctcaccagcccagacaccaacccagggtggcgggagccacattcatcccc

SEQ ID NO: 7062 - DNA, 300 bp, Homo sapiens
ggatctgaccctgattggggagagctgagtgctgagccttgggagcccctgccagccacctgcacctgtggacagtgggtgggggcactactccccactcagagcacaaatgcaactccttcccctacaatcccatcctgagccattgcagggggcagggaagttcaccccccccaccacccccccgcccccccgaagccatgtcactgaaaaggcctgggggggatggtatatggccctttccccaccaggcgctaaggggaacacccccttccccaggtcttttatttgtttaagtta

SEQ ID NO: 7063 - DNA, 300 bp, Homo sapiens
aattccgttgctgtcggtacatttttgcaattgttttcctctaatgagttgtaagacagataaaatgtgaaaaattggcattaaacatcacttgggaagagtttgtttctttttagcttgaggttggtaaaatggatttatttactccgcgccccccccccctgccccccgcttccatttgggctgaatactaaaaggtttttagagagagagaaagtttcagggggtttcataccctcagtttacaatctgagaaacattttttttaaaagcttccttccaaacctgtagcacattgcc

SEQ ID NO: 7064 - DNA, 300 bp, Homo sapiens
aattccgttgctgtcggcaatcctcccacctcagccttccaaagtgctgggagctgtgagctacacctgtgagatggcacccttgtcctgctgcatattttaagagttctgtttagtccatcaattgaggtcaggaaaatgaacgtgctgaaagataatatgtaatgataataatttgtagacataaatgccagccgtgtctgttaactatttcaggtgatattgtactaaatctctgaaatcacctgtgatgaacttttaaaataaataaaacttttaagtcacagtgtgattataatt

SEQ ID NO: 7065 - DNA, 300 bp, Homo sapiens
aattccgttgctgtcggtctttggttgctgttctttcctagactcttcagaaaaaaatgaattaactagcaatgcttaaagaggtagtaaatacaagccaatccattttcattccagctgcatttcatgcttcagagtaatggctgttagccagaatcacttgtgaagctttatacacatatacattctgtgatcttattccctgtaaacccctattcagtagtcggtctgtgatgaaatcccaggcatcttcattcaggttaaaaaaaatatatatatgtctacatgaaattctggtat

SEQ ID NO: 7066 - DNA, 300 bp, Homo sapiens
aattccgttgctgtcggttctcatggctatggctaaagtgtaagagggtaagcctccttgtacaagctcatgtaagattcttgcttatgtcgtgactactcacatctcattggccaaaacaatgcccaaatttgccaaagtccatggatgggagggattgcaatgttatattgaaaaagcttgatacatagaggggtggagaattggagccagtcattcaacctaccccatatcctttgcacagtcacattaaataatgaataacatatttcttatttgattatttaattggttatctcc

SEQ ID NO: 7067 - DNA, 300 bp, Homo sapiens
aattccgttgctgtcggggagaatcaccctcagcacccgccaagacctgcagacacacctgaaaccagagggcaggggcctgtggctcctggtgaaaccttcattcattgcctgtgggcactgaggtcatcaagttcaggggtcactcatggcagggatgcctggtactgagagactcagggctcctgcctccctcctgggactgtgcaaaagatccctccccccagctgctgccccaccctgatcaggggagggggctgggcaacctagttgggggagagggggccactccctgtcctc

SEQ ID NO: 7068 - DNA, 300 bp, Homo sapiens
aattccgttgctgtcggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgct

SEQ ID NO: 7069 - DNA, 300 bp, Homo sapiens
cttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctcca

SEQ ID NO: 7070 - DNA, 200 bp, Homo sapiens
  misc_feature 174, 181, 182, 183, 184, 185, 186, 187, 188, 189, 190, 191,192, 193, 194, 195, 197, 198, 199: n = A,T,C or G
aattccgttgctgtcgggacagtgtaggtctaggagacattaatactcacatccactaaacatcaaggtacagttattttgagtgccactaagaggtgaatgatgtttccagagaccataacatgaacccacttggtctgtaggttaggggtggcctctctgtggtggggggangggatgnnnnnnnnnnnnnnntnnng

SEQ ID NO: 7071 - DNA, 300 bp, Homo sapiens
  misc_feature 25, 35: n = A,T,C or G
tttttctactccttctttttgcagnttcccatttnattcgaattccgttgctgtcgaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcatagagg

SEQ ID NO: 7072 - DNA, 300 bp, Homo sapiens
aattccgttgctgtcgggcaggggaggggcttccaggattcacaggggcagatgggagccagcagtgggcagctgggagctgcgactcattcaaagagagggagttagtgcagggtaccgagatcaggaagaggagtggtgcagaggtgggaggtgatgagactcaagactacagagagaagaaagggccggcagcccagatcccagccccacccctcctgccctgcattcaggcagagcacagagggataaagagggaggtgggttgggggacaaggcagagatgcatatacctgggac

SEQ ID NO: 7073 - DNA, 300 bp, Homo sapiens
aattccgttgctgtcggtaagttatatctcttaactggattctatagttttatctcgagcaacttggaaaagctaagacatcctccacccacactggtatctacgcgcctggaagctgcaccttctctcattgctgtgctctgctttaaggaaaacctgatatgacagaatcaagactattaaaagataaatgaggggaaatcttcatttaagaaagttgccttgctccccaagagtgcctttaattgctattcccctaggcatctgggtgcatatcattaatgaaatcattaacctttg

SEQ ID NO: 7074 - DNA, 300 bp, Homo sapiens
aattccgttgctgtcggtagaattctgattggcatgggaagtgttttccttggtttgaaattgggcattggcaccaattcttcagtaccaattctaggaggaacaatggctgttagccatttcccccacatatctgagcttcagcattttaaataagcaacaagtgggtatggtttatttttggaaccagcgtgaaggcagctgacacaactcatctgggttgcctggtgcttgcaggggcccaaatgcataacagaaattctttgtgcttcatatagatgaatttgaacagttccacct

SEQ ID NO: 7075 - DNA, 300 bp, Homo sapiens
aattccgttgctgtcgcttttaaagtcaaaggggtgtacactctgtgatgttattcgtaatatcataggaaggggttattcctaatatcacatgggttatcctaggaagaggttactcctaatatcacactcctaatatcacagcctgtgatagcattcggaatatccaaaagggatggtacttttaatgtcacatggggtgcacaccctttgataatattcgtaagatcctagggacatatgacttcaaatatcacattgggtgtacacacatggtgtacacattgtgtgtgaacacct

SEQ ID NO: 7076 - DNA, 300 bp, Homo sapiens
aattccgttgctgtcggtgtgactgcctgccctcctctgcctcagtggcctgactcagtggccaagggacctatccatctctgaggtgagagctttcctgtcttgactggtctccaagacaaggtgaacagggacctcacctctacctccttcttagggggcgagaacagtactgccccagtcaagaggagcacgggggaatggggggtccccacccagtttcaagaccgactccgcctccctaggagtatggatgtagaaagatatgtgaccccacaatagcaatgggcaaccctggac

SEQ ID NO: 7077 - DNA, 300 bp, Homo sapiens
aattccgttgctgtcggtcacggtactttgcccaaagtcaccccgatgtcaagcgttagagcaagaatttgaaccccagagcttaactcttaaccattttgctaactggctgtctctccaggcccccatcaccctttccatcaccctcccctgccccaggggcatcctatcaaatggcagttcccccctcgcttgcctcagcatctccaatttagagcttcatggatctcctcctgttgaagtcatgggatggatttcccatctcagaaactgcacaagaaacaaccttggagttttgaa

SEQ ID NO: 7078 - DNA, 300 bp, Homo sapiens
  misc_feature 291: n = A,T,C or G
aattccgttgctgtcgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctncggactcgg

SEQ ID NO: 7079 - DNA, 300 bp, Homo sapiens
ctggccctcacctcccgccgtagctggctgtgacgcccgccatgggcacactggggcagtgcagtgagaagacgaggatgcccagcaggctgacaacggtgcagaacaggcagaacttgatgaccgcggagccccggagcctgagcttgttcacaaagaagccgcccaggaaggtgccgccaccacccgctggcaccaccagcctctcaccagagcagactgtcggcctcacatcacccccacctgcaggagggcggctctttcctctcggccacacctagagcctggttccgatgaacg

SEQ ID NO: 7080 - DNA, 300 bp, Homo sapiens
cccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagct

SEQ ID NO: 7081 - DNA, 296 bp, Homo sapiens
  misc_feature 251, 262: n = A,T,C or G
aattccgttgctgtcggacatcacagcccctatgaagaaagtagccacaatctcaaataacaaaagggaatgttctaaaactttttcttccttaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggtangtatttatagncctaacaagtccagtaattttttataaatcttca

SEQ ID NO: 7082 - DNA, 300 bp, Homo sapiens
aattccgttgctgtcgaggtgcaggtgttagtgcaggaccggaagggtgaggtgtcctaggcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatgg

SEQ ID NO: 7083 - DNA, 300 bp, Homo sapiens
aattccgttgctgtcggctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaa

SEQ ID NO: 7084 - DNA, 258 bp, Homo sapiens
  misc_feature 94, 96, 101, 105, 110, 114, 123, 125, 128, 130, 132, 141,142, 146, 155, 164, 165, 166, 167, 169, 171, 174, 183, 185,190, 195, 198, 200, 204, 206, 212, 213, 214, 219, 221, 224,229, 235, 236, 240, 241, 242, 244, 247, 250, 257: n = A,T,C or G
cgacacgctgctggcgctgcaccagcacggccactcggggcccttcgagagcaagtttaagaaggagccggccttgactgcagttgcaagaacngnaaggnaaangaagnactntccaaaatnanagngngnaatacttcnnaganttcttgtgngttattttnnnnananacnttcatattnanttttnttttnatntntatntnttattnnnatttnanagnaatanttattnngatnnntnttntanttcattnt

SEQ ID NO: 7085 - DNA, 300 bp, Homo sapiens
aattccgttgctgtcgggaggacttgaactcctcactaacatgtagaattgggctatttcccactcgaaagtactgacctccagctttcctaaaatcccaccgcacatgggctagcaattctgagatgaaagcggaagctgtcattcccaccagtgtctcaggcgccagggcagcctcctcagggacgtccctgcctcctcattgcactccacaaccacagcagagcatccacagtcgtaattaggcaattcttcttaaaaaatgttatgtaattagcacaccatagaattccccatttt

SEQ ID NO: 7086 - DNA, 298 bp, Homo sapiens
  misc_feature 214, 216, 221, 224, 234, 236, 241, 247, 251, 256, 257, 260,261, 263, 264, 273, 283, 285, 287, 288, 289, 290: n = A,T,C or G
aattccgttgctgtcggataaccaaaacagtatatgtaggtagaaaagagaagagtgtaaggtcttagctctggaggactggtgatatttaaagcttagggtgataaggaataggaatagagagtgagaacgaggggccaggaaatgtaggaaagctaacaaagtatgttattctaggaatgaaagagaaagtgtatcatggaggatgctgatngnctgcntcncacgtttgtngnctagnctcatngctntaatnnatnnanntcttgattntgtcatttcntnannnnctacctct

SEQ ID NO: 7087 - DNA, 300 bp, Homo sapiens
aattccgttgctgtcgctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggt

SEQ ID NO: 7088 - DNA, 300 bp, Homo sapiens
aattccgttgctgtcggtttcttaacatttctagttgtctgcaaccatccctgtcttacattacattattaagttagttctattacaagactaatgaatgacagaatagagcaaacatggactttggagtcagacagacatgagtcagataagagttcaaacccactgactgccgtaaacttgggcaagagatttaaccctgtcagggcctcagtgtactcattagtaaaggtaataataagtctgtaggaaataatacctacatacttacatttgacatatatttaatgctccagctta

SEQ ID NO: 7089 - DNA, 271 bp, Homo sapiens
  misc_feature 196, 198, 201, 207, 208, 210, 212, 217, 226, 229, 230, 231,232, 235, 240, 241, 242, 244, 245, 247, 250, 254, 258, 260,261, 264: n = A,T,C or G
aattccgttgctgtcggagtttttgctattatattttatcagatgctaacatatccctaacttctggctgattctttgctttaatcctttttatctatcagtcaccaaatacttaattgattccttttgctgggaaaaaagccaaaaaaaaaaaccaaactgcccacaaggaacttaaaatcatttatggggattngnatncagttnntngncccangggcgcggnatnnnngcnccccnnnanntnccngggnttangnngtncccacgg

SEQ ID NO: 7090 - DNA, 300 bp, Homo sapiens
aattccgttgctgtcggtgatttgtttctattaaaaataattttcaagtggtttcttgtactttagtatgaagacattgagtaaatataagaagcataggaacagtatttagagaaatcagtaaccttttgtttaccctattttgaatcctaaaagaaaaagttcagttatcatggccaggcgcgatagttcaggcctgtaatcctagcgctttgggaggccaaggcagacagatgacctcgtgattggcccacctcagcctcccaaagtgctggtattacagatgtgagccaccgcacc

SEQ ID NO: 7091 - DNA, 300 bp, Homo sapiens
aattccgttgctgtcgatatatttggcttctataaaaattaaaaacccagggataagaagaaggggagagaattggaaagcccctggttagctttaagggcctctcagtgcagcagaacacatgctggctctattcataactttgctctctggatcaatattctgaaagttggtacattcttttcatttgtgtctttcacagagggcagtaaaatttagctctaattatatttagggcatctggattctagtcagcattttctggctccgttttagaacctaaagtctgcggcttattcc

SEQ ID NO: 7092 - DNA, 300 bp, Homo sapiens
aatccgttgctgtcgaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggg

SEQ ID NO: 7093 - DNA, 300 bp, Homo sapiens
  misc_feature 288: n = A,T,C or G
ctagatttctgggaaaacgtgactcgggttcctctagagaagcagtggcagatgagagtacaaaggcaatggggagctggaggaaggccttaagcaggggcggcggcatggtaaggtttgtaggaggactggctgcagcagaggcagggagaccagtgtggagtctgctcagcagcccactgggaaggtggtgatcgccgtggtgatgagcagttcttggtagctgcatgtgaggagggtgacaggtcaggaactctagctcaggaaaccctgtggatggtggagggnaagatcagtctg

SEQ ID NO: 7094 - DNA, 300 bp, Homo sapiens
aattccgttgctgtcgcaattgaaaaacacagaactgtacggaatttaaaagtggaaatatggcatctatcttccttgcattccacgcaggtgtcatccagccacaccctcctctctgcagctctctctgcaagcacttaacacctggcatgcaccttccagacctttcttgtataaacatgcatgcatcgttttgttgttttctaacaggatcactatatgtgccattctaccacttggtttttttaattcaacaaaatgccatgagtatcctttagtctttttatggacagccctagt

SEQ ID NO: 7095 - DNA, 300 bp, Homo sapiens
aattccgttgctgtcggcggagatggtcaccagaattaaaggctgggagaatactgaagagctcaagtctattgagaacttagaagaggccattagttctggccgagagaaaagcattcaggatttttacaaagttttggtaaatcccagtgagcgcaaagctagactgcagtagatcgagaagtgaatagaaagtgacaaacacagacggagtgaaaacaactctttcagtaagttcagtggtggaggaaagatagcttaaagaggaggtaatagtagagtcagaaccttcaacctggg

SEQ ID NO: 7096 - DNA, 300 bp, Homo sapiens
  misc_feature 280: n = A,T,C or G
aattccgttgctgtcggattttctccctagagtgactttgggtctgtcacaggacttgctgctttcccaagtataaaagaacaactgtattttagaaggggctggttaaaacaccaggaaagtactggttaaatataatctttgtactttagactgtgttcttatcacatatcagcctgataagaggcaacagtttcaaaaaagtatttcacttttgtatttctaggtggaacagacaagttcttcatgttgttggggtaggggcagtggagggtcaagntcattatcaaacttttagat

SEQ ID NO: 7097 - DNA, 300 bp, Homo sapiens
aattccgttgctgtcggagaaaccaaacaggtaaaagcaagtggtgaagccacatggattaatgagatgatagaaagtacaaaatcactatgtaagtcagattaaaaagccagcttgcactctctgctttcatctttttgaagcaataactattacataaatcagtgaatacagtatttctacagtatttgaaacggtgttcacacccagcaattccacttctagacatatatccaagagaatggaaaacatgtgcacacaggcacttgtacatgaatatttatggaagcattattcaca

SEQ ID NO: 7098 - DNA, 300 bp, Homo sapiens
aattccgttgctgtcgggtttcgccatgttggccaggctggtctcaaactcctggcctcaggtgatccggccgctttggcctcccaaagtgctgggattataggcatgaaccaccacacctggccaaaagcaggtctttatttttaatgtccaatttatctgcttaattttgtctaaaaagatgatcttaatgcatacattagatgataatttcctctttgttccacttcatttcaacataattttttcccatatagtgtcttttaacttttttaaagaggggatatttgaatgagacta

SEQ ID NO: 7099 - DNA, 300 bp, Homo sapiens
aattccgttgctgtcgccaaagtgctgggatgacaggtgtgagccattgcgtccggctggaatttcttatggttcgtttccttaggttaaagattcagaagtaggatttttgaattaaagaaactaaatactgtctatggcgcttgatacatcttgccaggcagttatcagacagggttgtactggtttgcgccaccccagaacgtgtgcaaggcctgtttgtggaccctccttggcctggctgtctaggtcatccacctgcgtgtgctcacagagcatatggatttttccctgcggtgc

SEQ ID NO: 7100 - DNA, 234 bp, Homo sapiens
  misc_feature 226: n = A,T,C or G
caacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggnagctactg

SEQ ID NO: 7101 - DNA, 300 bp, Homo sapiens
aattccgttgctgtcggccaggtactattagaaataagacaaaaatctctgcctccaaagagctcccagagctcttgggagtaagggtttggagtggggcagacaaaagtacacaaaccattggaccacctgagccaggggctgtgatagaggcctggcgatagtgggcttggcaggaagcacttgtggccatttgggaaaggggcacattgctgtaagatgctgaatggccaatgcctggaataaggagggtgtgcctgtggcaaaggaatatcccaggtgctagggtccagcccagaa

SEQ ID NO: 7102 - DNA, 300 bp, Homo sapiens
  misc_feature 123, 125, 127, 135, 139, 143, 144, 153, 161, 166, 168, 169,175, 194, 201, 210, 213, 214, 216, 219, 264: n = A,T,C or G
aattccgttgctgtcgatgaatagtactcaaagtgtttttgttgcactgttactctgaatatggactctctatatctggtatggcgtgactgcgcataacttctgtaatgtatttcagttatntntntttccttntatngccnncttatgatnatgacacnctccncnnggatgnagatatatggaaccatatnttataanaacccctgnccnntnttncttctgaccttcagttcactttgtcgcccttggagaaagctgttnttctttaactaaaaataaccaaaatgctaaaaaaaa

SEQ ID NO: 7103 - DNA, 300 bp, Homo sapiens
aattccgttgctgtcggataaataagatactgatgttgtagatttctttttgcaaagattatttctttaccaaatttagcttgtgacttatcttgcagttataagacattcctaacatgtgactgttaaagtcttggagatggtagtatggtttctttattacttttcattatttctcatgcaacaaaatagagcagagtttattttaaaatgtgaaaagttacactaatgaaattcattttattagtgttgaaaataaggaagtaattagagcatttctataataaataagtaaccatc

SEQ ID NO: 7104 - DNA, 300 bp, Homo sapiens
aattccgttgctgtcggcaggggtcattccacattaccagagcttgttccagagaggcagtgggaggctccacaggcaggcttggagggtgcttggccctaatactaaatgttggacttcatggcattaacgaaggggaatcactggagccttttagtatgaagctaatctttttgtccatcacaggcaacttcttgcctacactcttttacaatatggcatttatgacatagccaagagcgaagacacgttgaacactgacttaatgctttgagtaggtggagagttgaatgactcaag

SEQ ID NO: 7105 - DNA, 300 bp, Homo sapiens
aattccgttgctgtcgcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttac

SEQ ID NO: 7106 - DNA, 300 bp, Homo sapiens
ccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcacaaaatcaaagagatggcagagcatgaagactttttgcttgccctacagatgaatgaaga

SEQ ID NO: 7107 - DNA, 300 bp, Homo sapiens
aattccgttgctgtcgcggaaatgtccgaaggcagcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgctt

SEQ ID NO: 7108 - DNA, 300 bp, Homo sapiens
aattccgttgctgtcgcccagagactggctcccagtgagctaagcccagccgcgacccttggatgtgccagctgatttaatactcatgataaacccagtaggtcagtgccagtattatgagagaagtgaggcacagaatgtcacatccacctccccaaagtcaacagctaggagtgacagagccaggattctgccaggcaggttggcctcagaggccacacttcttatcccaataataaaagtgaacaagaacaggatgaagttagagtgagagagcgagagtggtaacactcatgcaat

SEQ ID NO: 7109 - DNA, 300 bp, Homo sapiens
aattccgttgctgtcggtttcatcttctttgcccatgtacttcactcagtccataatgctcacctctgcctctgaaactgcccatcccctaagacccagctcctttgtcacctccagtgagaagcctccgctgcttttctttcctcctcttggtcccctgcagcactttctttgaacctctgttttggcacttaccatgttgtttggtgagggctctgtttacttgtctgtttctttcactgggctgatctcctgtagacaggggactttgcagaacatgtggtggagaggagtcggtgg

SEQ ID NO: 7110 - DNA, 298 bp, Homo sapiens
  misc_feature 242, 249, 270, 286, 291: n = A,T,C or G
aattccgttgctgtcgagcgattagacctgtcataaagtttgaaaaattgattctggaggcgaagtgaatagattgagcttgacagtgttgtcctaaagattctaagggaaaattctgtagtttaatttgaaatcccttgattattcattagctttccagatggcttttgttgatgttttacatattaatgcctgtattgtgttattggtgtactcttaatgtgcacataggtaatgagcanagaatanatacattggtaagtgtcccanattaatgggatattancgtanttgcgaa

SEQ ID NO: 7111 - DNA, 278 bp, Homo sapiens
  misc_feature 181, 185, 189, 190, 204, 205, 208, 213, 214, 215, 219, 221,225, 230, 231, 233, 237, 239, 240, 244, 250, 251, 252, 258,259, 263, 266, 267, 269: n = A,T,C or G
aattccgttgctgtcggcttactactaatcaaagaaacagattaaaactacagtaagatgtcattatttaatttattgattgtggaaagacaaaagtaccagatgataccagatgatgacaaggggtaaacaggtactttattttatttatttcttaaacattatctttttttttttttgnaaanaccnngccccccgggtggnnggncgggnnnccantntaanttggnngnaccntnncccncggggnnnaagggnntttnccnncntaacccccc

SEQ ID NO: 7112 - DNA, 260 bp, Homo sapiens
  misc_feature 143, 150, 152, 154, 155, 159, 163, 164, 166, 168, 175, 179,187, 192, 197, 199, 202, 204, 205, 206, 207, 210, 212, 213,214, 216, 217, 220, 222, 230, 233, 235, 237, 238, 241, 242,243, 244, 245, 246, 247, 248, 249, 250, 252, 255, 258: n = A,T,C or G
  misc_feature 259: n = A,T,C or G
aattccgttgctgtcgggaaagtcgtggagggtaagcacagtcctgaagacacaggatggaaaccccaggatgagaagggagcagggagagttccagaaagggggatgaaataggagtattaaaaagctgcgttggccagttnttcatgnancnnttgntgcnntnangcgtatnttanccttgctntatantcttntnctntnnnnttncnnntnntantntaactttnttntntnnacnnnnnnnnnntncgntgnnt

SEQ ID NO: 7113 - DNA, 300 bp, Homo sapiens
aattccgttgctgtcggcaagcatcaccgctgtctaattccagagcatttctgtcaccccaaaaagaaactccatgcctattagcagtcactcccagttcttcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgca

SEQ ID NO: 7114 - DNA, 300 bp, Homo sapiens
aattccgttgctgtcgctagttataaaagtgtaatttctactgtgtcataatcagccatgcagctggagacttgccctctttgtacagcaaagttgtgaaaaaaagtatttgcactacatttatttaaacattaggaaaaaaagccaacccatgcttttctttgccgagatgtagggctgtattattggctagtgagaagcctgggaacactaggactttgtgtgggctgattgcaggtatcagatccgggattatacaggtactgttggaagtatcttggggattttcctgataagaac

SEQ ID NO: 7115 - DNA, 300 bp, Homo sapiens
aattccgttgctgtcggaactctttaagaaagctcaacagggaaatgaagctctagatgaaatctgttttaaagtttgggcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgat

SEQ ID NO: 7116 - DNA, 300 bp, Homo sapiens
aattccgttgctgtcgggaatacaaatagatgacctgttatctgtgtcagcttttgatactatctgcccttcacgtctttattcttagattgtcatctgtgggtggaaaaccttaagtttctacccatagaaataagcccaccatatttcagaaaacatggtgggtcataggaaagcactcagatgggacaacctagttggatttggtacaaaatgagccagatgtgggaaaaggcaaattaatatgattatgaaaagtaagaatgatggagctgggtgcggtggctcagcctcccgaga

SEQ ID NO: 7117 - DNA, 300 bp, Homo sapiens
aattccgttgctgtcgattgattttagtggtattggagaaaattaaataattaggaggcatgtttaaagacatctacaaagcatcctaattaatttggagtgagtctttgggatggcttcccaattctgagtcccaagattaaacaggccaatcttgggccgggcaaagtggctcatgcttgtaatcccagcacgtcgggaggccaaggtgggtggatcacctgaggtcaggagtttgagaccagcctgaccaacatggtgaaaccccatttctacaaaaattacaaaaaaatttagcct

SEQ ID NO: 7118 - DNA, 300 bp, Homo sapiens
aattccgttgctgtcggtggggtttcaatgagagaatgcgtgtaaaatgcttcgtacaattactgccacttatgtctcaataactgctggctttggtcattaataaaagagggaaacaacattatcagatctgtatttagaaggagttctggcagatagggacagatttgtgccaaaatctcaagacagtatttttcaagattacactgaaacttagtacatatttatattatcatacatttttaaaaaggtcaagatgattatagttgaaaccacatagttctttttttaagaaagtca

SEQ ID NO: 7119 - DNA, 300 bp, Homo sapiens
aattccgttgctgtcggatttgtactattaagagagaaaaaatatgccacacaactaaacataggttgaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctacc

SEQ ID NO: 7120 - DNA, 300 bp, Homo sapiens
aattccgttgctgtcgataactttttactcatatcattgtccctatattagtattaagagcattttgtataaaacttcatgtgaggatctcaattctttataattctcttcaaagcaaggaagtatatatagagagacctttattttttagtaattttttcaaatggtttgggagatcttattctagcccaattctattctggcacttaattattttctggtggcttgtaatatggtaaatactggattccagattgcattcctatttccttgggaggtgaggatactcccatttgtaca

SEQ ID NO: 7121 - DNA, 300 bp, Homo sapiens
cgcgcgttccagagctgggcgctgcagctgcactgccgatcgccgtgtttggtcgatagaatccccagtgtgcccagagagtgcgacccctcgcccggcccggcgagccccgggcgtgaaccgaactgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagata

SEQ ID NO: 7122 - DNA, 300 bp, Homo sapiens
aattccgttgctgtcggctaccacccgctcctggtgtctgagttttagcagagcttttgccctctgaggaccccaccccagcctgcagatatgaaggtggcggtgctgttccctgggagggacccctgaatagatggacgggagggactctggagccaagggtctccgcaacgtcactgtgtggatgggaaccctgagatccagggttggccagggatgaccacaggcatcattcacaccactccttcaccgcaggcctgcctggggtcagtggcgccagccccacccagcccctggact

SEQ ID NO: 7123 - DNA, 300 bp, Homo sapiens
aattccgttgctgtcggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcacca

SEQ ID NO: 7124 - DNA, 300 bp, Homo sapiens
aattccgttgctgtcggttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctcta

SEQ ID NO: 7125 - DNA, 257 bp, Homo sapiens
  misc_feature 132, 139, 140, 143, 147, 150, 155, 165, 166, 167, 168, 169,171, 175, 176, 179, 180, 181, 182, 185, 187, 188, 191, 195,196, 199, 200, 202, 203, 204, 206, 208, 210, 212, 213, 216,218, 219, 226, 227, 228, 230, 239, 240, 241, 245, 251: n = A,T,C or G
  misc_feature 254: n = A,T,C or G
aattccgttgctgtcgataatttctctgaaagtctttagtgacaaagccaaatatagtattcttgatttttacgtcttcactctttacccccttttatactggtttcttctcagattaacatcttatattcnatgaagnngangganatntattnctggctttannnnntntacnnccnnnngancnnctntgtnnccnntnnnanancncnngtncnnatttttnnntnctgctgaannnccanttctcnctntta

SEQ ID NO: 7126 - DNA, 300 bp, Homo sapiens
ataatactaaaatatttactttagtgtttcttgacattcaaaaatgtcattggatttgtaattcaggtatcatatttgaaaatgagtcttttaaaagataacataaatatctttattttgacacacaaggtcaagactagaaatgtgttcctgggtactttcagcctacttggtttaatcaaattgcttttgaatatgaatgtcctaatttaattctttggacctttgaggggaggacactatcacttctacatatgtagagaagtaaaagtctcatagatccatcttgctttaaaaata

SEQ ID NO: 7127 - DNA, 300 bp, Homo sapiens
aattccgttgctgtcgattcctctatatttaattttgaaaacctaaaagaaggattgtgcatcttgagagaaagttgagcaaattgtgatctaccggaatgttaatttgtgctgcttcttgtgcacgatagcagcagtagtatctctcttggaaataaacatcccatattatgatgtctatgaatataggtttccttttcttccttccctccctccttcccccacctttctcttttttttttctctctcagcttctcttttcctccttccctcttcccttcctctttctttacttttttt

SEQ ID NO: 7128 - DNA, 300 bp, Homo sapiens
aattccgttgctgtcggcggggaggacgtaccttgtgagatgcgagccggccaacagcttgcaagcatgctccgctggacccgagcctggaggctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaag

SEQ ID NO: 7129 - DNA, 300 bp, Homo sapiens
aattccggtgctgtcgacaagaacaaggttgatagcgtttttcttgacacatgcactttaagctccaagaggaggcctcgagtcagctcacaacaacatgccaacagtgactctgtgcttactttgtgccaggcagtctctagccacttcacatctcacttaagtttttattagagtcttaatgaagtgtgctctctccgacctatgcccattactcaaatgctgcgggtctatttctttacttataaaatgaggttaataatgcctaaaaaaggattgtcatgagaattaaacaagtta

SEQ ID NO: 7130 - DNA, 300 bp, Homo sapiens
aattccgttgctgtcggtttaaatgttttcttcgggattaaaaaaacctgaatgtattctgggaaaatgttaaatggatgcaacactataagattttccacagaaatatgttattcaccgtgaagcacaatgggaaggctccattagcactttagatggtatcataactttggaaaaaccatttcaccatgcgagtatttacaaaaactgaagctgtccctgtcaggttttgacagagcttagctatataggtagtaagtgacgcagtgccaaaaccagtcttaaattacctatgttgtc

SEQ ID NO: 7131 - DNA, 274 bp, Homo sapiens
aattccgttgctgtcggggaccacatcctgcttcatgtcagtgactcctgccccttggtcttcagtgtttttctcttccccaggagggactttgatcatgcaggatagaattctcccatcgcacacctgggggcaagttttagatgagcttctttcctccatttcacctggtggtctgaggacacacagagggtgggggtgagcaggcagtgtgggtgggaggggctacctcccccagaccccttacaaactctgtacctctcggtgcgcggca

SEQ ID NO: 7132 - DNA, 300 bp, Homo sapiens
  misc_feature 19, 24: n = A,T,C or G
ttgcgtctgagacttctantccgntcttgttctttttgcaggatcccatcgatccttcctgaccttccacctccaccaggtgccgacacttccctgaccccagtaacctcttctcttgggtgggtgaatgccacctgctgatgtctgatttattcatcggttttcttgtctgtagtctgtcccccttggggacagggactcgttgctcatgttcacccggcaggctggacacttcgtggagggctccaaagccggcagatcccggggccgcctctgtctctcccaggccctgcgtgttgc

SEQ ID NO: 7133 - DNA, 300 bp, Homo sapiens
  misc_feature 207: n = A,T,C or G
aattccgttgctgtcgaaatattgttttaaaatgcatcagcctatgctatacaatctgaatgttattttaacttataggtttttttaatatatatatttaactataaggacagtttagggaacaagttacctaccacatttcactttagtgtacctatttacagaaagattaaactgccacctgcgggcacattcccataaatgtgnactttactttaaaaagaacatgccacgattttgtctttctgtggactcaacattcacttcgattaaaaatagcaatttgaccaagttggactt

SEQ ID NO: 7134 - DNA, 300 bp, Homo sapiens
aattccgttgctgtcgcttctccacctcatctcagcttagggactggttagatcgtccaggtgacaacacatgcttctgaacctacacatctgccttgctttctgaaaacaattttctaatgtttttgaaaaagtaatgtatgcatgtattgtatccatcagaatcctagaaggacacagagaatgctcttaaactggggagtttctggagagtttaataaagatgtgggctgggcgcggtggctcacacctataatcccagcactttgggaggccgaggcgggcagatcacttgagctc

SEQ ID NO: 7135 - DNA, 300 bp, Homo sapiens
gtgaaaaactatcactttcaacaatgaagaatagtaatatgtcataatggagattatgaagttcagaaaggggtaaatgcagttttggggagggctgagactaagagagaacacaataagacaggcaattaagactgacatgaaagatcagtcacattgataggatatactcttgatatgatataatgagaatggcagtttaccgctgtggttttcttttcccaaaacccataaccacagcctaaccatgagaaagacatcaaacaaatcccaatttgggacattctgtagaatacctaa

SEQ ID NO: 7136 - DNA, 300 bp, Homo sapiens
aattccgttgctgtcgggatcctcatgcggaagaatttgaagacaaagagtggacatttgtcatagaaaatgtaagctaatggcaaattccttcacctttcacattttcaactttatatatgcattattaaggtacattggcattttggtggtaggaaaaatgttgccttaagaaaattaaatagtgatttgtagcttttagaatgtttttaatgaaatgatagccagtaacaaaattatttgtaagaaatgcttttattaacactgtaagtcttcaatactaaattgtatgtatgtttg

SEQ ID NO: 7137 - DNA, 300 bp, Homo sapiens
aattccgttgctgtcggtggttttaaacaccacttttgagatgctaaaaattcagtcccaatgggacttgttcaaattcagttcagtttctggtcatcaaaaaatcaatctgttttaagatctagtcttacccatgaaaactttaataatggtagatatctaaaacatgagttaattacccccaaaatgtttcagttttttcattgttatattgccaaaaaccattctggctatatatatttttaaaagaagccatttgcatgtcctttagtggtagaatagaaatttggttaaaattgg

SEQ ID NO: 7138 - DNA, 295 bp, Homo sapiens
  misc_feature 129, 131, 140, 145, 152, 155, 160, 167, 173, 193, 197, 200,201, 205, 223, 227, 252: n = A,T,C or G
aattccgttgctgtcgggagcacttggggtccaagaatggcaagatcagcaatcagcaagaagatcaccattgctgactggacaactgcaataaatttgacgggtgtttctcttaaaaaaaaaaaaaantnctgggacanaccanggacccntgngttcncatgtcntggggnccagtttttaactggggaanccgnggnnggcntggaaaaggaggcagtgnccgngactgtgctgttttccgaagccccntgcctgctgcctgttcctcggtcctcggggctggactggcgtt

SEQ ID NO: 7139 - DNA, 300 bp, Homo sapiens
aattccgttgctgtcgctcaaaggcactctcatgacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatccccc

SEQ ID NO: 7140 - DNA, 300 bp, Homo sapiens
aattccgttgctgtcggtaggaaaaatcccattctaataaggttatatttatgtagctctgcaaataaacatctagcaaatgtaaaaagtattttctttgccttaaaaatgattaaaattatttgaactcctgaggagtgttatatgaataaaattagtaagttatttggaggaaagttattttttaaaaagacaactggtaaaacagtacaggagaaaggccagcttcctcaagtgaggacagttgtttagaattgactgaggagcggccgggtgcggaggctcacatctgtaatccca

SEQ ID NO: 7141 - DNA, 300 bp, Homo sapiens
aattccgttgctgttcggtctgcgtacgcctggagtccttccccgctgtgctcagcatggaccctatcgggagcttctgcgggaagctgcggtctctggccagcacgctggactgcgagacggcccagctgcagcgagcgctggacggagaggaaatctattgtttagattatccaatgagaattttatatgaccttcattcctaagttcagactctaaaggatgatgttaatattcttcttgataaagcaagattggaaaatcaagaaggcattgatttcatacaggcaacaaaagtac

SEQ ID NO: 7142 - DNA, 300 bp, Homo sapiens
aattccgttgctgtcggaccaacttgatgatggcatctcttttaagatgcccaagtctgcgcacttttattcctttattcggcccctagcaccccctccccaccccaaagaaggtcagttgcatgcgtgtggggatgtagctcaaaaaagaaataagatggagtggaaaggaaagaaaggaagaagcaggaattcaaggtgggtgggctgagcttggggccacctagcccacctgctccaatcaagggctggaacaaacctgaggccacttggagaggcagggctgggcagggacagggg

SEQ ID NO: 7143 - DNA, 300 bp, Homo sapiens
ctacttgttctttttgcaggatcccatcgacagatcctggtaccccctgcccgcgccgatataatgctttttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattc

SEQ ID NO: 7144 - DNA, 300 bp, Homo sapiens
aattccgttgctgtcgggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgccccacgccttcccacccagcgtcttccccaggttcccccactacctctccctcagatccaggccctcagctc

SEQ ID NO: 7145 - DNA, 300 bp, Homo sapiens
aacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctat

SEQ ID NO: 7146 - DNA, 300 bp, Homo sapiens
aattccgttgctgtcgggacatttagtctgcctgggtttgaatcctagcattgtcatttacaggtaagtatcatcttgggcaatgcatctataaattgggataataataccaaattggaacaataatgataggttagttgtaatgattaaatcaaataatgagagtaaactcctggagtagtgactgacacatggcatgtaataaacatttttctttctacgaggtattgatatttattaacctcttaaaagcaatttggactccctttgtctcttattgtcctgtgacagttaccatga

SEQ ID NO: 7147 - DNA, 300 bp, Homo sapiens
aattccgttgctgtcgaaatggaggtagggacagatctttcaagggaggtgtgggttgtttatatttttaacacaattgtaggcttctcttttgagaaggtagatttccgtgttgtatctgatcatggcagtgtctcagaaggctgagtgtctgccttaagtttacgttgtcaacgcagtttagagggtaaacatgtctgtggacatagttgaactgggtttttgaagatgtaattaccaatttacatcatggccaaattggaattattatttttaattggaattattatttttaaaaaa

SEQ ID NO: 7148 - DNA, 300 bp, Homo sapiens
aattccgttgctgtcggtgcagtggcacatacttgtagtccaagcttcagaaggctcaagtgggaggatcgcttacacccaggagattgaggctgcaatgagctgtgatagtgccactgcactcagcctgaatgacagagggacaccctgtctcaaaaaaaaagtcagtttctcacttggactaactactttttaactgttaatagctggtggctgccatactggacagcccaagactagaggctcaatgggctgttctccactctctgtccaagggaaccttcctttatgtgctttttg

SEQ ID NO: 7149 - DNA, 300 bp, Homo sapiens
aattactagtgggggagtaaggggacaggccattgggcatactggagcagcatttactcagtcattgagaaaaggatggaacattcaataaagggtgctggacacatttgtgctctaaaaattttgtgtttcacctattaatttatccctccccttagcccctggcaaacactgatctgtttactgtctccatagttttgcctttcccagaatgtcacacccttggaatcatacagcatgtaaccttttcagattggcttcttttacgtagtaatatgcatttaggattccttcatgcct

SEQ ID NO: 7150 - DNA, 300 bp, Homo sapiens
aattccgttgctgtcgcacaaatactcactgttgaaatacactggagaaacatatatataaagtgttaagaataaaatatgacccatatgcacaaaacccaggcagatcattcttcaagtgtaaaggccatggataggtgctcgcaagcatgaaagcccttggggaagatggtgtccaactttgggttggggcccgtgggaggctgaacaaaacctagccattggggagctgggtgaagtcagagacaggaggactggtaggaaggagagaacctctttccttatagaatgactaagcaa

SEQ ID NO: 7151 - DNA, 300 bp, Homo sapiens
aattccgttgctgtcgagattttactattatacactaaattttcaataatgattagaatctgaaaaaatttgaaattgtgaataaaatgcttttaaacattttatcaagcattacaaaagtagagaatagtataatgaagcaacaccaagcttcaaccattgatacatggccagtcttttttaatctatacccatccctcttcagtcatcccccttccaccctaaattattttgaggcaatatctctaaaagatgaggacatttttaaaaacaaatataattttattatcataaataaaa

SEQ ID NO: 7152 - DNA, 300 bp, Homo sapiens
aattccgttgctgtcgggggctgttggcataatcacaagcctgtctgtcttcgagaagggacagtggagtcatccaggggctgccacatgacaggcacggtgggcaccgatccacagtgggccccgccttccccagctcgcctccctgcctgtgctggcctggccttgcctgctggcaccattggagtaggagggggtggaacacagggggcccatcctgatcaggccccatctcaaggttggcactcctgcccatcacccttagaaggatcttttcccatggcttgacttccttcattt

SEQ ID NO: 7153 - DNA, 300 bp, Homo sapiens
aattccgttgctgtcgggatgctgaaggcctctttcccccctgctgttgtgtggggatcaaatcagttgggggcctagacttaaaagggagcacgtggttaggaaatctcattagctgacaatttaactccactctaatgctcgtccaaagagcccggacaaagacttcctctcctttccctttgcagttctttctccttgctcctctcttctcccctccccctctaaaccagaaaggaaaagcagcgttgggcctgtctccttccccccagattcctgcagttctagtgtgccgactga

SEQ ID NO: 7154 - DNA, 300 bp, Homo sapiens
aattccgttgctgtcgctcaattgttgttttaagattgaccttacctgtctgttgaaattgaccatagcacatccttgatccttgagattttactattcaacctgtttttctgtttttgttgttgttcttttcactccctgaaattaggagagtagtacatatttgtgtcttccacagacgatacagactttaagatgtagaagctcatggttttatagatgaagggatttggaactcttcccttcagggtcaatgtacttgattgtctgaattaaacttggttcccaagttaataactc

SEQ ID NO: 7155 - DNA, 300 bp, Homo sapiens
aattccgttgctgtcgaaaaaaaatttaatttgaacacttctgttttgtgcagttttctctgttatattttactttttaaaaagaaaaagcggctgagccaccacgcccagcctcacatttttattttaaaaacctctccaggctgggcgcggtggctcacgcctataatcccagctgttagggaggcagaggtgggaggacagctcgagcccaggagttccagatcttctgcctgggcaatataatatagcatgaccctgttctaaaaaaaaaaatctctgaaaaagatgattcaaaaa

SEQ ID NO: 7156 - DNA, 300 bp, Homo sapiens
aattccgttgctgtcgtgaaaaaggaaaaatcacaataataaccacaaaagtacaaaagatcattacagactattatgaacttccatatacttacaaactagaaaagctagaggaaatggatacatttctggaaagcaagaaggaatagaaatcctaaacaggccaataatgagtagtgatattgaatcagtgatttaaaaaatcttccaataagaaaaagccaggaccgaatggagtcatagccaaatcctaccaaacatataagggagaactaataccaatcctcctgaaattgtgcc

SEQ ID NO: 7157 - DNA, 300 bp, Homo sapiens
aattccgttgctgtcggatagggcaatccaagagacatagtcctaaccccagagtagcatgtaatcccttcttagcatccctctttgaaaactgaagatagtacagctgagggaactgaacaggttcccaggatcatagagaatcattaagctgaagcaaacaaacaaacaaacaaaaggcaaactagaagaaaagcaggattcaatgggttctgcaccttcttagtctatcattgctttgtaaacattctccggttttacattactacagaatatggtccagatataaagttctactgt

SEQ ID NO: 7158 - DNA, 285 bp, Homo sapiens
  misc_feature 140, 143, 146, 147, 151, 154, 166, 177, 178, 180, 183, 184,190, 193, 195, 196, 197, 200, 203, 204, 205, 206, 207, 208,210, 217, 219, 221, 222, 227, 228, 235, 241, 243, 244, 251,252, 257, 263, 264, 269, 270, 271, 273, 274, 275: n = A,T,C or G
aattccgttgctgtcgcacaactggccagtggcagggctaggatttgaaagcagttcttttccattttggttgttggtgactcaaagtcattctgaactttcagaattcaggtggttgatggggtggggtgggggtgtcngtntgnntctnttnttcctctttaantgctcttatcnncntannccatgnatnannnctnctnnnnnngntcatctntncnntctanngatttcntttgtnannaactttnnatcgnttgtcnnatgannntnnntgttctatct

SEQ ID NO: 7159 - DNA, 300 bp, Homo sapiens
ctctccccccctccctctctcttcctttcctctctcttgttgtaactgggagtggaggcccactggctggggagacattaggtggtggggcccagcccgacctccaggttcttccttctccctagctgttgctttggtctggccactcccagcccccttgtccccttggaagcttgccctgccctcatcttgcccatgccttctactgccaggagacttgcacccatttcaaccctagggcgggggcaagtggggcaaggatggaccagcagaaggggggtaaggctctgttcacttccc

SEQ ID NO: 7160 - DNA, 290 bp, Homo sapiens
  misc_feature 99, 102, 104, 111, 119, 139, 144, 155, 157, 173, 177, 178,181, 183, 184, 186, 192, 196, 198, 199, 200, 205, 207, 208,210, 214, 218, 219, 228, 230, 233, 235, 238, 239, 241, 245,248, 251, 258, 259, 261, 266, 267, 268, 269, 271, 278: n = A,T,C or G
  misc_feature 281: n = A,T,C or G
aattccgttgctgtcggaccttacctgtattccctgtgctatcctgtgggaaggtaggaatgggctaagtatgatgaatgtataggttagggatctttnggntntaaatcncagacaanctaattcaaactggcttaanatganaaggatttatngnttcatgtaactagaangatnntancnngngtttgnttcngnnnaagantnngncccncggnngaattaccntntananccnnangganttnggntttaaanntngtgtnnnntnagggttntgnattaaaaaa

SEQ ID NO: 7161 - DNA, 300 bp, Homo sapiens
  misc_feature 265, 266, 267, 288, 289: n = A,T,C or G
aattccgttgctgtcggagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctgctcgcagaggacgtgtgctatcgtctgagagaggccacgcagaatagctctcagttcatgaagcacaccaaacgccggaagctgacggttgaggacttnnncagggccctcagatggagcanngagtaggctgt

SEQ ID NO: 7162 - DNA, 300 bp, Homo sapiens
aattccgttgctgtcgccaaggtggatgtagaagcgggctccggcgtcccactctcccttccatatgggcttagcgtctgggtcactgagaacgacgtctgaatagggccctgggtccttgccatggatgaatgtggttcccgcatccgccggcgggtgtctctccccaaaaggaaccgtccaagcttggggtgtatttttggcgctcccaccgtggtcgagctcgagcccggagatgaggggaaagaggaggaggaaatggtggctgatgaacaggagctggaaaaccgcgggcgtact

SEQ ID NO: 7163 - DNA, 300 bp, Homo sapiens
aattccgttgctgtcgcagaacacctaggtcctagcataagccccacctcctccaggaagccacctgactccctccagcaacagctctgcactttacctttgtattctctcctttctgactatggtcagcagacttctaagacggcccccaaagattgccacctggtattcatgtgctcgtgttatctcctcctcttgaatgagctggacctagtgacttctagtgcacagaaatgtggtgaaagtgatgggataacaatttccagattaagttataatagacactgtgggctgggtgcg

SEQ ID NO: 7164 - DNA, 300 bp, Homo sapiens
aattccgttgctgtcggatcttggagagtttctcccaggctccttgtgaactgctccgctggtgtgggagaagccaaaggggcaaagctcaagacggtgtctccctggtgagggcagttacattggcataagttgtctagcataacttgtcatgccgaccccttttcaagatagcagcttcattcactgataatgtggcagtgttccccttcatcagtggaagacatgggatgtgttctaggggaatttatagtacttgacatgtatgagggaaattctactatcaattaagtacaagag

SEQ ID NO: 7165 - DNA, 300 bp, Homo sapiens
aattccgttgctgtcgggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaa

SEQ ID NO: 7166 - DNA, 300 bp, Homo sapiens
aattccgttgctgtcgcacatacacacacatacacacaacacatacacacacacatacacacacatacacatacatacacacatacacacacacatacacatacacacatatacacgctcacagacacatgagtgaatctacatggaatatcccttgaataaaatgcaagcaattggttatagtgattgccactggggcagggaactaggaacttgatagtaaggcttggcagaaaaattactccttatcatacacagtttttggtattgtttgagatttttaaaataccatacatgtat

SEQ ID NO: 7167 - DNA, 300 bp, Homo sapiens
acttcgattgaattcccggagctgtcgatttagttatttgaagagaggttctcatttcctagaaaagatatgagaaacccaaatagaaaattattagagatctttgagacactctatttacattctggacctaatctttttgaattgtcttatatgagtgagtactttgtggcagaagatctagacattttaataaaacattttaatacaaatatctagatattttagatacatatttaagtatctaaaattcagacagccaggggtggtggccgtatacctgtattcctagctacttgg

SEQ ID NO: 7168 - DNA, 300 bp, Homo sapiens
aattccgttgctgtcgccgttgctgtcggaacattcttccctggaaccagtgctccacatctttcttttcctctgagagctgcagctggcagggacctccctctgctgctcctccagcaagccacagagcataccctcacgtgacaagagtgtggtaggttttctccccacttctcacacacgcctggtggttgtggttccatctgccttgttggcttgcccggggggattcaacacttgactttcaaatcaaagaatgctaatgcttagcacttgctgttgagcatgctctaactttta

SEQ ID NO: 7169 - DNA, 252 bp, Homo sapiens
  misc_feature 229, 234, 241, 242, 249: n = A,T,C or G
aattccgttgctgtcgagagaagcttttagtcaaaagtcagtttattaaatgtttagaatacctaaacaggaagaaaattctattgttttttataacaaagtggaagatttcaagaaaggacaactcactgtacacttgagaataatacctacagaggttcatactgaagagtagtctcaataatgtaaagaatttgacaagcatgatgctattgaaatagttctgtcngaagnggtgttnnttcttcnttt

SEQ ID NO: 7170 - DNA, 300 bp, Homo sapiens
aattccgttgctgtcggctcttgctgctgctcaggtagaacatctgggaggtcccttgctgaccactggaagaagatgagctcgagctattggagtgagacgagcagcagcagctgtggaacccagcagctcccagaggtgctgcagtgccagccccagcattaccactgctaccatcagtcaagccaagcccagcagcctccagaaaaaaatgtagtgtatgagcgagtgaggacctacagtgggcccatgaacaaggtggtgcaggccttggaccccttcaactcacgggaagtgctc

SEQ ID NO: 7171 - DNA, 300 bp, Homo sapiens
aattccgttgctgtcggaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagagatatgaagagctaattaaagaagagaagacaactaataatgagttgagtgccatatcaagaaaaattgacacatgggctttgggtaattcagaaacagagaaagctttcagagcaatctc

SEQ ID NO: 7172 - DNA, 291 bp, Homo sapiens
aattccgttgctgtcgaaggatataagtttataatactgctatttttgattcccttgcctaagaaaaattaggtatgaataaaaatttaatttgaactgatatcacttcccttaccattcacatgttaactaattgataagataaaaatgtgttgtagtagaatagactagatcgtatgcctttttagatgaaaattatagaagatatttagtcatagtaactacaaaggcaaaataaatatcacagcaaaaccagtaataggaatgcttgcagactttttttttttttgg

SEQ ID NO: 7173 - DNA, 300 bp, Homo sapiens
aattccgttgctgtcgggaagataggcaatgccatttttttcaaatgtacacatacacacacacaataagaaatgtatttaataatacattttaccttattttcaaggcttatcatgacagtaactattctttaaataataagaaggaggaaggtaatattatgaattactaccaccaacagaaaataatgctgttgattacccattaaaatggtacagtagtatcattgtctgttggacatatagatcagtttttttcttctaaatgctatttcaactctctattattaacatatatat

SEQ ID NO: 7174 - DNA, 300 bp, Homo sapiens
aatgggtattgtcttagtctgtttgtgctactgtaaaaaatatctgagaccgggtaatttataaagagtaaatttctttttcacagttctggaggatgggaggttcacgatcaagatgctgccaggttcggtgtctggtcagggccaggcttctgcttccaggatggcaccttgcatgctgtctgttcacatggtggaagggcaaaaagggggcctagcttgctttctgcaggcctcttataagagcactcaaccatttgtgatggcagagcctgtgtggcctcatcaccttccaaagcc

SEQ ID NO: 7175 - DNA, 300 bp, Homo sapiens
aattccgttgctgtcggaaactccctggagcgacgcagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccga

SEQ ID NO: 7176 - DNA, 300 bp, Homo sapiens
aattccgttgctgtcggtaaacttaaggcataaacttctgaaaattagttatgtataattttattcaatctaatgtacattttaaatatggataattgatagttttttctacaaataaaaatgtactatatatttagttacataaatactgttcattaactttgaattgagaaaatggataccatttgcattgctattgtggctttaattctgtgggttcagatggctattaaaattacatcttttaattgtgtttatttttaaagttgaaaagtgatcattatcctcctgttcattttg

SEQ ID NO: 7177 - DNA, 300 bp, Homo sapiens
aattccgttgctgtcgggattattatgctactttattaatgtttattgttattctttagaaagtaaattattgtaggcttataaaattaagaaatctagtttttagtaacataatcatttgctccctttaaattttaaatcactctaaatctgaacataatagctaacttaaaataagtagcatttggattacattatttttgcagataactgattatctgtgtgaaatgatttagtattataaatgttttgtgataaagtttatggtaaagattgattatagttacctcatttttatct

SEQ ID NO: 7178 - DNA, 300 bp, Homo sapiens
aattccgttgctgtcgctggaattttctttactcctgtatctgatgtctgggctgcgatgactcaaaggctgatttcagctgagactgtagaccacgtgcctacttgtggcctccccttttgccttgggtttctcacagaatgtggctggttctggagaatgagacttccaatgaaatcaggtggaaatgacatctcgccgctttcagcatgctctattggttggaacagttatggacttagctagattcaaaggaagggaacaaagaccccctcctctcagagagtggggcataatgag

SEQ ID NO: 7179 - DNA, 300 bp, Homo sapiens
aattccgttgctgtcgggacaaaaccacagcaagctgtcaggtttctgagtgaactgcttacttttccataattgatagataatacagccatgtctttaagagaactcttacagagtttattattatatatggcaatattaatagagaaaaatatttcatgtgatttttagagaacttaagcatttgccttaaatgtttcttaagccctagaaatatagctataatttcattatttatcctctcttaaacagatgattccctggtaaagagaagaaaaacactgtataaagtacagctgt

SEQ ID NO: 7180 - DNA, 300 bp, Homo sapiens
aattccgttgctgtcggaaagaaatcatttaaatgtactatatgtggcacaggctgtatcgagacctaccaaatcactagacatcgaaacattcatctttggtgaaaccacacaaatggattgtgtgtgccaaggccaacaagtcaaaatatgttgaacctaatgatatgatgtgtataaagggtgcaaggacacgtggaaatgatctgtaatattcgggttattaaaaatgtaattggctgggcgcagtggctcacacctgtaatcctagcactttgggaggttgaggcaggtggatca

SEQ ID NO: 7181 - DNA, 293 bp, Homo sapiens
  misc_feature 278: n = A,T,C or G
aattccgttgctgtcgggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcanaagactgactggaag

SEQ ID NO: 7182 - DNA, 300 bp, Homo sapiens
aattccgttgctgtcggccaactgttttatgtacttgagaagcaggtgttaacttcctcagttacaaatgagaaaacccaggcttaaggggattgactcatttgccaatagtcatgcagttaattgcgtttgttttgccacacagccactgttctttacatagcaatttggtatatagagaaaatatggtgccatggtcaagggcacgactttgaggatggactgtctggcttcaaaaatctgatttccatcccttacttattatgtaactttggccaaattactgaatgtcttaaccct

SEQ ID NO: 7183 - DNA, 300 bp, Homo sapiens
aattccgttgctgtcgcagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaa

SEQ ID NO: 7184 - DNA, 282 bp, Homo sapiens
  misc_feature 96, 98, 100, 103, 107, 110, 118, 121, 123, 126, 127, 128,134, 137, 142, 146, 150, 158, 163, 165, 170, 175, 176, 177,180, 184, 190, 196, 197, 204, 210, 214, 225, 227, 228, 233,245, 250, 261, 270: n = A,T,C or G
aattccgttgctgtcggctggagtaaaccgtgatcgagttactgcactccagcctgggtgacaagagtgagactctgtctccaaaaaaaaaaaaancngnatngccnggntttactcnggncncannntgcagnccnagttntgcngctntgctgttngttcngntttcntccannnatnggcntcaccntttggnnccaaaanggctgntgcnttccaggcttnanntccanactcaaacccanaaaanctgcccatccntacctgggngaccctttgtag

SEQ ID NO: 7185 - DNA, 300 bp, Homo sapiens
aattccgttgctgtcgcttctctgcccctaaatttggatatccatttcgagatttagaatccaaacgcttttattggagaaccattaaattaagaataaagttctaaatcagtttctccaattagttctattatattctatagtatatatactgtaattttgcatccccacgtgtgtcctaataaagatacctatagctgaacagtttgtagcatggaataaataaaaaccaaatgattcgtgttataaaatactaacatcctttgtaaaaacacaaaaatcttgtacctatatatatat

SEQ ID NO: 7186 - DNA, 300 bp, Homo sapiens
aattccgttgctgtcgcttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccaggcttcacctacgaaatatgaagagcaaaagctgattttgcttacttgctaaactgttgggaaagctctgtagagcatggttccagtgaggccaagattgaaatttgatactaaaaaggc

SEQ ID NO: 7187 - DNA, 300 bp, Homo sapiens
aattccgttgctgtcggatgcctgctctaagctgcaggagcagaagaagtcactcaccaaggagaaggaggagctggagctgctgaaggaggatgtgcaggactacagcgaggacttgcaggagatcaagaaggaactttcaaagactggtgaagaaaaatacgtggaagaatctaaagccagcaagagattgacaaaaagggtgcagcaaatgatcgggcagatcgatggcttgatctcgcagctggagatggaccagcaggctggcaagctggccccggccaacggcatgcccacggg

SEQ ID NO: 7188 - DNA, 300 bp, Homo sapiens
aattccgttgctgtcgggtttttaagaagtcgttaaacttaatatttactagatatttgtttttggatggcatctaatatattaatagcccagaaaaaaggcgccactaatgaatatgtcttggattacatagtgacatatattagcttttcgtccacatttgataacattgctaatattttctttttttttactgaagctctttgaatttaaagttttctctcatttaaatttattaattaaaaacatacctttactctgttccctttagcatttcaacctgatgttaaaagatgtgta

SEQ ID NO: 7189 - DNA, 300 bp, Homo sapiens
aattccgttgctgtcgcattaaagtcactaagaataaccattttttccagtatatatggaatatacaccaaaaaagaccttatcctggaccatagatacattttaacaaattcccaaagatttatattttcagagactgttttctgaataataataataaattagaagtaaaaaaaattggaaaattcctaattatttggaacttaaacatcatgtttgtaaatatccctgagtgaaaataggtctaacaaaaaatctactaaaataagtctaataaataaatttagaacatattttgaa

SEQ ID NO: 7190 - DNA, 300 bp, Homo sapiens
ggcacaatttgaagcccaacctcagattctaagtcccatatattagtttttggtaacaatcatcagtaaaggagaatattttaaaaacctataaaggagtccttgacaatactatctaaatctttttatacattgataattttataatataccctgtatatattaggtaaatgcctgtaggtctccaaagacctagaattgagaatcagagggtaaacatccaaacaaatcccctagatgtgggaaaataaggaagttatcttatttcgtcgtcatttatattgaggtgaatcatgatgg

SEQ ID NO: 7191 - DNA, 300 bp, Homo sapiens
aattccgttgctgtcgcacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccag

SEQ ID NO: 7192 - DNA, 300 bp, Homo sapiens
aattccgttgctgtcgggaaattcagttacataaataaattacccaagttacatacctatatactgatagatttcaagtcatgttccagaaatcatgtttctaactagtatgctacactgcctgtctcgaaaaaaaaaaaatagtaactatgctctacactacgcagtccacttactatcccagttccttattctcctttgctgcaaaatgtcttgaaagagttatttatgcctgctgtctgcagttaagccatttcagggggatggagggcgcacaaccttatttgaagtgggttgagg

SEQ ID NO: 7193 - DNA, 300 bp, Homo sapiens
aattccgttgctgtcgcacagtttaaaaaagaaattagtttctcctaatgtgcacattaaaagtagtaaaaatggccaattttgttaaatcttgatccttgagtacatttttgtgtgtgtgcattttttccttgtaaaaataatccatgggagggcatggtggctcatgcctgtaatcccagcactttgggaggccgagggaggtgggtggatcacctgaggtcaggagtttgagaccagcctagccaacatggtggaaccccgtctctactaaaaatacaaaaattagccggcagtggt

SEQ ID NO: 7194 - DNA, 270 bp, Homo sapiens
  misc_feature 134, 137, 139, 140, 143, 145, 146, 157, 158, 162, 164, 165,167, 169, 173, 175, 179, 180, 183, 184, 187, 189, 192, 197,198, 203, 206, 213, 214, 217, 218, 220, 221, 228, 233, 240,241, 242, 245, 247, 248, 250, 253, 257, 258, 260, 262: n = A,T,C or G
  misc_feature 264, 265, 267, 269: n = A,T,C or G
aattccgttgctgtcgcttcccttccttccccttccatctttctttccacatgtcctttccttattggctcttttacctcctacttttctcactccctatcagggatattttggggggggatggtaaagggaanccncnncanannccctggaactnngttntnncngnctcncncaannggnnccntngcnacccnngtacntcnaccctannaanncnntacagtngaaancaacccnnnccncnnanccncccnncncncnncnana

SEQ ID NO: 7195 - DNA, 300 bp, Homo sapiens
aattccgttgctgtcgctcattccaaggctatgcatatggatgtcacattcccatgtcaatcatctctggaaggtattattcgcccagttttttaagcatgggaaactgaggcttagagtcttaaaaaataagtagctggcagtctctcagcaaataatgatggtgctgcactacagacccagatctgtgactccaaagtcagcctttgttcttttcttcttgttacttttaattggaaaaaaatttaaattgcaaaaagttgtagagtgataaaaacaaaaatccacgaatgctcttct

SEQ ID NO: 7196 - DNA, 300 bp, Homo sapiens
aattccgttgctgtcgcagaataagcctatcaaacataggtcaaatggttaaataaagaatgaaagcgtaaaagccatagaagaatttttctgttgtcttggagtagagagaccttcctaagtttgacacaaatcccagaagctataacataaaagactgatacatttgacaacatcaaaatgagatccacttcataagagtaacactgtaaacaaagtcaaaagatacatgataatctgagaaaaataatttggaaaaaatatgataaaaggagttaattttcttaatatactaagagc

SEQ ID NO: 7197 - DNA, 300 bp, Homo sapiens
aattccgttgctgtcgtcctcctttatgagaaaagaatagaccctgatagatgaagctataaagttctataacatatcttcattgaacgtgtgattttttttaaagtataaatagcatattcatatttttgcaaattgcttgttttcagtacgcagcgttttgagagctgtgtatgttaatgcagttgactcccgaacagtgggtttgaattgctcaggcccacttatacctagcttttattcaaccaaacacataatggccagcatatatgaggagctaacttttcatatgtgtggtct

SEQ ID NO: 7198 - DNA, 300 bp, Homo sapiens
aattccgttgctgtcgcacaaaacaaacaaaaacccctgattcctggagatcctgattccataggtgtggtctctgcaagcaattttatctggaattgaagaccactggtgttctgggacaaaggttttgaaacagacaggggtccaaattctggctctaccacttattgaggtgtataaatttgaggaagttactaaatgctctgaacttcagtttctcctggaaaatgggataattatgtctagcttgtgtggctattgttaggatgaaatgagatacaagtatgtagagtacctagc

SEQ ID NO: 7199 - DNA, 300 bp, Homo sapiens
aattccgttgctgtcgcttgtttgcaatagctatcttcccactctcacttgaacccactccaaccaggcctccccatctccatgaacctgatcttgtcagagtcacaaggacctccacgatctccacattgctaaccaaatggtcaatgttcagtcttcatcttattcagctcatcagcagtccataacttcctcttccttgatgcatattcttcacctagcttccaaaacctatacttctcctggcttttctctgccttaccagtaatgccttactggtctcgttgctggctccttctc

SEQ ID NO: 7200 - DNA, 282 bp, Homo sapiens
  misc_feature 150, 153, 156, 157, 160, 162, 164, 168, 175, 183, 184, 186,191, 193, 194, 199, 202, 208, 213, 214, 215, 220, 221, 222,223, 225, 236, 249, 251, 260, 264, 266, 268: n = A,T,C or G
aattccgttgctgtcgcataccagctcctaagccctattaagaagaggcctggtcctctaatgccttggttccatttcagttgttctttgagagacagaatgatgtactaaccattcgtgattattagagatagggatgggtcagggctnagntanntgncngncttnttgtggntgggtggnncnttgancnnatctnagngctgtntgtgnnngtacnnnntnggtggttaatntatccatgctgcnanggctgtcanggantngntaagcgaatttcta

SEQ ID NO: 7201 - DNA, 300 bp, Homo sapiens
aattccgttgctgtcgctcagggcacagcaggcagtgtgttagccttggtctcccttgccctccaagtcccacagggcaatactggcaggcccaggaaagtgttacacactgcaggtttgcatgacggctaaggaaccacaatcttagggagatactatctctgtcttctaaggccatttgctgtacaaaaatccttgaaatacctgggcacagtggcacacctataatcctagcactttgggaggctgaggcaggcggatcacctgaggttgggagttccagaccagcctgaccaacat

SEQ ID NO: 7202 - DNA, 300 bp, Homo sapiens
cctaacttcgaaacccgctacttgttctttttgcaggatcccatcgactgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaaca

SEQ ID NO: 7203 - DNA, 300 bp, Homo sapiens
aattccgttgctgtcggtcgattcatatctgtaggattaataaatgggtctgttatatccgttttactgatggtgaaatgaaggaccagagagagtaagtggcctttccaaggcttcacagcaagcttgtggaagaaaccaccaagaaaccagctcttgagacttccagcatttgttccagttcctctgcaagggaaacccccattccctgctctctctttttcccctcctcacaggcagcaggtatgtgcacagacaggcctggagctgggctagggtaggagtcccctgtgaggctcc

SEQ ID NO: 7204 - DNA, 300 bp, Homo sapiens
aattccgttgctgtcggaaggagagttaaaagtcaataagcattacaaaaattgccattttgacatcagcaaatcaaatttctctatctaattaaaggaaaaccctttctcttatttctcttctcttttcctcttctcttcctcctcctctatttcccctctccttatccccttgtctccctcttctgctctttctctacttcctctttctctttttttgatatatttctatcatatattttcagaaataattcagtggcatctcatgtagatgtaccactttcttattgcaactcagag

SEQ ID NO: 7205 - DNA, 300 bp, Homo sapiens
aattccgttgctgtcgcaacccttactcctccggccaaggagccaatgtgagcattcagctggcagctaagaatgtgtatcccaataaacagggcagacctacagacccactggacccactagagatggacttgggccacagtgccttccatgacttcagtaaacagaggggtgtggtgatcttgtcaaagtcctggcgtcaatgtcagtgtccggctacacaccatgttcccgtcctcgaaaagcctctctgtacccctctatgttggtgacacaaccctggcaaatggccacagactc

SEQ ID NO: 7206 - DNA, 292 bp, Homo sapiens
aattccgttgctgtcgggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccacacccagcattggcctagggggcggattgt

SEQ ID NO: 7207 - DNA, 300 bp, Homo sapiens
aattccgttgctgtcgctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggc

SEQ ID NO: 7208 - DNA, 300 bp, Homo sapiens
aattccgttgctgtcgtacaaaaaaaattttaattagctgggtgtggtggcacatgcctatggtcccagctacttgggaggctgaggtgggaggatcactggagcccgaaagttcaagcccacagtgatccatgattgcaccactgccctccaggcctgggcaacagagtgagaccctgtctctaaaaaagaagaaatgattgaaatcatatttttcaggctggacttccaataaagtagcccttaaaaggatcattcttaaaatattagccatatacaatggtcataataaatgtatgt

SEQ ID NO: 7209 - DNA, 300 bp, Homo sapiens
aattccgttgctgtcgcatatcagtaaagaagtaaacaagaataaaatacatgctaaaatgtcatacactctttttgttctaacattttgatttggcagagccaatacccacctatactacaactttcttatgccagcacaagaatgctatattcaaaatgctttccatgtattaccttcttttatcctcagatatccttggcagatagtagggcagatattaccctcatcttattgaagaatattctgggtataaggaagtcaaataacttgtcaacagttacaaggttatgaggtaaa

SEQ ID NO: 7210 - DNA, 300 bp, Homo sapiens
accattgaatacccgctacttgttctttttgcaggatcccatcgatctgaaagcgggcagcactgtcattcatagccaaacagtcctattgagaggtcttggactatcaggccagctgtcagaccactccatgcactgggtgtgctctgttggtcagggactgggagggaaactacctctccttcccttaaccaagcatgaattatgtttgttagcaaacctctctgggaatatatgtcaagccacattcctcctggggcagctgcaacttcagggcttcacaataaacagttctgaaaa

SEQ ID NO: 7211 - DNA, 300 bp, Homo sapiens
ggcacacatggcccaccatgcagggccacacaaagaagcaccggggttggtcaggaggccgagggaacctttattgtcgattccaagagaaagaatgggtgagagagagtagtatgaataagtgtagtgggatctgggagggaggagctgtccctaattatctggtgtctgcccggggattggttaagtcaggggacagggaccaggacatgagagcctgaaggacctggttggggtgtgagctttaggtgcgttgctttgcatacgaaaggtacctggaagatgagttgtttgtcctct

SEQ ID NO: 7212 - DNA, 291 bp, Homo sapiens
  misc_feature 135, 137, 140, 152, 162, 163, 179, 183, 185, 186, 193, 197,199, 200, 201, 210, 212, 214, 217, 224, 226, 228, 233, 243,247, 249, 256, 263, 265, 268, 271, 273, 275, 278, 279, 282,283: n = A,T,C or G
catgccgatgctgtccatgggtgccaagcaagccagttttttggttccctgagggaaactgaccctcctctcttgtggcaccatccagcctcagggtcttggagacttgagtaagaatgtgagtggagggggagngnatntcttaagggggnggaccccaannccctgaggaacatgcncttngnnaagaagncaanannnagggccttnanangangcatgcnanantgccnaggtcatgantgcnantgccgangtatgangnacnttntnanacnntgnnaggaggca

SEQ ID NO: 7213 - DNA, 300 bp, Homo sapiens
actctagaatacaagctacttgttctttttgcaggatcccatcgacagatcctggtaccccctgcccgcgccgatataatgctttttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggaccctatccccccaactgc

SEQ ID NO: 7214 - DNA, 300 bp, Homo sapiens
aattccgttgctgtcggtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgctttt

SEQ ID NO: 7215 - DNA, 297 bp, Homo sapiens
  misc_feature 210, 211, 212, 213, 216, 218, 221, 222, 227, 231, 233, 237,239, 241, 245, 246, 247, 251, 252, 254, 255, 257, 258, 261,262, 263, 268, 271, 273, 281, 286, 288: n = A,T,C or G
aattccgttgctgtcgttcaattgttctctcttcaagttcactgattctttttttcttcctgtctagatctgcctttcagtctctctagtggatttttaatttcatttattgtacttttcggcttcagaatttttgtgtgtatccttttaggttttcattctctgtgtttctcttactctgttgctttttttttttttttttgggggccnnnnttngnggnnaaggnggancnaaancncngggnnnaaannanncnnccnnnccaanttncnggggaacngggancngaattggcc

SEQ ID NO: 7216 - DNA, 300 bp, Homo sapiens
aattccgttgctgtcgccttgaatatgtaaaaatacctatcatatcagtgtaatactatcttaacaatcctaaaaaccaggaaagaaaagcaaaatacagccaaatcaatgtcaagaattcttgggaaggctgggtgcagtggctcctgcctgtattctcagcattctgggattacacttgagtccaggagtttgagaccagcgtgggcaacatggcaaaacctcatctctacaaaaggtacaagaaattagcaggcatggcggcgcgtgcctgtagttccagctatttgggaggctgag

SEQ ID NO: 7217 - DNA, 300 bp, Homo sapiens
gtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagag

SEQ ID NO: 7218 - DNA, 300 bp, Homo sapiens
aattccgttgctgtcggccactgcgcacggcctggggaggttttatttcttgacaaaggtatttgatactcgtgcagtccctggagggtctcactggagagacaacatttaggctgagatctgattaacaggaggcagctgcagtgcagaggtcaaaagggagggtgttccaggcagagaaaacagcctgtgcaaaggccctgaggcagaaacaaactctacttgaggtcagcctggttagaaagcccaactcaaaatagaaagtattacatgataaggtctgaggcaggctggacccag

SEQ ID NO: 7219 - DNA, 283 bp, Homo sapiens
  misc_feature 226, 235, 236, 237, 246, 264: n = A,T,C or G
aattccgttgctgtcgatgtgttccctacaaatctcatgttgaaacgtaatccccagtgttgttggaggtgaggcctggtgggaggtgattggctcatgggggcatatccctcataaatggcttggcgctgtccttgcaataatgagtgcattttcactctatgagttcacatggatttggctgcttaaaagtgtatggatttcttacctgctgttgctctcaccntgcgatgcnnntagttcccnctttgccttctgccttgngtaaaaactccttgaggcc

SEQ ID NO: 7220 - DNA, 300 bp, Homo sapiens
  misc_feature 235, 236, 240, 241, 242, 244, 250, 259, 260, 266, 269, 270,272, 273, 274, 275, 277, 280, 284: n = A,T,C or G
gtgagagaattgtggagaccaactaccacatatcattgagcccagctcttgggagcattgagatgtatagctcagggttacacagttccaaatcttgggaaggggcttttcagacagactgtttgctttctgctgagataaggaatgcatcactctgccagagtatgactttttacaatgagacatatgcagctttatttaataatctgcatatgtctcattgtaaaagatgaanntgannnanacatgnaacaaacanngaaaanatnngnnnncngtnaaangttaacggaccatgca

SEQ ID NO: 7221 - DNA, 300 bp, Homo sapiens
  misc_feature 186, 193, 194, 196, 211, 220, 221, 226, 248, 249, 251, 253,254, 256, 257, 258, 263, 271, 272, 277, 291: n = A,T,C or G
aattccgttgctgtcgctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaacngaagtcnngntggttaccgctgggngaatataannagcantttcagctgtgcggtaatggcnnantnngnnncttanctctgcgnngtctngctctagagatacnacttttgac

SEQ ID NO: 7222 - DNA, 300 bp, Homo sapiens
  misc_feature 71, 74, 81, 103, 120, 129, 148, 150, 158, 160, 161, 166,167, 171, 176, 178, 179, 182, 190, 200, 207, 218, 226, 254,262, 265: n = A,T,C or G
aagttgtggcaaaggaaactatacttttcatttttaaaaatgtaaatagaaaagtttttaacgggcatatnggncaaaagnatacgttttaacgatttttaangatcaaaatgtggcacngctggtacnttttatcttgctgactgcncncatatttntnnagcanncttnctgtncnnagnatgacttnaccggctctntaactangatatacttcngggggganaaagctgtgatactatagctaataaatncccactanagngacactgaagatttaaacacaagcattcataagat

SEQ ID NO: 7223 - DNA, 300 bp, Homo sapiens
aattccgttgctgtcgagcccaggtcccagcggaatgggcctctctgttcagtaggatccccctcctgctgagtggttcatggcatgtttctgttcaacgcttttccatctgtaggattcttattctgtatttatttgtttttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccaca

SEQ ID NO: 7224 - DNA, 300 bp, Homo sapiens
gccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtc

SEQ ID NO: 7225 - DNA, 261 bp, Homo sapiens
  misc_feature 136, 179, 196, 199, 200, 205, 209, 211, 214, 217, 220, 227,230, 244, 246, 247, 248, 252, 256, 258, 259, 260: n = A,T,C or G
aattccgttgctgtcgatgaaattcagtataaaattgaatagaagtaatgttaatggataatcttgtcttattcctggtctcagagaggaagtttttaaatatttaatatgacatacattgtttgattgggactantcagcaaaatcctttatcagatttattaagctccctttgtttnttaatttattatgttcnttnnatttntgantntgnatngantttatcncanatattctgttaatnannngttntttncnnna

SEQ ID NO: 7226 - DNA, 300 bp, Homo sapiens
aattccgttgctgtcgagaaatggaagaacgtgaaaaaagaaagataattgctgaagaaaagcacaaggaatgggttcagaaaaagaatgagcaaaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggaaaaagaaaaacaacagcaagctgaaatacaggagaaaaaggaaa

SEQ ID NO: 7227 - DNA, 256 bp, Homo sapiens
  misc_feature 114, 121, 132, 139, 140, 144, 146, 155, 156, 171, 172, 173,176, 178, 180, 182, 193, 201, 202, 207, 213, 221, 223, 228,233, 239, 246, 253, 255: n = A,T,C or G
aattccgttgctgtcgagctgcaccatcactgcgtatccctgtgactcctaccaggattataggaatggcaagtgtgtcagctgcgggacgtcacaaaaagagtcctgtcccgnttctggnctattatgatncagttgnnaagncngttcagccnnaagtgcctaatgagnnngcnancncncattaaatgcnttgcgctnnctgcncagctnagcaagcngntaacntgacntgccanctgtatnaatgaancng

SEQ ID NO: 7228 - DNA, 300 bp, Homo sapiens
aattccgttgctgtcgacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaaga

SEQ ID NO: 7229 - DNA, 265 bp, Homo sapiens
  misc_feature 103, 110, 122, 125, 131, 136, 145, 147, 150, 155, 156, 158,159, 160, 161, 162, 164, 166, 167, 170, 176, 179, 182, 183,191, 193, 199, 200, 201, 205, 212, 214, 216, 217, 222, 226,228, 229, 235, 237, 241, 242, 246, 247, 249, 253, 254: n = A,T,C or G
  misc_feature 255, 256, 257, 262: n = A,T,C or G
aattccgttgctgtcgcaaggtggtacctctatgaggctgcaagaaccacaacgtagatacagtttagatggtaatacccaagtcctttaaaatatttggaangcccaanaaggatggaatncanataatnctcanatagtgaananaancagtnnannnnntncnntantatatnttntgnnattctttntngcaacnnnttcnctctttncntnnatagnaaantnnctatangntttnngttnntnatannnnntaatnatt

SEQ ID NO: 7230 - DNA, 293 bp, Homo sapiens
  misc_feature 261, 265, 277, 279, 286: n = A,T,C or G
aattccgttgctgtcgctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggccttgctgctctcagtcaccgcttcagcttcagaccaagttcgacttcacctcctgccagggcgggcttttcgggtttttnatgnattttttctttnanggaattnatctggc

SEQ ID NO: 7231 - DNA, 300 bp, Homo sapiens
  misc_feature 41: n = A,T,C or G
ttgaaccccccaatagagctcttgtcttttgtttgaacccntgattcgaattccgttgctgtcgctagccacatcaccaaataagtgaacaaacaacagcgacaaatcctggagtagagagtatcgttatccagagctgcagcagtgtagtacctaaaatgttcagtgcagtaaaaatgagacatgcaaagaaataggaacatgtgattcatacacaggaaaaaagactagaaattaccttgataaggaccagatgttgatcttagtgaacaatgacttcaaagcagctattataagtat

SEQ ID NO: 7232 - DNA, 300 bp, Homo sapiens
aattccgttgctgtcgaaagaagtatgactgttagtacttctcaggacccatctttctcaggattaaaccaggtctgaaactgtctcctattccaacctcaatcccaaattcatgtgcttttcttttttattgttttattttgatgatttttgttttgttttaattctggagaatgtagatcttgctcaagcacctcttacgttggcattattcagacatacttggcaaacataacattactaagatatttctttgtggcttttgcttaaaacttataaagtttagaaaaaagctaaatg

SEQ ID NO: 7233 - DNA, 300 bp, Homo sapiens
aattccgttgctgtcggtttctccgtgttgcccaggctggtcttgaactcctgggctcaagcaatccgtccgctttggcctccgaaagtgctgggattttaaaggcgtaagccactgcacccggtaactttgggttcttgaattcccttcctcctcttcttcctcctcccctacactccattagagaaagggtcttgctttgttgcccaagctggagtgcggtggttgttcacaggcatgatgatcactgcagcctgggctccagtggtccgcatacctcagcctgccagtagcaatttg

SEQ ID NO: 7234 - DNA, 300 bp, Homo sapiens
aattccgttgctgtcggggaagtccaagattgaggggccagatctggcaagggcttccttgctgcatcatcacatggcagaaggcatcatatagcaagagagcaggcaggagatggatggcaatgggggccaaacgcgcttttataacaaacccactcccttcataaaggacagtccatttatgagggcagagcccccatgacctaaacatctcccattgggcccatctcccatcactgttgcattggagattaagtttccaatacatgaattttgggtgacacactcaaatgatagtat

SEQ ID NO: 7235 - DNA, 293 bp, Homo sapiens
  misc_feature 72, 76, 77, 84, 96, 102, 113, 121, 125, 137, 142, 156, 158,162, 164, 181, 209, 210, 218, 226, 264, 266, 272, 273, 275,286: n = A,T,C or G
aattccgttgctgtcgggaatgaagatgatgacgcctccttcaaaattaagactgtggcccaaaagaagggngaanngaatgancgcgagagaaanaaagcnagatgaagaanaagcgaanctgnggaagctgaaanaactnagacgagttagaancnggtnanaaggatcagagtaaacnaaaggaatctcaaaggaaatttgaagannaaactgtntaatccanagtgactgttgatactggagtaattcctgcctctgaananaaagcnnanactcccacagntgcacaa

SEQ ID NO: 7236 - DNA, 300 bp, Homo sapiens
aattccgttgctgtcggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatcttt

SEQ ID NO: 7237 - DNA, 291 bp, Homo sapiens
  misc_feature 239, 242, 245, 249, 259, 261, 270, 280, 283: n = A,T,C or G
aattccgttgctgtcggtggtggcgcgcacctgtagtcccagctacttgggagactgaggcaggagaatcgcttgaacccaggaggcagaggttgtggtgagcggaaatcatgccattgcactccagcctgggtgacagagcaagattctgtctcaaaataaatacatacatacatacatacatacattcatacatacatacaactttgttttttcttttctttctttttttttttttnaanggnaaangcaccaccantnaaaaaaccnttaccgaaanggnaaaaaaaa

SEQ ID NO: 7238 - DNA, 300 bp, Homo sapiens
aattccgttgctgtcgggcagtggtttcttagatgttgacaccaaaagcacacgtggcaaaagaaaaagcaaagtcaacaccatcaaagatgaaagtgttcgtgcttcagggaacactatcaagaaagtgaaaagacaacccaagaatgggatagtattttgcaaatcacatatctgttaagaatcttgtatctattctagctataggactcttacaacttaataaaagagaaaacccacctgggtgcactggctcacgcctgtaatcccagcactttgggaggccaggcggacggatca

SEQ ID NO: 7239 - DNA, 300 bp, Homo sapiens
aattccgttgctgtcggcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctcccactactcgagccacctgaagcggcacatgcagacacacagcg

SEQ ID NO: 7240 - DNA, 290 bp, Homo sapiens
  misc_feature 130, 143, 150, 155, 158, 159, 162, 163, 166, 167, 170, 178,182, 184, 186, 188, 189, 193, 196, 198, 207, 212, 215, 219,221, 223, 224, 225, 226, 233, 238, 240, 248, 250, 253, 255,263, 279, 282: n = A,T,C or G
aattccgttgctgtcgccagtgagtacctgcaaaaatgagttgtcacagaaattatgatcctctatttcctgaacctggaaatgatgttggtccaaagtgcgtgtgtgtatgtgtgagtgggtgcgtggnatacatgtgtacntatatgnataanacnnatnnacnntanatctaacntatnancncnncctnctncntccccttcncacgnacngccntntnnnncctcagnatccncntcagcctncnccntnatgcatcncatgcccgctcagttnttncctccctc

SEQ ID NO: 7241 - DNA, 296 bp, Homo sapiens
aattccgttgctgtcgattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaccaaaactgtattgtattttttttgctgtaattaactgtataatgtaaacctaattattttatcatggtttaaattttttgcatatttgcttaatcttatgctgctgattcttctaactgaatttgcagatt

SEQ ID NO: 7242 - DNA, 300 bp, Homo sapiens
aattccgttgctgtcggtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcaca

SEQ ID NO: 7243 - DNA, 300 bp, Homo sapiens
aattccgttgctgtcggggaagttaagacttataatcacccatagctttcaaacagaacacacatagcatctccaccttcattaccaccatcaccaccaccaccacctccatctccacctgcaaccccagcactaccaccatgaccaccaccaccatcactgccatcaccatcattaccatcacctccacctctaccttcaacatcaccatcacaatgaccaccaccatcaccaccagaaacactgaataaaataatgaaagtgcagccttaggctgggcacggtggctcacacctgtaa

SEQ ID NO: 7244 - DNA, 285 bp, Homo sapiens
  misc_feature 126, 143, 176, 178, 179, 191, 195, 202, 207, 208, 214, 219,223, 224, 225, 230, 234, 235, 239, 241, 242, 244, 245, 246,247, 250, 251, 254, 255, 257, 258, 262, 265, 266, 267, 270,273, 276: n = A,T,C or G
aattccgttgctgtcgatgttggggctggcaaaacgagtcggtgcccgtctgctcctggcctccacatcggaggtgtatggagatcctgaagtccaccctcaaagtgaggattactggggccacgngaatccaataggacctnggtcctgctacgatgaaggcaaacgtgttttanannccatgtgctatncctncttgaantttanngcgttnatttnctannnttttnttanntttnanntnnnnatnncanntnnactnatnnntgnagnatntgtctttat

SEQ ID NO: 7245 - DNA, 280 bp, Homo sapiens
  misc_feature 271: n = A,T,C or G
cggccgcaggaatttttccagtcaaaagcatattcgagggactaaaaggacatcaagagggatacttcagtcaaatgataatcagctatgaaaaaataccttcttacagaaaaagtaaatctcttactccacatcaaagaattcataatacagagaaatcctatgtttgtaaggaatgtgggaaggcttgcagtcatggctcaaaacttgttcaacatgagagaactcatacagctgaaaaacactttgaatgtaaagaatgtgggaaganttatttaag

SEQ ID NO: 7246 - DNA, 300 bp, Homo sapiens
aattccgttgctgtcgcaagttttcacaagaggccgggcatggtggctcacgcctgtaaccccagcactttggctattgtttttttgtttttttaatttcttgtagatacgaggttttgctgtgttgcccaggctagtctcgaactaactcttggcctcaagtgatcctcctgcctcgggctcctgaagtgctggatatacagtcgtgagccactgtacctggccagaactcctcttctagggggaagtcaaccacaatgtaggaagtcagattgtcccaagtccactatgctgtaagga

SEQ ID NO: 7247 - DNA, 300 bp, Homo sapiens
aattccgttgctgtcggcaggggcctccccggtcgccccagcaggcccaggcacataggtgcccagagatccctggcttctgatcgcccggaagactaagagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatgggcttagtgctt

SEQ ID NO: 7248 - DNA, 272 bp, Homo sapiens
  misc_feature 253, 258, 263: n = A,T,C or G
aattccgttgctgtcggagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatnattcnttcanctcattttt

SEQ ID NO: 7249 - DNA, 262 bp, Homo sapiens
  misc_feature 235, 237, 246, 247, 257: n = A,T,C or G
aattccgttgctgtcggctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagntngaagagcannctctgaaggntaccg

SEQ ID NO: 7250 - DNA, 272 bp, Homo sapiens
  misc_feature 199, 207, 212, 215, 218, 237, 249, 250, 251, 253, 255, 256,261, 263, 264: n = A,T,C or G
aattccgttgctgtcggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccnaggataanttgcngangtntatctatttttttgaaacntcttgaggctcnnngntnntaatntnnatattttt

SEQ ID NO: 7251 - DNA, 288 bp, Homo sapiens
  misc_feature 81, 82, 89, 91, 93, 101, 105, 107, 112, 123, 126, 130, 147,148, 150, 151, 165, 166, 175, 178, 180, 187, 188, 196, 197,201, 207, 209, 211, 213, 217, 220, 221, 222, 223, 230, 234,236, 238, 240, 241, 249, 260, 266, 268, 275: n = A,T,C or G
gctgcaataaacaagttaacaacaacaattgcattcattttatgtttcaggttcagggggaggtgtgggaggttaaccccnnccccccncnanccgccttncctncncaccnaccctaccacnccntccncctcctccccttctcgnncnnccccccctcctccnntattccccnccncntcccttnncccaatcnnccgnacttgncncncngccncannnnctcctcntccncncncnntcatctcntcacccccctncctctncnctaaccnccccctctccaat

SEQ ID NO: 7252 - DNA, 292 bp, Homo sapiens
  misc_feature 70, 72, 76, 80, 88, 92, 97, 98, 102, 106, 107, 110, 123,124, 127, 130, 142, 154, 163, 164, 170, 180, 184, 188, 194,201, 202, 208, 210, 217, 231, 244, 247, 256, 263, 267, 271,278: n = A,T,C or G
aattccgttgctgtcgtgcctccaagatggtgagtcttcttgcgtggtgagggtgggggttcgggtgcanantatnatanagtgaccntatnatacnntgangacnnccnagagactctcacnncancancagttccaggcnttcaaaccgaanacaatccannaaaagnggaacatacngaanaacnttctantataacnnaactantnactactnatagaaaatattcntgactaggtcccncanatccttctnacttccnatanaaanagagagntcttaacctttaaa

SEQ ID NO: 7253 - DNA, 262 bp, Homo sapiens
  misc_feature 120, 129, 130, 135, 141, 142, 145, 146, 148, 151, 153, 155,157, 158, 163, 168, 172, 173, 179, 180, 182, 186, 190, 194,197, 200, 201, 203, 205, 208, 210, 217, 218, 222, 227, 228,229, 232, 233, 235, 236, 244, 245, 249, 250, 251, 255: n = A,T,C or G
  misc_feature 256, 259: n = A,T,C or G
aattccgttgctgtcgggcgctttcaactgtactgctgcagctttaagtaccttaaagcttctcctgtgaacttcttagggaaatgttaggttcagaactaaagtgttttgggtgggtcntatttcttnnaattntctatnnatnncnctntnananntaaanttaanttannaatctnncngttnttanttanaanatnnantnttntnatctccnngtantatannnttnntnncatatgtnnatannntaanntancga

SEQ ID NO: 7254 - DNA, 300 bp, Homo sapiens
  misc_feature 153, 154, 158, 159, 171, 173, 174, 177, 178, 183, 186, 199,206, 212, 214, 215, 221, 233, 246, 254, 256, 258, 264, 273,274, 275, 277, 285, 288, 291: n = A,T,C or G
aattccgttgctgtcggtaggattataaatggtttaaaatacgtattctcaaacctcattttcagcatataaatttttaagaatcagtgtttaaaggtacgtgaaaccatttgctagatttttgtcctagttttttttttttaatttaaaaannttanntgttttttaganannttnnaatgnccntgcctcactggcnaaacgcnttcagngnnggatcnactgtttaagangatctccgggaanaagccctnanantttganagggactgnnntnggtgttcnatnctnccccagttt

SEQ ID NO: 7255 - DNA, 300 bp, Homo sapiens
aattccgttgctgtcgcacacagcccctctgcaaaggttgggaaacttgcaaggaatttaaggaaatctctgttcagtcattagccagccactaaactaactgagcagatccttcagtgatcacacacaacaaagaatacagactttacagacttagtcctagaaaatcactacacaaacagcaacaacaatgcacctgggactaagggagaggagatgagttccagagttggtatattatttaaatgtctagttttcaataaaaacaattataagacacagagcaaaactagaaagtat

SEQ ID NO: 7256 - DNA, 300 bp, Homo sapiens
  misc_feature 89, 92, 93, 98, 108, 109, 113, 114, 115, 120, 122, 125, 126,132, 133, 137, 140, 152, 157, 161, 164, 167, 168, 170, 172,174, 180, 185, 187, 196, 201, 203, 207, 213, 218, 221, 223,225, 229, 231, 233, 235, 238, 241, 248, 249, 251: n = A,T,C or G
  misc_feature 255, 264, 265, 266, 268, 269, 273, 274, 280, 281, 287: n = A,T,C or G
ctggtgttagggttctttgtttttggggtttggcagagatgtgtttaagtgctgtggccagaagcggggggaggtgtgggaggtttaantcnnccacnaccatattcnnaacnnngtttnanccnnttcttnncacnaancctatatttgancccancctntgnacnngncntncttgantcacntnacatgttanccctncnaccncctacncatancantncnttancntnantcnccnttacttnntncctnccaccctgnnncnnactnncccacnnttcagnccttattctctcc

SEQ ID NO: 7257 - DNA, 300 bp, Homo sapiens
aattccgttgctgtcgataaaatgggaatcttcttggtattttatgtgtattgtaagtagcagttaaattatttttttaaaagcaatttcagttttaatcactgaacaaaagaaacaggcaacattcacttctgtagtatggtttccacctatctctaacaccactattaaggtacaccagtgttaaggtacattaataactacacaaaattttatttaaagagaacacttagcagcctatgatagttttcaataaaatgttgcctctctttcggattctcactaacttttggtactatt

SEQ ID NO: 7258 - DNA, 291 bp, Homo sapiens
  misc_feature 114, 117, 118, 119, 122, 127, 128, 130, 133, 138, 139, 140,142, 145, 150, 159, 176, 180, 183, 184, 195, 197, 201, 204,214, 215, 218, 231, 237, 238, 240, 241, 242, 243, 244, 246,247, 248, 252, 257, 259, 261, 267, 269, 270, 273, 277: n = A,T,C or G
  misc_feature 281: n = A,T,C or G
aattccgttgctgtcgaagaacttcatgggcttcaataatgtctagaaagtaaaatgaaagaggaatgttaccatccccagctgcccttatttccagagaaccagacgtttggntgnnnagnggatnnanaancgctnnncntancaggntactcgatnaaggcaaggtaaatatngctncannagtgccctctncnttcncangagtccctcnnatnagcacccttatgntagggnntnnnnntnnnaacnttccngntngaccanannttnaccnctgnggccgttagg

SEQ ID NO: 7259 - DNA, 284 bp, Homo sapiens
  misc_feature 232, 237, 251, 260, 264, 268, 269: n = A,T,C or G
aattccgttgctgtcggttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacngtggntgaagtagaattcnaattaccanggtnacannagatctttggcaacc

SEQ ID NO: 7260 - DNA, 300 bp, Homo sapiens
aattccgttgctgtcggcaactgtgacctggagcgctttgctcaggtcttggagaaggaactgcccctgtatgcgcgccccatcttcctgcgcctcctgcctgagctgcacaaaacaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccg

SEQ ID NO: 7261 - DNA, 300 bp, Homo sapiens
  misc_feature 84, 102, 112, 123, 126, 135, 141, 142, 159, 166, 173, 184,187, 197, 198, 204, 207, 215, 236, 239, 261, 276, 280, 285,289: n = A,T,C or G
tataagctgcaataaacaagttaacaacaacaattgcattcattttatgtttcaggttcagggggaggtgtgggaggttttacngacgctaaagaaaacccntatggcaagnatgactataanagnccattcccnctgcannccaaaaactaacgcagntatgccnagaatgngactgtctggntcnaacccagcgnnctgcanacngatgtacngaagattttatgaaatgcatnganactacctgaaaaatcacagacnttctataaggagctnaacngtttncganaggccgtctag

SEQ ID NO: 7262 - DNA, 294 bp, Homo sapiens
  misc_feature 105, 109, 111, 112, 115, 126, 128, 132, 136, 142, 144, 147,151, 157, 161, 164, 186, 189, 190, 192, 196, 201, 204, 208,214, 216, 221, 225, 228, 233, 238, 240, 255, 261, 266, 272,282: n = A,T,C or G
aattccgttgctgtcgtaccccagtaccagtgaggatacattgggaattacttggcaaagtcctggtacctgggctagcttggttcctttccaagtgtcatatangacncnnatnttaccggccanantccnatantacggntngantatnttgtgntgcnganccattttcacaattactatgtnatnnantganaatgnttnagtnaaaaantncatanctgnaanacatngaatntnaattgggccatcatntacganttganctgaantatttagggnactttataaatt

SEQ ID NO: 7263 - DNA, 260 bp, Homo sapiens
  misc_feature 90, 107, 110, 117, 118, 119, 122, 123, 126, 132, 143, 146,150, 151, 160, 161, 165, 166, 168, 173, 174, 175, 180, 188,189, 192, 196, 199, 202, 205, 206, 208, 209, 210, 226, 228,232, 234, 238, 239, 242, 244, 245, 251, 256, 259: n = A,T,C or G
aatccgttgctgtcggaaacgctgccagatcatcatctttcaggtggtcttcctgggcctcctggctggcctggtggtcctcttctacgnctatcctgtgcgttgcnagnagttgtnnnttnnctnatggcnggtattctgtnttntttnnttttttttnntttnngnagccnnntgatnatgttttnnttngttnttntgnagnntnnnagttttggtaggtttntngtcngnttcnnagntnnattctntctantgnt

SEQ ID NO: 7264 - DNA, 293 bp, Homo sapiens
  misc_feature 267, 282: n = A,T,C or G
aattccgttgctgtcggaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggctctcttttaaatttggccaagcntgcagcttctaccgntcagattcttg

SEQ ID NO: 7265 - DNA, 300 bp, Homo sapiens
aattccgttgctgtcgatttaatatacaacttggtttagaataaatatctaacaaatgtataattgaatggcagagacactgacacttcatttgataggtcattgctcctgcccagtttgggactgagaaaataatttgatagttggtccaatgtgtgatacctatgaaagaaccgagcctttaatattttcatctttatgttacagccactgtgtcgaactcccagcaggcttaccaggaagcatttgaaattagtaagaaagaaatgcagcctacacacccaattcgtcttggtctgg

SEQ ID NO: 7266 - DNA, 292 bp, Homo sapiens
aattccgttgctgtcgccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcaaggggaaga

SEQ ID NO: 7267 - DNA, 263 bp, Homo sapiens
  misc_feature 174, 180, 186, 187, 201, 202, 206, 207, 209, 210, 213, 215,218, 222, 227, 228, 233, 237, 239, 241, 242, 243, 244, 251,253, 255: n = A,T,C or G
aattccgttgctgtcgggcacagtagtttaccctgttatctgtgtttcataatgggggctgtatgaatattatttataactaataaaatgttgccagaattatactaaactgttggatgagattaggagatcagaggctggaccttctcttgataatgcttgttttgttacagntattangaaatnntttgtatgtgattnntttnntnntcngnatngttnatgtnnagatnggtnanannnnctttttnantngctgaatt

SEQ ID NO: 7268 - DNA, 300 bp, Homo sapiens
aattccgttgctgtcgctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggat

SEQ ID NO: 7269 - DNA, 300 bp, Homo sapiens
tagatcaagctacttgttctttttgcaggatcccatcgagccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaa

SEQ ID NO: 7270 - DNA, 299 bp, Homo sapiens
  misc_feature 99, 101, 104, 108, 110, 113, 114, 115, 116, 117, 120, 121,129, 135, 141, 144, 158, 161, 164, 165, 170, 177, 179, 186,189, 191, 196, 198, 199, 202, 203, 206, 207, 211, 213, 219,221, 225, 226, 229, 230, 232, 237, 239, 240, 244, 245: n = A,T,C or G
  misc_feature 250, 252, 253, 274, 281, 282: n = A,T,C or G
aattccgttgctgtcgttgcacccaaggctgagcctgccatcatccctgccacccggaacgagcccatcgggctgaaggcctccgacttcctgcccgcngnganaatncnccnnnnngcnnatctggcntacaangatganatngacgtgataggtgntancannaacancatagananaaactgnttntntgtangnnganngtnntacntnatccgntncatnnaanntngaatncnnatcnnctccnannaggaaccgtcttgagaagatngcatganncgaatcctactcttcga

SEQ ID NO: 7271 - DNA, 294 bp, Homo sapiens
  misc_feature 227, 238, 248, 250, 251, 257, 263, 266, 271, 273, 276, 283,286: n = A,T,C or G
aattccgttgctgtcggccgcgaggcggcaatgccggcttggggcttggagcaacgcccgcacgtggcagggaaacctcgtctctataaaaaaaagaatacaaaaattagttgggcatggtagtgagcgcctgtgaggctgcttgtgaggctgaggtgggaggatccctttagtccaggagttcaaggctgcagtgagctgtataatgccactgcagtccagcctgngtgacagttanaccctgtctncnnatctanattttntgnaaagnanacnttaaggntangatgaaat

SEQ ID NO: 7272 - DNA, 300 bp, Homo sapiens
gagcattccatcgtcttcattagctcttctatcctctgtcctgtcctctagcaagacacgctggatgcagatatccacatagagacggaggatcatggcatgtataagtacatgtcttcccagcacctcttcaagctgttggactgtttgcaggaatcccattcattctcaaaggccttcaactccaattacgagcagcggactgtcctgtggcgagcaggtaaggccacacagcagataagatagatggccacactggtcaccttcctaaaacattaaagtgcttggaaaatgcccaaa

SEQ ID NO: 7273 - DNA, 282 bp, Homo sapiens
  misc_feature 136, 140, 157, 164, 186, 197, 205, 207, 225, 228, 230, 235,239, 242, 243, 244, 246, 248, 249, 256, 262, 271, 272: n = A,T,C or G
aattccgttgctgtcggaaatgtggaagctacctttaggaacatggagaatttccaaaccaacaggcaaaggaaaactaacgcacaaaaatgacattctgaagatgcaggtttcagccaggcgcggtcgagagaanatanaaacggtcaattacccnacatatnctgaggctgagaaatagtgctnagatggaaganatgaactncnagtctctggtcgaccatnctnanttctnaccnttnnngncnnactgtanatgaanagggctttnntcttctgtat

SEQ ID NO: 7274 - DNA, 300 bp, Homo sapiens
aattccgttgctgtcgtcctcttcctggcccagaagatcttcaatgacaacagcctcagtatggaggccttccagcaccgttctgtgtcctggtcgcagttcaacaaggtcattctcctgccctttggacctcccacccccaagctcttcatccctggggcactcagggcctgctcagcctccatgcagggaccttccactggattctccacagtgccccctcaggtcctttaggaaggcctgtcatggaccagggaggaaaaaccccaggcctgggggttggctctggagatgcgttct

SEQ ID NO: 7275 - DNA, 300 bp, Homo sapiens
atgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatga

SEQ ID NO: 7276 - DNA, 300 bp, Homo sapiens
aattccgttgctgtcggctaagacaatctcagcttttcttagacaatcttctatctcaaacttcagacattccagaattgtcatgatgtttacactgtctgagttaaaaatcctgttcaagaaaaaaaaaagattttgtatcacttcttaaaaaggaatattcatagcacttgtcacaaatagaaggcaaccatgagataatacaagccagggagaggcttgtattacatgacaggtgtaattagtctgctgagccagctttacccaatgaagggcatatgtgttagagagattagctaa

SEQ ID NO: 7277 - DNA, 263 bp, Homo sapiens
  misc_feature 120, 124, 126, 131, 132, 133, 144, 147, 149, 155, 156, 164,167, 169, 170, 171, 175, 177, 181, 182, 186, 187, 188, 194,195, 196, 197, 206, 207, 213, 223, 224, 227, 229, 231, 232,236, 244, 253, 254, 259, 260, 261: n = A,T,C or G
aattccgttgctgtcggttctgggccagaaagacttccagtttggagtcgtttgctgcggggagggaatgaatgggcgctgggaacacgcccgcgaggtggggacgcgccggccgtatcnaggncnttagnnngagaacggccnacngncatctnnttcatgcnccntnnnaacntnactnntagnnnactttnnnncgtgacttnnccttantgtaaaatannttntncnngacncagccganttcatccanntcttnnngg

SEQ ID NO: 7278 - DNA, 300 bp, Homo sapiens
aattccgttgctgtcggttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaaagtgcagctccttctctccacccaccacag

SEQ ID NO: 7279 - DNA, 300 bp, Homo sapiens
aattccgttgctgtcgaagagacagctatatttgtttcaatgtgtacctctccttctaaactcagttcttaagcatatagtatctttatagctatacacctagtgtctatcagaccctaaactatggtaggccctcaatacattttattgttataggtagatagataggcatgagtagggcaggagagggctctccctccacccactagaaatgtcaagtgatgttttaaaaattgtcacactgcctctcagaaaatgataattcagcaaccggggagagaatcttctgatggtccacac

SEQ ID NO: 7280 - DNA, 300 bp, Homo sapiens
aattccgttgctgtcgcctttccaggtccttccaactttgttaatttgttctactgcctgggagattcctttgactttatctttttacctttatattgaaggttttcagctgtcatatttttaatttctggtagttttttcttgtctattccttaattttttctttggagacagggtttcactctgtcacccaggtttgtgacagccttactgcagcctcaacctcctgggcccaagcaatcctcccacttcagcctcctgagtggttgggaccacaggtgcataccaccacacgtggct

SEQ ID NO: 7281 - DNA, 272 bp, Homo sapiens
  misc_feature 129, 133, 136, 137, 140, 147, 149, 155, 156, 157, 158, 159,160, 161, 180, 182, 185, 186, 190, 194, 197, 199, 201, 208,209, 214, 218, 220, 221, 225, 226, 228, 237, 241, 245, 246,248, 251, 253, 255, 256, 261, 267, 270, 271: n = A,T,C or G
aattccgttgctgtcgacaaagtcgcagatgcatacaagactttttcaagaaacacatacagtacaaattcttagatgaagactttgtgttcgatatatacagagacagtagggggaagggggggaagnttcntgnnacntctttgntnatcctnnnnnnncatgatttactactttaangnggnnttgntggntantngnaccatgnncattncttnanngtcnngnttttcttantaantcgnntnttncntnnactgncctaanatnnt

SEQ ID NO: 7282 - DNA, 288 bp, Homo sapiens
  misc_feature 105, 110, 124, 125, 131, 134, 136, 144, 145, 149, 150, 165,166, 168, 172, 174, 176, 182, 189, 190, 196, 197, 198, 199,201, 206, 210, 215, 216, 217, 224, 226, 227, 228, 229, 234,235, 236, 239, 240, 241, 246, 250, 256, 257, 261, 262: n = A,T,C or G
  misc_feature 264, 267, 273, 279, 280, 281: n = A,T,C or G
aattccgctgctgtcgcccaaactaaaaccttatctgtctgcattttgaatgcattttggtcaaaagtatacgttttaaagatttttaaagataaaaatgtggcncaacngggtttttttgctnnctgatntangnccctatcnntaanntaatctttctctccnnanccanantncaccantatggtnnaactannnntnaactnacantgaannnttaattngnnnntttcnnnaannntttcnaatntaaatnnctanngnttncaactngctcgnnngaaattc

SEQ ID NO: 7283 - DNA, 261 bp, Homo sapiens
  misc_feature 105, 107, 118, 125, 126, 133, 146, 148, 172, 173, 175, 182,183, 194, 198, 213, 216, 227, 239, 247, 249: n = A,T,C or G
aattccgttgctgtcggcttgggattcttttatctcctgtggtggataaatctgccttaaatatcaatgtaacttgggggctgggggcttgttttgggtgccaancncatctctttanggacagnntaaatgngattatatctcangnacagttggaccttcagacctaacnntnaccattnnccttacctgtntaantctgaaatgtaatanganagataactgcnagatgccagctntcctaatntncaaagcctttca

SEQ ID NO: 7284 - DNA, 300 bp, Homo sapiens
aattccgttgctgtcgaaaccaaggacacagtcagcatttaacaaaaaggaatctgcatctcagtcagaactgtattgcatttgcttctctctggattaccttgaagttactccccttccccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagta

SEQ ID NO: 7285 - DNA, 300 bp, Homo sapiens
aattccgttgctgtcgcgaatggtgaccccctggacggaagcgcccagaaggtgccgagtcccgatccccagcccagcactcgcggcatcttcggcctttgccactattttggtttttatgatttttaacaaggagcgtgaaagcttcagctgcgcctgagcccacgtgggcagcgggacggcataggggtggcccccatagaagccgggctgggggtggcctccgtagggttgtctggtgtttccacgtggggtgctaagaagcaaggcctggctgggtgcggtggctcccgcctgtga

SEQ ID NO: 7286 - DNA, 300 bp, Homo sapiens
aattccgttgctgtcgggcaaggaaggattcttctgaagctttcggaggaagcatggcccggccaacaccttgatttctgatttctaaactactcagcccgcctgcacccaggtgaaataaacagccttgttgctcacacaaagcctgtttggtggtctcttcacatggacacatgagacacttggtgccgaagacccaggtcagtgagactccttcaggagaccagtcccctgtcctcaccctcactccgtgaggaaatccacctatgaccttgggtcctcagaccaaccagcccaagg

SEQ ID NO: 7287 - DNA, 300 bp, Homo sapiens
aattccgttgctgtcggtttaccagctacataggatagggcctaacaaagacttactagcacaaagcaaggaggtttcaaggaagttagtttataaaagaaactattattttttaacacttatgatttattctttaacaagaagggaaactttgaagaggaacttttactttccacattgaacaaataagtaagaaaaagaaagggaaacttccccagggctgaaaggaaattttcaggtcatgccattattatcagaattaataagacccatgcatcgtggaaaactgagaacaccacg

SEQ ID NO: 7288 - DNA, 260 bp, Homo sapiens
  misc_feature 157, 166, 167, 169, 180, 186, 199, 201, 210, 212, 214, 216,222, 225, 227, 236, 238, 240, 242, 245, 249, 250: n = A,T,C or G
aattccgttgctgtcgccggagcgcacccggccggaagccgctgtcggggagccggcggtggggctggacgcaggtgcaactgacatgggtgaaccccagggatccatgcggattctagtgacagggggctctgggctggtaggcaaagccatccanaaggtggtnntnaatggagttgnactttntggataggatttntntgttagttncnantnttactntgntntaatctttngnantnttnggannttttttgttt

SEQ ID NO: 7289 - DNA, 300 bp, Homo sapiens
aattccgttgctgtcgatctcaccctgggaagatgtggtgccccctccagggctctggaggatggatgcctcccccaggggctctccaagctgggcatttgggcctggtggatgccaacctggataacctgtggcccagcattgactgtccacccagccttgctgttaggcaccatgactccaagatgaagatgtggtccctgcccttgagtgacagcccagggacttaatgtggccatcgggcatcaagcacaaggccatgcaggtgatgatacgtcggaatagaggcaccagccctgg

SEQ ID NO: 7290 - DNA, 300 bp, Homo sapiens
aattccgttgctgtcgggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagagtggggtctggattatgttgtcctgacatctgtggatcgagatgatatgcctgatgggggagctgaacacattgcaaagaccgtatcatatttaaagg

SEQ ID NO: 7291 - DNA, 265 bp, Homo sapiens
  misc_feature 89, 90, 93, 100, 102, 105, 117, 119, 129, 141, 149, 154,159, 162, 165, 168, 172, 176, 177, 189, 198, 201, 208, 212,213, 215, 217, 219, 222, 227, 239, 240, 243, 245, 246, 249,250, 254, 258, 264: n = A,T,C or G
aattccgttgctgtcggtggaggttgccgtgagctgagattgcgtcactgaactccggcctgggtgacagaaggaggctctgccttaannganaaaaaancntcntggaactgttgnanggataaaatnaaggattgaggnattgaggnattgntgacntgnacntcnaggngtcnnatttttttaaangggggggcncgnaccgggnccgnntncntnttntttcnaggcaggtgggnntgngnnaanncaanaggnattccnt

SEQ ID NO: 7292 - DNA, 257 bp, Homo sapiens
  misc_feature 104, 105, 108, 111, 115, 116, 123, 125, 136, 140, 147, 153,155, 162, 167, 170, 173, 174, 178, 183, 185, 187, 190, 194,195, 198, 203, 205, 206, 207, 210, 211, 217, 218, 222, 223,229, 232, 234, 235, 237, 239, 243, 247, 249, 251: n = A,T,C or G
aattccgttgctgtcggtgaatgatgatgatgccattgttgctgcttcgaagtgcttgaaaatggtttactatgcaaatgtagtgggaggggaagtggacacannttncantgannaagatgntnaagagcccatncctnagaccancttatntnatacctnttganctnttnngatntcatntnangtntcannatntgccntnnnctnngccacnnggcnntatgcnttntnngncnattntttntncntcatct

SEQ ID NO: 7293 - DNA, 286 bp, Homo sapiens
  misc_feature 134, 137, 141, 148, 152, 155, 158, 161, 163, 167, 172, 173,175, 179, 187, 188, 190, 192, 194, 197, 201, 207, 209, 212,221, 227, 232, 233, 236, 241, 244, 245, 247, 253, 254, 256,259, 260, 266, 269, 278, 279: n = A,T,C or G
aattccgttgctgtcgagatgaccctgctttcttggtcctgttaagtatctggctctgtgtgtccactataggatttggctttgtgctggacatgggattctttgagacaataaagcttctcctttgggttgcnctnatanattgtgnatgngcntgntcntntttncgttnnanaatnttcctttnnanancnggncatntaattnanttnaaaggaatnaccctngcccnnggnttaanaannanttcttnnanatnnggaacnttntcccctttnnaattttc

SEQ ID NO: 7294 - DNA, 300 bp, Homo sapiens
aattccgttgctgtcggacccataggcatgccagacatgggcatggggttcatgttcatctgtcccatgtgaccactgctgccattcatgtgcaccatactatacactgcaggattcccctggtgggcaaactgctgctgggaaaaggagctgtaagtaaacaaatggtaatattacctctggaagtcactttagcgacaaagggcatgcccacagaaattactacaattgtgtcaaacattgctatacttaagctgggaatgttagagaaaactccctgacagcctgtgatccattttt

SEQ ID NO: 7295 - DNA, 300 bp, Homo sapiens
aattccgttgctgtcgaccagacagagcttccagagtgtcaggacatgtgtgacttagcccagattcagactttagtcacaagcaggatcagcatagacatctagctcccagcatggcaattctctgttgtgtctccctgtttgtattggctgcaggaaagctcagagccaagtctgcgataagctgatcctaagtgtgaacgtgaagtccccagccctgctgctgagccagttgctgccctacatggagaacaggaggggtgctgtcatcctggtctcttccattgcagcttataatcc

SEQ ID NO: 7296 - DNA, 300 bp, Homo sapiens
gggcggctccgggcaggggggcacgatcttaaggacagtcgctccctgaacgcggagccggaggagacgaagggaaggtggagcggacgccacccgcgcaccgggcaggcgcggagaccggcgtgggacagccacctggagcgcagctgccagaaagaaggactttgctgctttgggccaggatctgaacttaggtgtaaaccattgccctggcagagggaacctacccagtccattgctgcctgctacaagatatgaacagtaatggcacatattttggttatgagtcactcagtggac

SEQ ID NO: 7297 - DNA, 300 bp, Homo sapiens
aattccgttgctgtcggcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagg

SEQ ID NO: 7298 - DNA, 300 bp, Homo sapiens
aattccgttgctgtcgatgctcccaggtctccagtgtcacctctcggtacagtgtcctctgggccaggtccagctgttcccactcctcctgtgtgaatgccatagccacatcctcgaagcacacagatgcctgaaacagggcacttgttactgctcagagaccccaggtcctcatgccctcacggaggtacctgttaaggcctaaatgttggtgtccccccgtaaaattcatacattggaacctaatacccagtgagatagtgttaagaggtggggtctttacaaggcaattaatgtcct

SEQ ID NO: 7299 - DNA, 298 bp, Homo sapiens
  misc_feature 109, 117, 127, 128, 129, 132, 133, 139, 140, 142, 145, 146,152, 153, 154, 155, 156, 159, 173, 174, 175, 181, 183, 186,187, 189, 190, 196, 198, 201, 204, 208, 213, 215, 217, 219,224, 230, 231, 232, 244, 246, 248, 250, 252, 254, 257: n = A,T,C or G
  misc_feature 258, 262, 288, 290: n = A,T,C or G
gaaaggcaccagtatgtgttttagattgatttccctgtttcagggaaatcacggacagtagtttcagctctgatggtataagcaaaacaaataaaacgtttataaaagntgtatctngatacactgnnnttnnacatgnnancannttatgnnnnntantctatgccaccttnnngtcacntnttnnannctctancnttncancttncttgntncntntcctnattcgnnngtgccaagagantntntncngnagnnaccnttcctttgccaccttcttgctctgtntntattacct

SEQ ID NO: 7300 - DNA, 300 bp, Homo sapiens
aattccgttgctgtcgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgccttcccctctcagacatggcttccttattgctggaagaggaggc

SEQ ID NO: 7301 - DNA, 267 bp, Homo sapiens
  misc_feature 130, 133, 135, 145, 146, 157, 158, 159, 163, 164, 165, 168,169, 172, 173, 174, 177, 180, 181, 184, 188, 189, 192, 193,194, 199, 200, 202, 204, 210, 215, 227, 229, 234, 239, 242,243, 244, 247, 252, 254, 258, 259, 260, 261, 264: n = A,T,C or G
aattccgttgctgtcggcaggttggtgtcaaaggaaatccccaaggcttcaaccagggtctggattgtgatgtgatcgtagctgaggtatgtgcttctcaggcctgcaaagcttccacatttttgttganatnanttattcatgnngacttgtatcnnnctcnnnacnnttnnntcnctnnaanctgnntannnctatnntnancttcgnaactnatcttgattacntnttctncatcntannnttnatttnantaannnntgntga

SEQ ID NO: 7302 - DNA, 300 bp, Homo sapiens
gccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgg

SEQ ID NO: 7303 - DNA, 294 bp, Homo sapiens
  misc_feature 230, 233, 249, 256, 257, 265, 267, 273, 274, 278, 283, 284,286: n = A,T,C or G
gtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccnccnggacctggacctgtanctgttcnntgggtacntnctgaannttgngtgtnntnagctcctt

SEQ ID NO: 7304 - DNA, 300 bp, Homo sapiens
aattccgttgctgtcgctggtgatgagatcgggaaagtgggctcaggaggtctggatctgtgatgagatggggaaagtgggctcaagaggtctggatctgtggtgagatgggggaagtgggctcaggaggtctggatctgtgatgagatggggaaagtgggctcaggaggtctggatctgtgatgagatggggaaagtgggctcaggaggtctggatctgtgatgagatgggggaagtgggctcaggaggtctggatctgtgatgagatgggggaagtgggctcaggaggtctggatctg

SEQ ID NO: 7305 - DNA, 278 bp, Homo sapiens
  misc_feature 133, 138, 140, 147, 148, 151, 156, 161, 187, 215, 230, 232,233, 246, 253, 257, 269: n = A,T,C or G
aattccgttgctgtcgcagccttatcattggttatgccagaaacccttcgctgaagcagcagctgttctcatatgctatcctgggatttgccttgtctgaagctatgggtctcttttgtgtgatggttgcttncttgngngtgcttnncangaccnaagancataggaaacacctgagtagctcttntcgtgctggccaccaggagaaggagcantatagtcgcctgagngnnggcggccattatnacagccngaanacactttctacntcttcaatg

SEQ ID NO: 7306 - DNA, 281 bp, Homo sapiens
  misc_feature 115, 117, 134, 136, 138, 143, 146, 151, 154, 157, 161, 171,175, 179, 183, 204, 210, 220, 222, 224, 230, 231, 235, 254,256, 259, 263, 269: n = A,T,C or G
aattccgttgctgtcggaagctagatggactaggagagacttgattttggtgctaaagttccccagttcatatgtgacatctttttaaaaaaaataacaacaaaaaaaaaatgananaaaagctaaaaaaaaangnanggggngancagtnaanggnattnattccacatncaanatcngggnaaaacgatttcctgtaaaagnaccttnaagggttttngntntaaaannccgnaggtctatccttaaagcantnacnccangctttnttccctgggttt

SEQ ID NO: 7307 - DNA, 300 bp, Homo sapiens
aattccgttgctgtcgctcagcccgcctgcacccaggtgaaataaacagccatgttgctcacacaaagcctgtttggtggtctcttcacagggacacggatgaaatttggtgccgtgactcggatcgggggacctcccttaggagatcaatcccctgtactccttttctttgccctgtgagaaagatccacctatgacctcagtcaggtcctcagaccgaccagcccaaggaacatctcaccaattttaaatcagaccttgaagatttgttgttcaaggagaaactgaagagcaagaagg

SEQ ID NO: 7308 - DNA, 293 bp, Homo sapiens
  misc_feature 79, 81, 88, 89, 90, 91, 94, 96, 101, 102, 104, 105, 115,116, 123, 141, 147, 150, 151, 153, 155, 156, 166, 176, 187,198, 209, 213, 215, 221, 245, 249, 255, 256: n = A,T,C or G
aattccgttgctgtcggaaatgacccgccctcaatgctggctgctgctaacattaatgagaaggtggccttcagcgtgnanctgaggnnnnaangncacannanntgaatgcttnnagcgacngaaatggaatattctganaatgancannancnncaccactacnacagaaagangttggaggctnctgtaccctgntcattccttangggncntgcttnccttaataagtaagtaagttggtntacngccctnnatatgcaaatgagagctgaaagtttttaaaaggtaca

SEQ ID NO: 7309 - DNA, 280 bp, Homo sapiens
  misc_feature 219, 225, 229, 237, 240, 247, 248, 250, 251, 252, 254, 259,262, 273: n = A,T,C or G
aattccgttgctgtcgctttgaaatgtaacaaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttgaaacggagtnttgctntgtngcccaggntgnagggcannannncnatctnggntaattgcaccntccgttt

SEQ ID NO: 7310 - DNA, 259 bp, Homo sapiens
  misc_feature 201, 213, 226, 227, 229, 235, 238, 241, 242, 244, 248, 251,254, 257: n = A,T,C or G
aattccgttgctgtcgctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagagggtttnactctctgctanagcgtagacgatnnantttacnctntcnnanctcnatnttncanct

SEQ ID NO: 7311 - DNA, 276 bp, Homo sapiens
  misc_feature 193, 196, 198, 200, 207, 213, 214, 215, 216, 221, 224, 229,230, 233, 234, 239, 244, 246, 250, 252, 254, 256, 259, 262,270, 273: n = A,T,C or G
aattccgttgctgtcggtctctgtgtgtacctcccattgagtagagaagcttaagataatttctgagagaagaacactgctgattgtgggagcagtttaggagtccatggaagaaagaaaaatacatgtgtcttggcagccatggtgtatttttgtccaaatggattggaaggatatttgaatatttgaatgntgntncnacataangttgannnncactntcnattcnnccnntgaantacantnctgncnancnctntcnccttaatntcnttc

SEQ ID NO: 7312 - DNA, 299 bp, Homo sapiens
  misc_feature 219, 231, 232, 235, 241, 246, 247, 251, 252, 253, 260, 261,263, 267, 269, 276, 283, 288, 289: n = A,T,C or G
aattccgttgctgtcggtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtangttgggtaacanntanggctanctaanngcannntttccanncntttngntctgaanaccttcntttannctgcccattg

SEQ ID NO: 7313 - DNA, 296 bp, Homo sapiens
  misc_feature 203, 223, 229, 240, 242, 243, 250, 251, 257, 266, 273, 275,283, 284: n = A,T,C or G
aattccgttgctgtcgcagctttattgctcacacaaagcctgtttggtggtctcttcacacggatgcgcatgaaatttggtgccgtgactcggatcgggggacctctcttaggagatcaatcccccgtcctcctgctctttgctccatgagaaagatccacctatgacctcaggtcctcagaccgaccagcccaagaaacatntcaccaatttcaaatctggncttcanatggaaaggancnngtatccnnaaagangtgatcaangattgcntnctgagganntcatatgcactt

SEQ ID NO: 7314 - DNA, 300 bp, Homo sapiens
aattccgttgctgtcgcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctggcagttaccccaccc

SEQ ID NO: 7315 - DNA, 300 bp, Homo sapiens
aattccgttgctgtcggccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctc

SEQ ID NO: 7316 - DNA, 300 bp, Homo sapiens
catcttggccatgctggtcttgaactcctgacatcgtgatccatctgcctcggcctcccaaagtgctgggattacaggcatgagccacagtgcccggccattttgcccattttttaatcaggttatttgcttttttgggaagattcgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagtta

SEQ ID NO: 7317 - DNA, 300 bp, Homo sapiens
aattccgttgctgtcgagcaaataccaaggcctaaaaaagaatgaattatttgctgtttgggaaatggaagcccacgctgagtgctgaagcacagggactctgcgcaggaagaggaggggaagcaagaaatgaatttgggtccttgtgatggcagtggctgctgccatcacgctgtgtggctagggctgcacacttcatggagccggtggaagccccgtccctcatgagttgggactggagccgcaaaccgctgctgcagacccaggccttctgctctatggagcaggcaggagccccac

SEQ ID NO: 7318 - DNA, 270 bp, Homo sapiens
  misc_feature 128, 131, 136, 150, 151, 153, 155, 165, 166, 167, 172, 174,177, 179, 184, 187, 188, 191, 196, 197, 201, 202, 204, 207,211, 213, 216, 219, 220, 223, 224, 225, 226, 227, 228, 231,232, 233, 234, 235, 241, 242, 243, 244, 251, 254, 257: n = A,T,C or G
  misc_feature 259, 263, 264, 266, 268: n = A,T,C or G
aattccgttgctgtcgcagccttgttttatgccacttttctctccccataccttcccctcatgtgtacttagccacctgtgttgctttgaatctgctgccagttctggctcaaatgtggcacaaaatnagnacttnagacgcaccatganntncntgtggctatnnnttctnangantngtttnacnnttnctgtnntatnntntgnttangnttnagnngtnnnnnntannnnnaaatannnnatgatgnttntgncnatcnntntnat

SEQ ID NO: 7319 - DNA, 300 bp, Homo sapiens
aattccgttgctgtcgcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatct

SEQ ID NO: 7320 - DNA, 300 bp, Homo sapiens
  misc_feature 216: n = A,T,C or G
aattccgttgctgtcggaagaacataaacaggatgctgagagattgggtctctccacattgccccggctgctctccaacccctgagttcaagtgattcacctcccttggcctcccaaagtactgggattacaggcgtgagccaccgtgcctggctgagaagatggatttaagacatattttggaggtaacattgtcaggacttcctgaaggattanatgtggaagggaaggataagaaacagaccaaggataactttcaaatgtatgcttaagcaactggatggataatgatgccattga

SEQ ID NO: 7321 - DNA, 286 bp, Homo sapiens
aattccgttgctgtcgcgaatggtttagcgccaggttccccacgaacgtgcggtgcgtgacgggcgagggggcggacgctatctacttagatccagacatgataagatacattgatgagtttggacaaaccacatctagaatgcagtgaataaaatgctttatttgtgaaattatgtgatgctattgttttatttgtaaccattataagctgcggatatacaagttaacaacaacaattgcattcattttatgtttcaggttcagggggaggtgtgtgaggtttta

SEQ ID NO: 7322 - DNA, 268 bp, Homo sapiens
  misc_feature 162, 166, 171, 174, 177, 178, 179, 180, 181, 182, 183, 186,189, 191, 198, 199, 200, 203, 206, 207, 209, 211, 212, 213,219, 221, 223, 228, 232, 233, 235, 237, 238, 239, 240, 241,242, 250, 251, 252, 257, 258, 259, 260, 261, 262: n = A,T,C or G
aattccgttgctgtcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcgnttgnagganganttnnnnnnnttnttntngtgcttnnncanttnnantnnncttccntnanagttngctnnangnnnnnnttttatannntatcnnnnnnatcatt

SEQ ID NO: 7323 - DNA, 289 bp, Homo sapiens
  misc_feature 161, 175, 178, 185, 214, 266, 268, 273: n = A,T,C or G
aattccgttgctgtcgcaggaagtgaggatacttctggcgagcgccggttgctgtttcttctcaggctcagggaccggccgcggccccgtagggggttttaactcaaatgggtgatgaaaaggactcttggaaagtgaaaactttacatgaaattcttcangaaaagaaacgaanganggaacangaggagaaagcagagataaaacgcttaanaaattctgatgaccgggattccaagcgggattcccttgaggagggggagctnanagatnactgcatggagatcac

SEQ ID NO: 7324 - DNA, 264 bp, Homo sapiens
  misc_feature 164, 165, 169, 170, 178, 183, 192, 195, 196, 199, 200, 204,205, 206, 207, 208, 209, 212, 214, 216, 217, 219, 223, 227,229, 230, 232, 234, 235, 237, 239, 241, 251, 254, 255, 259: n = A,T,C or G
aattccgttgctgtcgctttttatcacctcccctcctcacacctggtccggcttacagtttcgttccgtgactagccctcccccacctgcccagcaatttactcttaaaaaggtggctggagctaaagacatagtcaaggttaacgctcctttttctttatccnnaatnngatacgtntaagntcctttttnaanncannttannnnnnagncnanntnatgncttnanncncnntnancntgctgagacncannaatntttaa

SEQ ID NO: 7325 - DNA, 300 bp, Homo sapiens
aattccgttgctgtcgggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattg

SEQ ID NO: 7326 - DNA, 300 bp, Homo sapiens
ctatctacgtacagccagacatgagaagatacattgatgaggttggacaaaccacagctagaatgcagtggagaaaatgctttatttgtgaaatttgtgatgctattgctttatttgtaaccattataagctgcattaaacaagttaacaacaacagttgcattcattctatgtttcaggttcagggggaggtgtgggggtggagttgttcaggtatcttgggatatatatatgcattctaaaatctgtagcagcataactcctttgggaatcatgagacatttttgtctcttacctgtt

SEQ ID NO: 7327 - DNA, 300 bp, Homo sapiens
aattccgttgctgtcgcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaact

SEQ ID NO: 7328 - DNA, 300 bp, Homo sapiens
aattccgttgctgtcgccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttattcttgagtatcagaacaccaccttctttgg

SEQ ID NO: 7329 - DNA, 300 bp, Homo sapiens
aattccgttgctgtcgcccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatg

SEQ ID NO: 7330 - DNA, 279 bp, Homo sapiens
  misc_feature 251, 254, 259, 260, 262, 264, 266: n = A,T,C or G
aattccgttgctgtcgttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagctgagttttcttgggccaggcctttacaataaggcacgtctntgngtggnncncnantgaaccccttatg

SEQ ID NO: 7331 - DNA, 300 bp, Homo sapiens
aattccgttgctgtcgggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagc

SEQ ID NO: 7332 - DNA, 207 bp, Homo sapiens
  misc_feature 157, 182, 185, 187, 191, 193, 194, 196, 198, 201, 202, 203,204, 206: n = A,T,C or G
aattccgttgctgtcgctcagttttggcggagcaaagtcctagaggtggccaaggacttccctgagtacacctttgccattgcggacgaagaggactatgctggggaggtgaaggacctggggctcagcgagagtggggaggatgacaatgccgccntcctgaacgacagtgggaaaaagantgncntttngnnanangannnngnt

SEQ ID NO: 7333 - DNA, 300 bp, Homo sapiens
aattccgttgctgtcgcccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaaggggatagtcccctttctgaaaacactcgttgcctttgttcttctcctccaaagccagctaaattccaaataccagagactgaaattttcagccttgctaagggaacatctcgatgtttgaaccttt

SEQ ID NO: 7334 - DNA, 249 bp, Homo sapiens
  misc_feature 125, 130, 147, 149, 155, 164, 177, 187, 190, 199, 205, 210,217, 218, 220, 226, 228, 232, 234, 237, 240, 243: n = A,T,C or G
aattccgttgctgtcggctgacagctattttgaaatttggagcagaggatctcttcaaagaactggaaggggaggaatcagaacctcaggaaatggatatagatgaaattttgcggttggctganacganagagaatgaagtgtcancnagtgcncagatgaanttctatcacagantaaggttgtnaantttgcagcnatggangatgngtaactnntntaaaancntggncntgnttngtngggata

SEQ ID NO: 7335 - DNA, 269 bp, Homo sapiens
  misc_feature 148, 159, 171, 182, 187, 188, 189, 190, 191, 197, 202, 203,208, 215, 221, 228, 230, 233, 235, 242, 247, 248, 255, 257,259, 261, 268: n = A,T,C or G
aattccgttgctgtcgggacaacgccaagctggtgcctgtgctctcagccaaggcggcccaagccagtgacctggaaaaaatccacctggatgagaagtctttccgttggttgcacaacgaggaccagatggctgtggagaagctttntgacgggatcngcaagtttgccngtgatgcagtnaagcnnnnncgcttncttgnnagatngaatgtntttatngttaatngnaanantttggtntctanntggtgtntntntnattatgnc

SEQ ID NO: 7336 - DNA, 294 bp, Homo sapiens
  misc_feature 182, 190, 201, 202, 205, 206, 207, 208, 210, 213, 218, 220,222, 224, 226, 230, 231, 233, 236, 237, 239, 241, 242, 247,249, 250, 252, 254, 255, 257, 258, 259, 266, 267, 270, 272,274, 278, 280, 283, 284, 285: n = A,T,C or G
aattccgttgctgtcgatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgtaangtgtcgtncctgagtggcnnggnnnngnggntatgngngntngngggnngnggnntngnntcggngnngntnncnnntgtgggnntgntntntatntnggnnngatttcggg

SEQ ID NO: 7337 - DNA, 285 bp, Homo sapiens
  misc_feature 179, 186, 193, 201, 208, 210, 211, 215, 223, 237, 242, 249,252, 253, 265, 268: n = A,T,C or G
aattccgttgctgtcggtatcgccaccgtgctgcagcacgaggagcgccgctgccagtacctcacccgggaggccaagctgatcctggcactccaggatgaggtgtccgccatggctgatggaaatgaaggtcctcagtccccattccatcacatcctgcccatttgcgtcattgcccnaaacctnaaggaancttatganagcctgngnncgtnagacgtantgcggcttcacatnaacanctggctnganntgagcttttgcntgncctacatgaaccactat

SEQ ID NO: 7338 - DNA, 250 bp, Homo sapiens
  misc_feature 163, 166, 174, 179, 193, 196, 197, 200, 203, 209, 211, 213,214, 216, 230, 236, 237, 243, 245: n = A,T,C or G
aattccggtgctgtcgaaccatccagattagatgtcaccaacagtgagagcccagaaattcctttgaatccaattttggccttggatgatgaagggacacttgggcccctgcctcaggtagatggtgttcagacacagcagactgcagaagttatatgagtgntanttctgaanaaccnttgctgactttttntgnnaanttnttacantnanngnaatttctttcctgntctatnngatcantntctcc

SEQ ID NO: 7339 - DNA, 266 bp, Homo sapiens
  misc_feature 178, 180, 184, 189, 197, 201, 204, 206, 211, 216, 219, 220,223, 227, 230, 235, 238, 240, 242, 245, 246, 248, 251, 261,262, 264, 265: n = A,T,C or G
aattccgttgctgtcggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgntntttncggcngaactaanttcnatncnttgancttanctnntangctnggncctcnatncntnatnntncgnagagatcganncnnt

SEQ ID NO: 7340 - DNA, 300 bp, Homo sapiens
aattccgttgctgtcgaagtggcttagggatggggtagagtagttgacttatttggatgaaaaccactatcttctgtcagaaactcaaaaggaatcattgctggcatggtaacctaaagaaaaacaaccagacaagtgcccaacgacacttaaaaaggtgatttattagcttgccaagtttaggctgggcatggtgactcatgcctctaatcccagcattttgggaggctgaggctggtggatcaccggaggccaggactttgagaccagcctgaccaatatggcgaaacctcgtccctg

SEQ ID NO: 7341 - DNA, 300 bp, Homo sapiens
aattccgttgctgtcgcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcat

SEQ ID NO: 7342 - DNA, 300 bp, Homo sapiens
  misc_feature 198, 218, 224, 226, 240, 248, 257, 267, 268, 278, 280, 287: n = A,T,C or G
aatttcgttgctgtcggtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggggaggtgtgggaggttttnccaagtgcttctgtagatancgtcantnggactagatattcnacaggccntaacttgantctattgccnntgtctttatnanatgtacnttttatattctgt

SEQ ID NO: 7343 - DNA, 287 bp, Homo sapiens
  misc_feature 256, 258, 268, 271, 274, 278, 280: n = A,T,C or G
aattccgttgctgtcggaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggtgagtagccctttctgtgctcgttctaaggctgtgggaaacgctttncnctgtcttcanttngcncacncntgtgcga

SEQ ID NO: 7344 - DNA, 300 bp, Homo sapiens
  misc_feature 242, 279, 289: n = A,T,C or G
aattccgttgctgtcggccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggaggtgtgggagggnatgaccttcccagggagaaacccacgacctgtcctgnctttgatcgnctctttgacat

SEQ ID NO: 7345 - DNA, 291 bp, Homo sapiens
  misc_feature 172, 175, 186, 196, 214, 216, 219, 224, 227, 229, 232, 241,244, 248, 249, 250, 253, 255, 256, 261, 262, 264, 265, 266,268, 269, 270, 276, 280, 281, 282: n = A,T,C or G
aattccgttgctgtcggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgnggncaccagggaangagcccattnacatcatcatcgattacntngtnaaggncantntgntgaattttntgnttannnatnanngccannannntnnntctacnaaannntatttctat

SEQ ID NO: 7346 - DNA, 231 bp, Homo sapiens
aattccgttgctgtcggttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttgcccaagctggcctg

SEQ ID NO: 7347 - DNA, 289 bp, Homo sapiens
  misc_feature 167, 168, 193, 196, 203, 215, 221, 225, 238, 243, 249, 252,259, 260, 262, 263, 267, 271, 272, 276, 277: n = A,T,C or G
tttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttcanncaccacctgacacttttgctgaagntgnaggacanactgaaccggcncctganctgngacctgatgccanacganaatatnccngagttgnngnntganctgnngcanntgggctacagtt

SEQ ID NO: 7348 - DNA, 300 bp, Homo sapiens
aattccgttgctgtcggagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcag

SEQ ID NO: 7349 - DNA, 300 bp, Homo sapiens
aattccgttgctgtcggggggatcaggatactcctgctcacagacacccatctccccctaccaaaaataacgctggagtcctccttccaccctgactctgcctctctgtctgcaggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagag

SEQ ID NO: 7350 - DNA, 300 bp, Homo sapiens
aattccgttgctgtcgcgagttcatccatcaatttcctgactcgagttagtggcattggtccatctgctgcaaggaagtttgtagatgaaggaattaaaacactagaaggctcacagctggattcatgcccagtaaagggacacctgaatggaactgagtcacttttagacttaatatgggatgttatgacaattcttaagttaaaaaatgcagatctcagaaaaaatgaagataaattgaaccatcatcagcgaattgggctgaaatattttggggactttgaaaaaagaattcctcgt

SEQ ID NO: 7351 - DNA, 300 bp, Homo sapiens
aattccgttgctgtcgggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtattaccaccttgctcttgactggaaatgcaactgtggttaccacctgtgctgcaggtccgtcctgg

SEQ ID NO: 7352 - DNA, 300 bp, Homo sapiens
aattccgttgctgtcggggggatcaggatactcctgctcacagacacccatctccccctaccaaaaataacgctgggctcctccttccaccctgactctgcctctctgtctgcaggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagag

SEQ ID NO: 7353 - DNA, 300 bp, Homo sapiens
aattccgttgctgtcggtggttgacgagctcggcggcggttttgctgagatctgtggccgtcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggc

SEQ ID NO: 7354 - DNA, 252 bp, Homo sapiens
  misc_feature 237, 240, 243, 244: n = A,T,C or G
aattccgttgctgtcgaataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggtgtgggaggttttgggatganaanacnngtttccca

SEQ ID NO: 7355 - DNA, 300 bp, Homo sapiens
aattccgttgctgtcgcgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagct

SEQ ID NO: 7356 - DNA, 300 bp, Homo sapiens
aattccgttgctgtcgctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttccc

SEQ ID NO: 7357 - DNA, 300 bp, Homo sapiens
ccgcactatagaatacaagctacttgttctttttgcaggatcccatcgagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccga

SEQ ID NO: 7358 - DNA, 295 bp, Homo sapiens
  misc_feature 196, 200, 201, 210, 214, 217, 220, 221, 223, 226, 230, 231,233, 237, 238, 244, 247, 249, 251, 254, 264, 266, 267, 270,271, 273: n = A,T,C or G
acgtacatccatacatgataagatacattgatgagtttggacaaaccacaactagaatgcagtgaaaaaaatgctttatttgtgaaatttgtgatgctattgctttatttgtaaccattataagctgcagtaaacaagttaacaacaacacttgcattcattttatgtttcaggttcagggggaggtgtgggaggntttnntggatctgnccgnccnccnnangtncacnncntgcnngtggcngangntnccntcaagccctngnnttnngntcctttcattgtccaacaatga

SEQ ID NO: 7359 - DNA, 256 bp, Homo sapiens
  misc_feature 210, 212, 220, 222, 223, 235, 238, 243, 244, 245, 246: n = A,T,C or G
gctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttgccccntngcaaaggngnnctaggctctctnggngattnnnngttttcccga

SEQ ID NO: 7360 - DNA, 205 bp, Homo sapiens
gctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttt

SEQ ID NO: 7361 - DNA, 300 bp, Homo sapiens
aattccgttgctgtcgtgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaac

SEQ ID NO: 7362 - DNA, 239 bp, Homo sapiens
  misc_feature 206, 207, 209, 210, 211, 212, 213, 214, 215, 216, 217, 218,219, 220, 221, 222, 223, 224, 226, 230, 231, 233, 234, 235,236, 237, 238: n = A,T,C or G
ctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttnntnnnnnnnnnnnnnnnngntttnntnnnnnng

SEQ ID NO: 7363 - DNA, 300 bp, Homo sapiens
aattccgttgctgtcgttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcct

SEQ ID NO: 7364 - DNA, 300 bp, Homo sapiens
aattccgttgctgtcgctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactgga

SEQ ID NO: 7365 - DNA, 300 bp, Homo sapiens
atgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagc

SEQ ID NO: 7366 - DNA, 300 bp, Homo sapiens
aattccgttgctgtcggcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcac

SEQ ID NO: 7367 - DNA, 300 bp, Homo sapiens
aattccgttgctgtcgagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgttt

SEQ ID NO: 7368 - DNA, 300 bp, Homo sapiens
aattccgttgctgtcgatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatg

SEQ ID NO: 7369 - DNA, 300 bp, Homo sapiens
aattccgttgctgtcgaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgctt

SEQ ID NO: 7370 - DNA, 300 bp, Homo sapiens
aattccgttgctgtcggcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttggggcacggcagcaatttgataggtatgtctgatctcaatgtgcctgag

SEQ ID NO: 7371 - DNA, 300 bp, Homo sapiens
aattccgttgctgtcgagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgag

SEQ ID NO: 7372 - DNA, 300 bp, Homo sapiens
aattccgttgctgtcgcttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaatcctg

SEQ ID NO: 7373 - DNA, 297 bp, Homo sapiens
  misc_feature 61, 64, 77, 100, 107, 116, 123, 130, 148, 156, 162, 164,185, 190, 193, 200, 208, 211, 219, 224, 225, 234, 235, 241,242, 248, 249, 263, 276, 277, 282, 290: n = A,T,C or G
aattccgttgctgtcggtcttgatcttctgacctcgtgatccacccgcctcggcctcccanagngctgggattacangcgtgagctaccgtgcccggccncatattncttaatganaactttnttgaaanccttcattatttctgtgnctttgganttaggnancagagattcataggtaccttnagaanganagaaatntctctacncanatgagtcntccanncctggaagnnataatnnaactgnnctcactactccaanctttaagaagctnnatgangctcattntaaggaa

SEQ ID NO: 7374 - DNA, 289 bp, Homo sapiens
  misc_feature 129, 130, 140, 143, 158, 159, 167, 168, 180, 184, 189, 191,193, 194, 195, 198, 199, 203, 208, 209, 210, 214, 217, 219,221, 222, 223, 235, 240, 241, 243, 245, 249, 251, 252, 254,257, 259, 261, 265, 266, 269, 270, 273, 277, 281, 282: n = A,T,C or G
aattccgttgctgtcggttgacccgccaaggcagcctcttcctccatagatggatgaacgctgtggccgctgctcctgcctgggccatgccctgatgctgccaacaccactgctcctctatttataagnnttagtacagntgnatgacccttcaatanntgaacagnngatatgttcctnacantaagncnannnctnnatangaatnnntcantgnantnnncataaatatatnccttnncnanatcnanncnttntnantagnnaanntcntttnattnntattctt

SEQ ID NO: 7375 - DNA, 294 bp, Homo sapiens
  misc_feature 111, 118, 129, 133, 135, 140, 142, 148, 152, 154, 160, 163,164, 170, 171, 172, 173, 174, 184, 185, 187, 188, 193, 195,197, 198, 203, 211, 212, 214, 215, 217, 218, 226, 228, 231,232, 236, 242, 243, 251, 252, 255, 257, 265, 267, 268: n = A,T,C or G
  misc_feature 269, 271, 272, 278, 279, 281, 283, 284: n = A,T,C or G
aattccgttgctgtcgagcctgcctgcccccaggtgaaataaacagccatgttgctcacacaaagcctgtttggtgtctcttcacactgactcgagtgaactttgatgccntggctantatattttcantatntnttatnanattatntttncntccttnttnntttttnnnnntttttaaagnntnnttttngntnnttttntttttttnntnncnntctttttntnctnnattntcttcnntatctttnntantncttttctntnnntnntgattnntntnncttttttgat

SEQ ID NO: 7376 - DNA, 300 bp, Homo sapiens
aattccgttgctgtcggcaaacaggtggccatgaaacagatggtcatagaattggttcagtggttgtgagtgcagcaacccaagagtgtcttatctgaaataccaccaggaatgtctggacacagtagacaaagttttttcaactggacgccttaggatacatgcttccaaaaacaaagtagccaaaaagaaaccagagtcacagaatatcagagccaaaggaacatttggaggtaattcagtacctcctccttttcaacctacaggggagatagtggaagagaagcagggatgggtctg

SEQ ID NO: 7377 - DNA, 300 bp, Homo sapiens
aattccgttgctgtcggaagagagcccgaaactaaacagggaggaatccaccatttagaagtctggcaggcaaagaggacaagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctc

SEQ ID NO: 7378 - DNA, 287 bp, Homo sapiens
  misc_feature 249, 251: n = A,T,C or G
aattccgttgctgtcgcagaatcttaacttatcttaatgatatttacctatcctttttgcaactcacaactgactttgtcacagaggtaatgcatctgcttgcaggaagtagctgtaggctcagtacctgttgtttgagtcagatttagcagatttggtttttaagcttgtgggtttgtgctaatttgggcagaatatatttattatatatgtgtgtgtgtatgtgtgtatgtgtgtgtctgcatacgnantacctgtacatagacacacatgcatgtggtcatcct

SEQ ID NO: 7379 - DNA, 300 bp, Homo sapiens
aattccgttgctgtcgccagggctgagaagataaggctacttataggggcgggaagcattgaagctggtttctggccctagcgctcccctgcgatgagatgtgggagccagtgtgtccctgcctgtccatcctgtgcacccccagctttccttgtcacctgaaaccacctctgagggaaggtggtggcgtctcagatgcatgggcatgtggctggtcaggtggcctccatcccagggtgccccgtctgtgtgacctccctctgggtgctgtgggcttgctccagggtgcaggtgcaaccc

SEQ ID NO: 7380 - DNA, 300 bp, Homo sapiens
aattccgttgctgtcggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccag

SEQ ID NO: 7381 - DNA, 300 bp, Homo sapiens
aattccgttgctgtcgggctgcagttccggctacctgtgtagtccgagtttccacagccaggtactactccgccagtgaccctggacagtaacaaaacatataaagcccgagcccaaaccccgccaccatcatagtgtgggaattttgctgtcctcgtggatcttcatatcttgccacaaggttcaaacaaagatacaagctggttttctgaacagaagaaagaggaagtctgtttactgttaaaagaaaccattgattcaagagttcaggagtacttggaagttcgcaaacagcacagg

SEQ ID NO: 7382 - DNA, 300 bp, Homo sapiens
aattccgttgctgtcggtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagtcgctgcacgtcagcccgcaggccaagggtccagcttatcctgggtgctctgtgatcagaa

SEQ ID NO: 7383 - DNA, 292 bp, Homo sapiens
  misc_feature 86, 89, 94, 96, 97, 99, 100, 105, 113, 115, 119, 120, 126,132, 133, 134, 135, 136, 137, 139, 143, 144, 147, 151, 161,163, 166, 167, 178, 186, 187, 188, 191, 201, 208, 210, 213,215, 218, 222, 224, 228, 229, 233, 236, 240, 247, 250: n = A,T,C or G
  misc_feature 260, 262, 271, 282: n = A,T,C or G
aattccgttgctgtcgagaattcggaagaagccgggacccaagcccggatggaagaagaagcttcgttgtgagagggaggagcttnccnccatntnnannttttnttaccatngnctgnnctttcntctacnnnnnntntatnntgngttntttttctttnantcnntttttttttantttttttnnnccnttgttttttnttccttntnttntnttntttntntttnntttnctntttngtttttntantacttttttntnttctttttntgtttattggntttttgttct

SEQ ID NO: 7384 - DNA, 300 bp, Homo sapiens
aattccgttgctgtcggtgaccaaaaggaaagggcaacagcaggagccctgttagtgctgccagaacaccaggaagccttgtgggaggcgtattgtccaagatgatgcgtattgtccaaacgactcagaagaagtcatttctgaagggttgatcataacttccctagccatgttttacctacagagaacttagttagaatttatgagtacagtatgttaaattacttttagtgtaccttaggcagtgtatttgttttgatacagagacaaagactatatgatccctgagacttgttgcct

SEQ ID NO: 7385 - DNA, 267 bp, Homo sapiens
  misc_feature 228, 239, 244: n = A,T,C or G
aattccgttgctgtcggtttttgtctgggcttgtctagcagtggaattctgcctgagttcatcatttttgtgactggtacttgaagtgcatcagatgattaatttcatgataagagggctttttggcgtggtgaaatagacatttatggaaaatgggatacccacattaagcagggtgactacctgtttaccatacaacccacacaaagccaatacaactatggatgngctttatatantctgntgcctctgcaaacattgaccgtg

SEQ ID NO: 7386 - DNA, 300 bp, Homo sapiens
aattccgttgctgtcgggaccactccagaattggccgctggcggtatcatggcgacccggaacccccctccccaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttctt

SEQ ID NO: 7387 - DNA, 300 bp, Homo sapiens
aattccgttgctgtcgctgaaagtaagagaaacagactctagctagtttaagctggaaaataaattattaaaactattctgtagctcatagcatctccagcagggctagagagttagccaggaataatgtcccaaaggtcacagccaagccagcctggcagagccaccctggacactgataccactgtttgccaatgccattgatttgggccctgggtggtggcactaagggctcactcccctaagcctctggaaacaggatttggctgtcaccaccctcccagggtgcatttttcttgg

SEQ ID NO: 7388 - DNA, 300 bp, Homo sapiens
aattccgttgctgtcgcaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgtgaaaaaagaaaaaagctcaaaaaaatccacaaaaagacaaaacacacaaaaaaaatcctgcctatattttactcagtttcaaactttattagtctatttttaattataaaaccagaaagctacaa

SEQ ID NO: 7389 - DNA, 293 bp, Homo sapiens
  misc_feature 225, 238, 246, 253, 257, 262, 269, 279, 282, 284: n = A,T,C or G
aattccgttgctgtcggcagatgacctcaaagcacaactggagttggctcagaagaagctacatgattttcaggatgagatcgtggagaacagtgttaccaaagaaaaggacatgttcaatttcaaacgagcccaggaggacatctctagacttcgcaggaagctggagaccacagagaaaccagacaatgtacccaagtgtgatgagattctgatggaagagantaaggattacaangctcgctngacctgnacgngctantccatgngtaattgganctngntattcatat

SEQ ID NO: 7390 - DNA, 300 bp, Homo sapiens
aattccgttgctgtcggagggcaggagcattcatctctgtggccacatgtttggtccagtgtctgacaaataacattcaacttgtaggaacaagtgatagcagagcatcctttctcaggaacaaggcccatcccctggtgagctgctccactggagtcccaggtccctaacctgtggcctaggtagaccttaggatttgcctcactgatgccaatgagttgctgctgcttacttttgaaacaaagtgttggcatgttccagctgctgcgattcaattgcctttcagacagtgtggtgccc

SEQ ID NO: 7391 - DNA, 284 bp, Homo sapiens
  misc_feature 169, 179, 181, 185, 186, 191, 193, 194, 196, 198, 201, 202,203, 205, 207, 209, 210, 213, 214, 215, 216, 218, 221, 224,229, 231, 232, 234, 236, 240, 246, 247, 249, 253, 254, 255,256, 261, 268, 270, 275, 276, 277: n = A,T,C or G
aattccgttgctgtcggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgncggctttgtnanaccnncgatntnntntntgnnncnancnngannnncnaancanttacntnngntngccntgtttnntnctcnnnnctcgncgttatntnatccnnncacatac

SEQ ID NO: 7392 - DNA, 300 bp, Homo sapiens
aattccgttgctgtcggtcccgggctcacagtggcacgactgaatcctcagagtcggctggcttttgagctctcacgatgggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccata

SEQ ID NO: 7393 - DNA, 300 bp, Homo sapiens
aattccgttgctgtcgggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcga

SEQ ID NO: 7394 - DNA, 300 bp, Homo sapiens
aattccgttgctgtcgaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacat

SEQ ID NO: 7395 - DNA, 300 bp, Homo sapiens
aattccgttgctgtcgaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtat

SEQ ID NO: 7396 - DNA, 300 bp, Homo sapiens
aattccgttgctgtcggtcccgggccaggagggtcacagatgcaccacaaggcactctgtgtggcactgggaacaggaattctgggagtcagtctgcaagggtggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcga

SEQ ID NO: 7397 - DNA, 300 bp, Homo sapiens
aattccgttgctgtcgctgaagatcacaataaataaaacagttgctgtcaatacaactccccttattttctctcaagtcacctggatcgtcctgaccccgggaaccccgtctgcagcaccaggccccctccgtggagaaaagatggagccggattaagcacccagtgctaaggcgactaagacgccactgcccgcaggccctgccggaaaatactcagagagtgcagcaggcgccgcgattccttagaaagtgctggcgtggcctctcctgacacagaaagccggctcctggatgcttac

SEQ ID NO: 7398 - DNA, 300 bp, Homo sapiens
aattccgttgctgtcggtgcgccagttcacactccgggtcagagttcctggcccggtgcacctgagaggtcgctctccgactcccgcgctggaccctcttgcgccattgaaccccctgatccgggggcctcggaccccagggctcaggagatggatccagtccctggcgctcctacttcccaactgctcctcctcccgcatccccacagtaccccgtcctcacagcgggctgtgggtccaatcagactttcccctcggattcctctctaggactgaaccaagacttacccgaagttgccg

SEQ ID NO: 7399 - DNA, 293 bp, Homo sapiens
  misc_feature 165, 168, 169, 170, 177, 194, 204, 205, 208, 210, 218, 221,227, 231, 232, 233, 234, 240, 242, 246, 252, 254, 255, 259,263, 264, 265, 270, 273, 274, 276, 278, 279, 280, 283, 284: n = A,T,C or G
aattccgttgctgtcgctgctatcgaactcatcatccttatggaggtcttcaggggccccagagacactgcagagagtgtcagggatttccttccccacaacagaattgctgagggtctgggaagcatggagggaggaagcagaattgcgggaccactggcgcantgnnnggatcangagctatacttcttccngaactgatcnntgntncctgcatnttntgcacnaggnnnnaggatnancttntaatanannctgntgtnnntcctnagnnantnnngtnngttctaagg

SEQ ID NO: 7400 - DNA, 300 bp, Homo sapiens
aattccgttgctgtcggagactgaaataaattgtatagttacttaactaatgaagacatttcagaactctgggatgattttaatcttgaagtagtaggtggtatagtcataaaaccattcatccccttcttgattgtatcttaattttctggctttaaggcgacatctgagaggtaatgcattcttttttatattgaaatcataaactatcacccgctgcttctctgagttacttttaattttgccttgtggttatggtttggcgtttccttctgtttggttttcagagccccatgtcta

SEQ ID NO: 7401 - DNA, 300 bp, Homo sapiens
aattccgttgctgtcggaaaatattagctactcaaataagtaggcttctgaaatagttttaactgcaagtgtgttaacttgtgtggtggtttgaagccatttttccaaataaagttattaaacaccactttatgtactgaagcatgaacagaaaaatcaagagctgagcagaccacctcctttatgtaggcaaaacttccatcattttggcttttgttctaaacagaactaaatgacatgcatagcatggtaacttacagatcgcttaattggagtaaaactcagagtaatagagggaaa

SEQ ID NO: 7402 - DNA, 300 bp, Homo sapiens
aattccgttgctgtcgcatcagccctgctttctcccgctccgtgactttgcatcagttgtcatgaggatgattaaataatttagcacttagccccctgctgtactccttggcctggatcatgaccacaccgaaggagtgcccaccagcaagagacctggagacatccccaattcctgcaagcagaatctgggatgaacagtctgcatgcctctcgccacctgtcccagggattccctgttccacaagacacttgggatctgcttgtcatgcatcatgcgtaactaatagtgcagaggaat

SEQ ID NO: 7403 - DNA, 293 bp, Homo sapiens
  misc_feature 138, 145, 147, 154, 155, 161, 168, 169, 173, 178, 179, 181,183, 186, 190, 191, 196, 198, 199, 201, 205, 206, 207, 208,209, 211, 212, 216, 217, 221, 225, 227, 232, 233, 236, 237,238, 242, 243, 244, 245, 246, 247, 251, 260, 264, 267: n = A,T,C or G
  misc_feature 268, 269, 272, 273, 274, 275, 277, 280, 283, 285: n = A,T,C or G
aattccgttgctgtcggttggaagatacggggataagattgacattgctgttgcagtattgcaaaaacatgactaaattggttaattatggctaccgcttatgtttaagagaatcctttcactaacttaaattgatancattgtngntgatatnnacaatnaatattnntccnaaacnntnanttnacanntatantnnanatcnnnnntnnatanntatntatntntaacnnttnnngccnnnnnntatnttatttttnttcnttnnngannnncngantgncntttcatat

SEQ ID NO: 7404 - DNA, 300 bp, Homo sapiens
aattccgttgctgtcgcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttcacaactctgtgttataggaagtataatgatgtctctgatctttgcaaattagaaaataaacaatattgtaggtggtccaagaaccaagatgacagt

SEQ ID NO: 7405 - DNA, 300 bp, Homo sapiens
aattccgttgctgtcgcagggcctggtgaagcacacaggaggctgccactgtggagcagttcgttttgaagtttgggcctcagcagacttgcatatatttgactgcaattgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgc

SEQ ID NO: 7406 - DNA, 300 bp, Homo sapiens
aattccgttgctgtcgccaaagtgctgggattacaggcacgagccaccatatctttaaaaatgtaatagaatggaaaatggcaaagcgcgctgcttttcatagaagagactatcgcattggggttcttctgttgcccctgcctgtgctgcacgtcctgcttcacagtgtaaagcgcaactcttgctgtgccttattgtaacaggtatagggtggatgctgccatcatgaagagagaggagagctctttgcttataaaattccgtagagtggagaacagggtgtgccggcttaggagaggg

SEQ ID NO: 7407 - DNA, 300 bp, Homo sapiens
aattccgttgctgtcggatggggagtcttgtgttacacgtctggcctcagccacaggtggggtgccggctggtcagcaggtcacctgccaccaggcccttcacctgcagatgggctccatcgcctgtggcctcgctggttaggctaaagggcagcccgggctcctgcgggttggagagctcatagcaggaatgtctgggcccaaccagttctcacaggctcctcaggagacagagcctggacttcgtgtcttagcctcatacttcaggattaggggggcatttgtttaagggtgtataag

SEQ ID NO: 7408 - DNA, 300 bp, Homo sapiens
  misc_feature 10, 12, 13, 16, 17, 18, 23, 24, 27, 34, 40, 41: n = A,T,C or G
gtgagcctgnanntcnnnttgannctnaaaagcnatggtnngtgctgacgctcaggcttccaggacgggctagatctccaaggggtccataggccctttatctgtgtaagagagtcctctttagcattttccttcagacccccatcccacacacatgctagccgcgctcagagcttccaggggtactagaccctgtgaaaggccatttgggcctggcctttgtgtcgggggcccctcttcgccacacgtcaggtctcctaaccccaccctggccctagcatcttccatcagagactctgc

SEQ ID NO: 7409 - DNA, 300 bp, Homo sapiens
aattccgttgctgtcgatgtattttgattctattaaggaatatgtcatttttatgaccttagactttggtctttgttggaatcctttgaaattggaatatggaagcccctctatcccaccattgtcagtgttgcatatccctagactctcttccagagtcaccctggggctgacttaaattctgggccacaacttcaaatggctgttaacgtttcccccgacccaaaacacacacaccccatgtctgacatctaagcagaaagactgggggttggggaggaagtcttggtgtttttagga

SEQ ID NO: 7410 - DNA, 300 bp, Homo sapiens
aattccgttgctgtcggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcacccagcgagactggagccagaccctcaacctgctgtggctaacagtccccctgggtgtgttttgg

SEQ ID NO: 7411 - DNA, 300 bp, Homo sapiens
aattccgttgctgtcgaatagagcaagtccagcctgagcctgtggtcggcagtggagaagagagggtcgcagacctgaggcaaagggcagcctgaacaatcaagaaccagagcagccctggcacccgacacccaggagagtgggctacaggaagaggatctgagaccagagcccacagagtctgcagaaactagaggcacaaggcacgaggaatcacaaagcaaacttaagtgccgacatcaaagaaggcattctcaccctgtttcctgcttctgggtttctccacattcctatagcctt

SEQ ID NO: 7412 - DNA, 300 bp, Homo sapiens
  misc_feature 20, 26, 40, 45, 46, 50: n = A,T,C or G
ttggccccttgggcacctanaagctngctacgcaggactncatcnngacnaattccgttgctgtcgcgttgttgtcttctaaacaaaaaaatcttttccccgggtctctctaccttcgtttttttcctctttacccctcagctcaaaactcagaatcctagacttttgactagctagtgtaactcgttatttacttccactaatgtctcctcccagttgatgcccaggtctatcgagtttgatcttattcttaagagatagaattggggagtagttcttccatccagtattgggtaaccg

SEQ ID NO: 7413 - DNA, 300 bp, Homo sapiens
aattccgttgctgtcgtcacaggagagtctagttgtaaacccgaagcaaggatggtagctaatatcgcagcagtgtttgtaagaggatttttagtttgtcatgcttaaacagacccctcagtattctcacagagaactgaagcaattcattttcaagactaacaagagcacagcatctgcatgcatgtggcaggtatgttagtgaatgttgtgaagtaggtggtcccatcagttgtcatggttcacctctgtccagactgtgattgtgtgactcgcagttggcacttcagcaaagcttag

SEQ ID NO: 7414 - DNA, 300 bp, Homo sapiens
aattccgttgctgtcgtctagctcacaactcgaaacctctgatcatgttctgtagagtacacccgctcaactgatccaatgcaaccaatacagtattggaagctttctacgaacaaggcacccagagagggctcggaggaagatgacagtgccaacgggcacagggagaatcgtgagcttactgcaccttcccagcaggcagagtgagcccgtaggacaagagccccctttctccgtttcccatctgccctgcagccccgaggaacggtccattctacagacaagaggcctgaggctcag

SEQ ID NO: 7415 - DNA, 300 bp, Homo sapiens
aattccgttgctgtcgtagaatttgacgttgtttgggtcaacttcctctatattcatcctgtcccccattccctataggctctaatgtttgtctctggtcacatgaggtaatgtgagttggatgcagttggatcagaaggagtttttgctagaagaaaaataaatcccaaagcacaaactgtactaatgttgggttctgtggtatcatctccatatccataaatcacatttgatttggatgccactggaaatttaatggcttaggaagggatgggtttcatatgcagagtgaaactttaa

SEQ ID NO: 7416 - DNA, 300 bp, Homo sapiens
aattccgttgctgtctagcagtggctgctacagggaattattcacatggcagcaagagagccctggctccctggaccaggacattccctttgtgtgtgttggaatgagagcaggaggagtgctggtcagaagcccctccccagggctctgggacttcagtgttctcagacaaactgggccgctcctctgagctgggatgctgacccacacttggccccggctctggcatccacaggacgctgccttatccgtcatctcgctggggctgggggctagaggctgagcaggtcacactgaaca

SEQ ID NO: 7417 - DNA, 270 bp, Homo sapiens
  misc_feature 129, 137, 141, 153, 169, 173, 175, 187, 204, 210, 226, 227,230, 237, 240, 247, 252, 255, 256, 262: n = A,T,C or G
aattccgttgctgtcgtgttacccctcattctgatgcagctcagacaggctgaccagcaagccagcgaggatgaggactgaggctcaatttggagacacgggcctatgtgacctcagggtgcaggcggngggagganttcnctcttatggggntcatgggaacaggggngggngngacttgcttggnggcctcattccatgtgngcctgngcctggggcatggacnntgntaagcanagncagctgngaggnccnnattctncagacgtg

SEQ ID NO: 7418 - DNA, 300 bp, Homo sapiens
aattccgttgctgtcggcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggttttta

SEQ ID NO: 7419 - DNA, 300 bp, Homo sapiens
aattccgttgctgtcggcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgcca

SEQ ID NO: 7420 - DNA, 300 bp, Homo sapiens
aattccgttgctgtcgggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattc

SEQ ID NO: 7421 - DNA, 300 bp, Homo sapiens
aattccgttgctgtcgggcagcagctgctgggtatttgagctggtctgaaagggtggaggtttccagtgatgtcactctctggcaggattgtggggggtggcttacgccaggtgagtctgtctattggtcctggttatgggcacttattaccaggcagtggcgtagggggtagggcctggagtgaggtggggattttaaagtgagcagatgccagaggtagtgagccaacagcagggctgtgctcttggcccccagcagagcatggttgtatagtatcagctgaggattggttccaggat

SEQ ID NO: 7422 - DNA, 300 bp, Homo sapiens
aattccgttgctgtcggtctatttactgttcttactaagaactatattttaggaggattgctcatccacttgaaggcaaaattggaactgagaagaagagtaaggtagtttcttccctgggtgatccacatctgagacagagagagctggaccaggataggactgaaggaggactgaggctgagagatgcagaaagcgctgtcagggaaggatcccttgagatggcaataggacctctaagtaggcgtgtaacagacaaggggagagcgcccttctccacaatgcagggattttatcatt

SEQ ID NO: 7423 - DNA, 300 bp, Homo sapiens
aattccgttgctgtcgaaaagaagttaaaacgttcccacaggcccctaaaagtcttgtgagttctggcattgtggttcacacatcagatgcccaagttggccctggtccgcagcagaggagggctttgatgggacttagggtatcacaggtgtgctctggctgttgtggggaacagactgtaggcagccagtgtggaagtgcagggacctggaaggggttgactgcactggccctggaaggccctggtaagaggtggtgaggttgaaaataaggttgggggggccgggcgcggtggctca

SEQ ID NO: 7424 - DNA, 300 bp, Homo sapiens
aattccgttgctgtcgccgctccgtggccacaggtccccgcaagaaagaccccgtcccactctctgaggtctcctcccagctccagaaaaggggacattccacctagtctgcccaacaagtaggtctcagccactgtgccaggagctcgggactccctccctccagaggtttctggaatgcattcagcaggaaaagctaaaagaacaggactccaggagataagccaaggccaagtctatcagagggtgagccagcagcgggaaggggaccagcccttcccctagcgttttttctgcccg

SEQ ID NO: 7425 - DNA, 300 bp, Homo sapiens
aattccgttgctgtcggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagaactggaagtccgcctggaggaggccctgtcagccgtaaaacttgtggggcccccgaagcatcgcttgaaatacacagcttgggcccaagataaagcgtgtaccaatggcccc

SEQ ID NO: 7426 - DNA, 300 bp, Homo sapiens
aattccgttgctgtcgtgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaag

SEQ ID NO: 7427 - DNA, 300 bp, Homo sapiens
aattccgttgctgtcgcgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagacca

SEQ ID NO: 7428 - DNA, 300 bp, Homo sapiens
aattccgttgctgtcgtccaagccacccccttcccacaacccctgttcctctggggaatacactgtttttgcactttacctccctaccagcagctctttccagattgcaggggcgagctggtgggaagcttgcagattgtttcgcactgccgtgtaatctgtgtgcttgtcactggggtctgttcttccttgagttggtacagtgaaatatgcattgagagtcccagggcagtcattgccactgtactttgtgggctggcttgccttctttattatttcttctttaaaataaaagaaaat

SEQ ID NO: 7429 - DNA, 300 bp, Homo sapiens
aattcgttgctgtcggtggaaccggccccactaacctgcatccagctgcctcttccacctgggccctgctctcagatggaagtgtcaccaaacacccagatcgccgtgctcctgcttctctggagtggacacaacctgaaaaccaactggactgagcatccttctcctaaaatctcagccagaagccacgatggagggtcctgggaagggaagagatgtgaagatttctgtgattctaaaaccttgggtctgcctgcaaacttctctctgatcccagccgagagctgtgcacacgctagc

SEQ ID NO: 7430 - DNA, 300 bp, Homo sapiens
aattccgttgctgtcgcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtaatgtagaaagcaacagaaaaaaggaaacggaacttcttggctctttttctaaaaatgaatcagttcccgaagttgaagccctgctggcaagattacgagctttataagttaaactggtttttaaaaaaaatgatt

SEQ ID NO: 7431 - DNA, 300 bp, Homo sapiens
aattccgttgctgtcgaaaaaatctgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttct

SEQ ID NO: 7432 - DNA, 300 bp, Homo sapiens
aattccgtctgctgtcggccctcttcactgcagtggggtggcagcagcacctgctcaggaagttggtgggcttcgctgggcgcacacggcccacctggcactcaccagcctccgggctgcccttggcaggtgccgtccacactccagcactcagggaggggcggtgcacatcctcaaaaactgaccacactggcactggcgcccaggtggtgagtaggcgggctgtggtctgcagacagaagctttaccctgtgcacatacgaggagtaactcatttgagtgacgtcactggactgcggc

SEQ ID NO: 7433 - DNA, 300 bp, Homo sapiens
aattccgttgctgtcgtaaaacttaaatacattacacgggttgtaaggacaaaggattttaaaatctgagcacttaggtgaagggacaagcaggtttatgtgtttaaacagaaagaagggaaaaggtactatgtgatatggtactgaaattttgatcccaatagaattcatttctcttacgttgaatccccaatcataattaagccgtatacacagattaaattaacagaagcatttcacataaatgttggtttcagtcatcaactacccatgaattcctgcccaaggatacttaatcag

SEQ ID NO: 7434 - DNA, 300 bp, Homo sapiens
aattccgttgctgtcggaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatgacttgtgccatgggtattcgcttcaagtcttactgctccaaccttgctcgcactttgatggttgatccttctcaagaagttcaagaatattataactttt

SEQ ID NO: 7435 - DNA, 300 bp, Homo sapiens
aattccgttgctgtcggttgtcacatcctgacagggtttcttataaggatttctcttcccttgtgttagaattacagaggatgaaagtattttaaaatctctgttgctgaacagggacatgtgctaggcagcctacaattgtcagttttattccataggtacgttagtggtcagaatgacttcttttttgatggcacaattattttcataatattagattgaattaagctggtgagacaatctgaccctaaaagattcagaaaatgacgctttgatgttagctttgaagcagggtattcc

SEQ ID NO: 7436 - DNA, 300 bp, Homo sapiens
aattccgttgctgtcgggattttccaagataatctacagccttttacgccatctcttgttcctgttaagtcttcaaataatgtggcttcaaagattttaaaaacttttgtagataggaaaaatttgggagataatactataaatatgccaccattgagtaccatcgatcctagtgggacgcgatccaaaaatatgcctattaaagataatgctttggttatgtttaatgggaaagtctatctgttggctaaaaaggggacagatgttctgccatcacaaattgaccaacagaattctgtt

SEQ ID NO: 7437 - DNA, 300 bp, Homo sapiens
aattccgttgctgtcgaagacctttatcttgctttcagggaacttgcaggtaaccaaacagataagacttgatggatgaaataaccacagtcagtgctagagttaatggtgtatgcagtaagggtgaaataaaataatgaaagcccataggtatttctaagggggctttctagattctacgattgatctttcatattttctaccttccactttacaaagaaaggcacattagccagacatcccaaatagtacattgtggtgagaggccttccacaccaccagagagacaaatcagaatgt

SEQ ID NO: 7438 - DNA, 300 bp, Homo sapiens
aattccgttgctgtcggacggggttctcaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttgg

SEQ ID NO: 7439 - DNA, 300 bp, Homo sapiens
aattccgttgctgtcggtgaggagaacatggatatggatgtaatgtccttcccttttgttttctttgcacaaatttcagtggaaacatgttgccaagtcagatcgccattctacttgagtgaatatggaatttgtccagttttccaaatgcagagctttttgtgggctgatggactgaatagaaagaggaacaaccatacacccttctacagatgaaggcaagattttatgaaagcgacttcattcgttctcctctgcctggtgttccttctttgtaaaccaggaccagggagctttgaa

SEQ ID NO: 7440 - DNA, 300 bp, Homo sapiens
aattccgttgctgtcggttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttga

SEQ ID NO: 7441 - DNA, 300 bp, Homo sapiens
aattccgttgctgtcgggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagc

SEQ ID NO: 7442 - DNA, 300 bp, Homo sapiens
aattccgttgctgtcggggtggtgaagggtgcctcttccatggtgttcccatgtttccattcttcttcctgactccagggccacttgacccctaagggcccttctttcactctggtctttcagagtgtctcagccttcacttccctttgtgtctctagaaatttacttacactcattattttccatctgggtttgagattgaacaggttcatctcccccattactgccaacccccaaaagcctgggtttctggagcgtccctgcctttttcatttttgcttccagaaaccatatacagct

SEQ ID NO: 7443 - DNA, 300 bp, Homo sapiens
aattccgttgctgtcgacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacc

SEQ ID NO: 7444 - DNA, 300 bp, Homo sapiens
aattccgttgctgtcggccttttaatagttccagtgaggtgagagctggatgaggtgggtacaacagaatcatcaaaaatctggccgttgatgggacctcagagtcacttgaggaagcaacatttgagcagcatctaggagccttctgggaaaagatggagaaaactaaagacgttaggtttattgcaaaccaatcaatcatactcactgatcacctactagaggaaacctgtgataacacttgtggggagatttatagaaagaagacgtatttgcacatcaggattttacatcatgatg

SEQ ID NO: 7445 - DNA, 300 bp, Homo sapiens
aattccgttgctgtcgttttcgcttggctactcagattttactaaagcaggtcacatggccagcctgtatttaacaggccaggaatgtataatcctgttttcagagagaagcaccaaacacaaggaacaataacaaagacactgtggagtgtcctaagaggcttggagcggtcataaaataaaactgtacccatgaatggatgaccatgtagatgggtcacctctccttgcgacctaactgaaaccacagtagaaccacagtagaaaccacctccaagtgaggttcctacaagttctgtc

SEQ ID NO: 7446 - DNA, 300 bp, Homo sapiens
atttgctgggggcctcccgagcctggagactgagtgacccacccctcctgcctaagggacgctatcttcaagaaccggaagagaccactcccacccccaccccgcccctgctttcgctcttctctgcaatggggtctccgaaaggagaagactgcagccctgtgaccctggaggtttgcgctctcctatgctgtctcaaaaaactgcctccttctaggcaagggcttccaaaccctcatcctgatctcaccttcagccttacccgccagctatgatccactcgactgtgaacttaaactc

SEQ ID NO: 7447 - DNA, 300 bp, Homo sapiens
aattccgttgctgtcggaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaa

SEQ ID NO: 7448 - DNA, 300 bp, Homo sapiens
aattccgttgctgtcggcctgggaagatatatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagca

SEQ ID NO: 7449 - DNA, 300 bp, Homo sapiens
aattccgttgctgtcgattctcacgtgttgttcccctcccgttctccagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccat

SEQ ID NO: 7450 - DNA, 217 bp, Homo sapiens
aattccgttgctgtcgcacaaacaacaaaaggattaggacagtccttctgaaagcaggggtctcaacatcaaatgtgacaacagccatacaggctttacaaatatgtagactggcctagtataagagaacagggagtgggcacatatttagcgcattgcaatgggcataaatacctgaagttacttgacccgtggaagagcccttgacagccatata

SEQ ID NO: 7451 - DNA, 300 bp, Homo sapiens
aattccgttgctgtcgtagaaacctagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaggttgtctgaaacaatttcagcttccaatgcctggaaaagtcattatgagaaaattgtaatagaaaaaaccgaattggaagtacagattgaaaca

SEQ ID NO: 7452 - DNA, 300 bp, Homo sapiens
aattccgttgctgtcgggacttgtaagaggacatggcaacctgtgagcccagactggatcctggaccagaaaaaggacactagtgagacaactggcagaatttgcataagaagcacggcctcggcctcgggtggtggagtcactgctgagcccatgacgttctgcttatattccatccctgcatttggaagtcgttctttgccaggaggaaagtgaggaaaaaccagcaataacaaaacagcagctctactgacggaggaggaggagcccaggaggcggctggtcagggcccaggtgtgg

SEQ ID NO: 7453 - DNA, 288 bp, Homo sapiens
  misc_feature 223, 231, 266, 276, 278, 280: n = A,T,C or G
aattccgttgctgtcgattgactccactttctcaaggaacacaggagactaagacaggcaaagatgcagcccagggagggaccatgtgggggactggtctaggtagtgagtccccacttggagcctctgtgatcccagaccatcatggaggagcagctggtactgaagcgggtggccaacatcctcatcaacctgtatggcatgacggccgtgctgtcgcggnccatccgntccatccgtattggctccgcaaccacgaccacgangttacttgtncnanaccttttg

SEQ ID NO: 7454 - DNA, 300 bp, Homo sapiens
aattccgttgctgtcgggctgaaaggcctacagattaaaaactaacactgcctcccctgcagtgagatagtcctttcattttagctccttgcattgaaatagcattgaggattaaatttgtgtaagccccacaaaattcaaaatttatgtgcttttctgaccacttgccttctagtggaaattttaagcatattagaggatatgtttctgtgggagctgatcagaatggtactaggagtacaaaagaatatctaaaactaaaacacagctatatttcagatcatactgcttcatcacatc

SEQ ID NO: 7455 - DNA, 300 bp, Homo sapiens
aattccgttgctgtcgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaat

SEQ ID NO: 7456 - DNA, 300 bp, Homo sapiens
  misc_feature 83, 85, 94, 100, 107, 114, 117, 120, 121, 126, 129, 134,141, 146, 156, 160, 165, 169, 174, 175, 177, 183, 185, 193,195, 200, 205, 213, 216, 218, 223, 225, 228, 236, 242, 247,252, 267, 270, 276, 278: n = A,T,C or G
aattccgttgctgtcggtgccactgcactccagcctgggcgacagagcaaggctctgtctcaagaaaaaaaaaaaaaaatcancntttttaaanccgatntactttntatgttnccntanntgggnaanacagnaatgagngggtnaaggcattgngtcnaaaanatgnggggnnancctgtngnacttgaangnaatcnttccntaattttnccncntaaananggnattaatanccagcnccacncctgngaggaaaaattttgnaangccccntntttacgggaaaatttaaaaaaa

SEQ ID NO: 7457 - DNA, 300 bp, Homo sapiens
aattccgttgctgtcggtatgattgagggaatgctgggaatgtgtgtaaacacatacatatgttgtcatgtgttaccttaattgacctatacagttcttgagtacaagattaaaacctgtttctgagtatgtgattgtatcaatgagggctctttctgatgtaaattttgagaaattcaaccttagttgttttaagtaagtaaaaagaaggtttattgatcatctgattgaaaaacctaaggcagggctagctatagatggttcacttgggccagtttcttccccagcatcctccttcat

SEQ ID NO: 7458 - DNA, 300 bp, Homo sapiens
aattccgttgctgtcgctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaa

SEQ ID NO: 7459 - DNA, 300 bp, Homo sapiens
aattccgttgctgtcgcaggaagtagccgtgtctagcgctctacaagacacataggagaggtggcatccatggccctgaaacgacaagcccatgttgccagcgcattatcaccaagtcacttggcaagcgtttagcagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaat

SEQ ID NO: 7460 - DNA, 300 bp, Homo sapiens
aattccgttgctgtcgttgtccttttctaatagttcgtgttttagaaattcagaacaaacaatttctgaatgctcctcagaacgccaactcaggcagagaatctcaccgaaatagagaagaagctcatgctcctggaagaaacagcccgaggagagccgctgggccacatctggccactgtccgcagcgctgtcagattgctggggccacatctggccactgtccacagtgctgtcagatccaaggagagccgctgggccacatctggccactgtccacagcgctgtcagatgccgacca

SEQ ID NO: 7461 - DNA, 300 bp, Homo sapiens
aattccgttgctgtcggatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccct

SEQ ID NO: 7462 - DNA, 300 bp, Homo sapiens
aattccgttgctgtcggtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaa

SEQ ID NO: 7463 - DNA, 300 bp, Homo sapiens
aattccgttgctgtcgcacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgc

SEQ ID NO: 7464 - DNA, 300 bp, Homo sapiens
aattccgttgctgtcggtgcaagcgagcctgacgctgtccacgtcgtgctggaccgccacctggtcacaggccagaatgccagctccaccgtcccggccgtgcagaacctgctcttcctctgtggcagccggtgagggcaccagggtgggcacattcctgccacatcagagctgcacccggtgcttttgcccaagctttgaccacacgtctgtcctgcaggaaatgaacctgctgggtagatgcaccccctgagacagcccaggtgtctccagaggcagccccgtctcaggcttcaggga

SEQ ID NO: 7465 - DNA, 300 bp, Homo sapiens
aattccgttgctgtcggctttcgccatcttcatccctacttactgtgcttccgctcccttgggtcccaggatcccactccttcgatgaaactcagtcttccatctctgcctggtgcttctgccctggtttctgctcaactcggcgccgtgtctctgttccccaaagttctgtttctgttctgtgctgccccctccccctgcccccgttttctcttttttaagagacaaggtctcggccgggcatgatggctcacacctgtaatcccagcacttggggaggctgaggcgggtggatcactg

SEQ ID NO: 7466 - DNA, 300 bp, Homo sapiens
aattccgttgctgtcgcagtcttcctctttgtctcatcagactgttatcactgagggttagatgagaaaatctcaaggctgtctgtctttcctaggccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaac

SEQ ID NO: 7467 - DNA, 300 bp, Homo sapiens
aattccgttgctgtcggcagtctgtagtctcgtaggtgctgtgtcatatctgctttctgtttggagctcagaattactttttaaggaattactttttaaggattaaaaagatttgtggttgcttcgtggctttgagaagacagtagagcattttcaggaattaatgaaggggagagatggctagaggagagggtgagagagacttgagttcttggctatgactatcaggtaaccaaataaaatgccctgtggaaatggggaccactgatggaccacaggcatgctgcacagttgatagct

SEQ ID NO: 7468 - DNA, 263 bp, Homo sapiens
  misc_feature 189, 192, 193, 194, 195, 209, 216, 219, 220, 221, 222, 223,224, 227, 232, 234, 235, 240, 241, 242, 243, 244, 245, 246,247, 253, 255, 256, 258, 261, 262: n = A,T,C or G
aattccgttgctgtcggtgaatccaaattaagggatagtccacaaaataactgacaatattctttagaagtgtcaatgtcatgaaaaaacaaagactgaggattcgtcccagattgagagactaaggggccacgaggactaaacacaacatgggaccctggactaggaaagggtggtgagtgggacggncannnngggtgagagggacngaaccanggnnnnnngcnatgcnannacggnnnnnnnngcgggncnnanaannc

SEQ ID NO: 7469 - DNA, 300 bp, Homo sapiens
ccatcgattcgaattccgttgctgtcggcatgtcccggtggacaggtgtggaagggactgaccctgccaccccgcggatctccccaggcttctgagttgctggcggttttccttccaactgcagtcccgcagtcctctcagccatgggccacacccccgggtctcagaccccgtgtttgttttcatgccaggaggcagctcagggaaggtcaggagatggggtgttcccagtcatgcccatggcatctctgcctcctcgggccccacctgcctcgccctgtggcctgagtcccttcagct

SEQ ID NO: 7470 - DNA, 300 bp, Homo sapiens
aattccgttgctgtcggtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactc

SEQ ID NO: 7471 - DNA, 300 bp, Homo sapiens
  misc_feature 117, 129, 138, 149, 151, 155, 156, 159, 161, 171, 172, 173,174, 175, 176, 177, 179, 180, 182, 187, 189, 194, 195, 196,198, 199, 202, 203, 205, 208, 216, 218, 222, 223, 224, 226,227, 231, 237, 238, 251, 252, 257, 260, 261, 263, 269: n = A,T,C or G
  misc_feature 272, 274, 280, 281, 284, 287, 289, 290, 292: n = A,T,C or G
aattccgttgctgtcgggtaatgaataatttatggacactgctggacctcagtctcctcatctgaaagatgagtggttggagaagtttaatggttttcaaatgctttttttttcagncttcaaataagngtttacgcngaaggaccttntntganntgntntttgtaaacnnnnnnntnngnttttntnccggnnncnnacnntnggncccccttnanaatnnncnntttnggtttnnaaatgagggaccnntgaanggnntnaaaatnccnangttacnnttnacnanntnaaggaatt

SEQ ID NO: 7472 - DNA, 300 bp, Homo sapiens
aattccgttgctgtcgctacactcagcctcattcagtttacagcatggaaactgtataggacctctttcctatagaaattgaagacacttaaataggaagaaaattaaaatatacatttggatacatgagtattccagtcaaataatatctataaaataccagatagagtataaaagacaactgaaggacaacagagtgatgaaaggactttattaggcatttggatttggttatgatttaaatttcaatttaattagaacgtttccatggcaaggaaggaagcatggaggactgtggaa

SEQ ID NO: 7473 - DNA, 300 bp, Homo sapiens
aattccgttgctgtcggagtgacctgttctcctgagtgctctagtgtctccagttgtcggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgag

SEQ ID NO: 7474 - DNA, 300 bp, Homo sapiens
aattccgttgctgtcgcctggattcaagtgatcctcccacctcagcctcctaaagtcctaggattataggcatgagccactgtgcctggccccctcatctgatagaaaattagattttgctatgagccatttcctgagggccaatttaatactcgtgtgactcttcttagagttaccatctgccttaaatttcctctgtttttcacattcttggaaatatatcattgttttgcaaatttctatatctaattcagggtttaccaggagcttaataattaatggctacatagcaaggcatcg

SEQ ID NO: 7475 - DNA, 300 bp, Homo sapiens
aattccgttgctgtcgaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtga

SEQ ID NO: 7476 - DNA, 300 bp, Homo sapiens
aattccgttgctgtcgcttctgttcctgatccgactcattcctttctaggtctgtgctgattgtcctagccttggggctccccaagactctgttcttgccactgaggctacttcttcctgaggaaaaataaatgataacagctgataagggcaggccatgaaaaaagagcagtcctagccaccccagcaccatcactggcaggctcccaggtgtaccctgcatcacaagagcttcccttcttcctatttgctgggagactaatcctcctcaataattctgtttagtatttacagtttttt

SEQ ID NO: 7477 - DNA, 300 bp, Homo sapiens
aattccgttgctgtcgaagaaatcctgcagctgaaacacttctctccaaatgtcgagcatctttatttatccaaatctctccacagtgtttgtttaaaggggagcgctggagagtaaactaaatcttacaatgagcatatggatggctataattgctgaggtttgtttttttttttcatatttgctaactcgctatatataaaattgggtttctattttatagatttcacaccctgaaaactgctaatttttgcatgcatatgattttcacatgaatggatgaaaatactaaaatctctt

SEQ ID NO: 7478 - DNA, 300 bp, Homo sapiens
aattccgttgctgtcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagg

SEQ ID NO: 7479 - DNA, 300 bp, Homo sapiens
aattccgttgctgtcggttttgtaggatcactgggatattttccacaacttcctcttctctagcacacacatctgttgataggaaatatttgagggtttttccactaccaaatgggagcttcatggtcctggtgtcaaacactataaacctttgaccagctgagctgtgactgctgtcacatatctgagtcctgtgtgcacagtaatatcctgggtcaggtaaaatccaggtcttcaagttttaaggattttttgaagaattcgggcttctttaagacgatccatgcccaaatccacaag

SEQ ID NO: 7480 - DNA, 300 bp, Homo sapiens
aattccgttgctgtcggctgaggggcttttgaaaaagagggtgccttactgtgccccagaccaggacaatcagtatttctggggaatggagcctggcacacacacatttcttaaagctcccttggcaattctgaggagtggattacatgttgtatgtagctcgtaacgaaagaaatcttgtctttgctctcagacccccatttcttactcatctcatgagctccttcgagatccagaaacagttgcatatttcattagtaaatcagttccagagtcacattttatttcacaagttagtcc

SEQ ID NO: 7481 - DNA, 300 bp, Homo sapiens
aattccgttgctgtcggtagtattgtaaaaatgtatctatatgttatcctacactaagcctaagctttaatgaggatattggtacctgactgtcctgtacttggagcatctgtccacttttgaatacatgtaacactttgatgctcctgtccccatggtttgatgaagtacttaataccttgaatgctatatttattatcaaattttgaatgaaatcactagcctaaatacaagtgagatgtttttgaaattttcatcacctttgaaacacctagtatttctgtagaattggattgagga

SEQ ID NO: 7482 - DNA, 265 bp, Homo sapiens
  misc_feature 241, 244, 247, 259, 260, 263: n = A,T,C or G
aattccgttgctgtcgctgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaagccacagctcagccaagtagaagagagctcctaataaatgaantcnggntgcctttgaatnnttnac

SEQ ID NO: 7483 - DNA, 300 bp, Homo sapiens
aattccgttgctgtcgatttcattgccctctttagaaatttgcttgatcttgggtcttgttcagggcagaaagagataatacaaggctttggtgatgcttagcattttagaagaagtaatgctgggtggaaatggatttggcagtctcgtttttcgcatcattggaatgggagtccctcacagttggagacaggatgaagtaacagagcgtggggatctggattaacaggtggccattcgcagaaaggaggctgcaaagcaagaggtgggggcttctggctgagcaggaaggtgggagag

SEQ ID NO: 7484 - DNA, 300 bp, Homo sapiens
aattccgttgctgtcggtttggtcttaggctaaaatccatgttttacggagaattcaagaaatttttaaacttcaggtagaactgtgttttttacaaatgtatagaaagcatagtgcctaatgcatggtagaaacatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacac

SEQ ID NO: 7485 - DNA, 300 bp, Homo sapiens
aattccgttgctgtcgggggtcttagttttcaaactctggcaactctgtgaaaaataggagcaaactagagagccctggagattggtagtagggaagggaggatagcaggaagtttgaaaaattagcagccccggggcctaaaggaatcagctgtcatcattttcatcattattattttggttaggatggcttgaaaatcagaacgtatcttggtttacgtaattgaggtcttaaagaactaagaacagttaaatagtcacaactaccaccctctgacttacataatcattggtgtgggc

SEQ ID NO: 7486 - DNA, 287 bp, Homo sapiens
  misc_feature 75, 84, 90, 93, 97, 102, 104, 107, 114, 118, 125, 130, 135,139, 158, 170, 172, 182, 191, 203, 218, 227, 260: n = A,T,C or G
aattccgttgctgtcgcattgcactccagcctgggcaataagagggaaactccgtctcaaaaaaaaaaagaaccntagtcgtcngggaanacnttantgcananacntgtgagngganacctganggaantgaanaggnaaggagttgtgctgatatntaggaggaggantnttccaggcanacggaaaanaggcccaaagtntttgaggaaggggcntgttggccntgttcacaggacagcgaggaggccaaagtgggnggagcaaagatcccagggggagaggca

SEQ ID NO: 7487 - DNA, 300 bp, Homo sapiens
aattccgttgctgtcggccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcgccctgaaaggcaagctaacgcta

SEQ ID NO: 7488 - DNA, 300 bp, Homo sapiens
aattccgttgctgtcggttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatgg

SEQ ID NO: 7489 - DNA, 300 bp, Homo sapiens
aattccgttgctgtcgtatacctctttgttatgatactgataaattgtgatcttgcagtcgatcactgattttctgtggtcagaggattcattattagcctcttcatggattctatcttctgaaacccttttttctttcttttcattgtgataaaaaaatcagcatatatgtgactaatctaaatgagagattgattgtgtgagaccactgaaaacaagcatatgtgagtgattccatactgatttttgttttaaaattgagcacgttttaaaaattttgtaaggctcggcgtagtggtt

SEQ ID NO: 7490 - DNA, 300 bp, Homo sapiens
aattccgttgctgtcggggtgagagagatggtgttctggacacttccccttggtgccatcatccctgctcctcctttccttcctctccccttcccatgaatgtggggcttgatttgttttaccccttaagtgggctgaagatgtaaagcttaacctcttccaaactagatgctttgaggttccagctgtcactgagaacagcttggtagctggtgcagcgtaccagcgtgcagaggcagcattgttcagctggagcctcactgctggagcctcatctaccagagggctccttccatactg

SEQ ID NO: 7491 - DNA, 300 bp, Homo sapiens
aattccgttgctgtcgggaacactaatggccctccctggaacagacacggcgcccccccacagaatagcctcgatgccccctggaacagcctcggtgccccctggaacagcctcggtgccccctggaacagcctggtgctcctggaacagacacagcccccccagaacagacacagcaccccctggaacagcctggcgcttcctggaatggccacatccccccatcctttctgtgctgctttaggcatctgcccttacgtggttcgtgtccagctctgtcaacaaggccagctccacaag

SEQ ID NO: 7492 - DNA, 300 bp, Homo sapiens
  misc_feature 27: n = A,T,C or G
cacctcttgttctttttgcaggatccntcgattcgaattccgttgctgtcgaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgtt

SEQ ID NO: 7493 - DNA, 300 bp, Homo sapiens
aattccgttgctgtcgaaaaaagttaaataatcaaaaatcattcagaagagagtaccttaaaagacccatatacctctgagaatttagaatgttacaaaaccgtatttcataccaatggggaaaggataaactcttcagtgacgaatattagaaaaagttagttatacatttgaggaaaactataaaagtaccaataatgagtaggaaatcacttctgcagtatttttggagcattttccttaagcatgacataaaagccaaaggtcacaagggaaaaaactgatagatttgtctgtgat

SEQ ID NO: 7494 - DNA, 300 bp, Homo sapiens
aattccgttgctgtcggtcatgtggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagctttttgatggtgggt

SEQ ID NO: 7495 - DNA, 300 bp, Homo sapiens
aattccgttgctgtcgtggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggac

SEQ ID NO: 7496 - DNA, 257 bp, Homo sapiens
  misc_feature 97, 124, 127, 147, 150, 156, 159, 161, 162, 163, 165, 166,167, 174, 179, 182, 183, 185, 188, 189, 190, 191, 192, 194,196, 198, 204, 205, 214, 218, 220, 221, 222, 227, 228, 230,232, 233, 235, 236, 238, 243, 245, 247, 249, 250, 255: n = A,T,C or G
  misc_feature 256: n = A,T,C or G
aattccgttgctgtcgaactttctttgcctccctccccacagaagcaccagacccacctgagccccagagcctcatgccagcagctcctggctgttnctcacctgaggctagagcagcagctgncancttatagatggggcgtatgntanttaatnctntnnnannntcctctnataangtnngnttnnnnngngntntctttnnaatacgatntgcncnnnctatnntnannanntnttatncnantnnatctnna

SEQ ID NO: 7497 - DNA, 266 bp, Homo sapiens
  misc_feature 243, 244, 245, 248, 251, 252, 261, 262, 265: n = A,T,C or G
aattccgttgctgtcgcactgaagttttgttttagacactttgggcttcgctgattgaaaacaccacaccaactgaaaaatcactgtgaaaaagaacctggtagtactgtcaatatcaagtaggattcattaattttctgacattactggacaagatggttcgtgccattcagaaagctctttttctttcttcttctttcctaatacagtgaggcatacaacgtagcctgccttatggttaannngcntgnngactttatnnttnc

SEQ ID NO: 7498 - DNA, 300 bp, Homo sapiens
aattccgttgctgtcggctgcggccggtttggcccttctttgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatga

SEQ ID NO: 7499 - DNA, 300 bp, Homo sapiens
aattccgttgctgtcggccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatg

SEQ ID NO: 7500 - DNA, 209 bp, Homo sapiens
  misc_feature 171, 172, 181, 184, 188, 198: n = A,T,C or G
aattccgttgctgtcggcctaagatttcttgtgggccaaggaattaattattccaatcagaaatggaggccttacctcatttgggcaaagattagtgctagttattgaagatttactaataaatgatctgttaaggaatttagttttttttggatatgttgttttggttgnngaaaactanggnatanttataatagntattttttgaa

SEQ ID NO: 7501 - DNA, 300 bp, Homo sapiens
aattccgttgctgtcggaatgatcaacttgttaactattgctgagatgctgtgtaagaagactgaacatttgccatttggtgatgtggaagctgttgagcttcactaaatggtttccacggagtggaggggaaaaggcttgtttgagtggcctcaaatgaaattgggaagagagggaagagacagtgtgagtataaatggttccttttggaaattcagtacaggagagcaaagaattatagatcgaggggtataaggagggtcaataaattttaagagaggatccattattcatcagttc

SEQ ID NO: 7502 - DNA, 300 bp, Homo sapiens
aattccgttgctgtcggtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtat

SEQ ID NO: 7503 - DNA, 300 bp, Homo sapiens
aattccgttgctgtcgcttcagttaagtaaagaagcagccccataagcatttttgtttgtccgtaattggccctattgcagaaagaaagaaagaaagttgccctcaaatgcgtgagacagcatggcaggctagggtgtaacagatgagttctgagcagggaaggtgaatgaagcaagtggatccttggaaagataaggtaaagaaaggatgttagttggaaactagcaatcaggaaggtcagctgctgcctggtctaggtagagtggcagggcagaggagggcttggctggatatggtaa

SEQ ID NO: 7504 - DNA, 293 bp, Homo sapiens
  misc_feature 207, 213, 217, 226, 227, 233, 235, 237, 246, 249, 256, 262,275, 280: n = A,T,C or G
aattccgttgctgtcgatgtgtctctggtacagaatagttgatattaacagaaaaaaaaaaatctgtagcttcatgaatatgccactctgttaatttcttgttccagacattttaatagagattgcttgagccatgttgtttgaattgctgccaatagcagaccatatccctatcatgttgttggctcaactgtttttttttttccntaatanaaanggagtatcnntgggtngntnaggctggcnttnaactccngggctnaagctatcctccngcctnggcctcccaaagt

SEQ ID NO: 7505 - DNA, 300 bp, Homo sapiens
aattccgttgctgtcgaaatcatcccaaacaacgcattattaccatatacatcaggatattaggagcccaatatagtgatccagattgagatcctcttctttttgtatgtgtctggattttgtttgctagggttttcaggatttttgtgtatatatgcatgagatactcatctgtagttttcttgtgatgtctttgtttggttttggtatcagggtaatactcgcctcaaagaatgagttgggaaatgtttccttctcttctgttttttggaagagtttgtgaagaattgatcattcttt

SEQ ID NO: 7506 - DNA, 300 bp, Homo sapiens
aattccgttgctgtcgctctccgcagtgagaacctgccttggctcccctcccctcaaggagttcatagccgtgggagggagggagacaagaactgttggagacaagaactgttagagaccagagagcaagggcgtgatgtggtctgcagggaggaggctgtctgaggcagaaccgggtcagggaggccatggtgcgggtaccctccaggcacggcatttggcctgacttttgaggggtgcccagggttggctacatggcggggcggaggtatctttagtgggggaacagcgttgtgccac

SEQ ID NO: 7507 - DNA, 300 bp, Homo sapiens
aattccgttgctgtcgtaaaaataaaataaaaaataaatgtgggcaaaaatgtgcagtgtgcagattcagcatcagatacgtctggagtgcctcgggcatattcattgctactgttgatttcgtgctcctgtttctgccctaaatgtgtgccacactgacgaccacagtgtagcccctagtcccgtctccatctaatctctccctcatcctaaaggctcagtctccagaacaaatcctacattgtctacctgtcacctctgtcctagcccaggacaccccccactccctggacacctgct

SEQ ID NO: 7508 - DNA, 300 bp, Homo sapiens
aattccgttgctgtcgaacaatttttagagaagaagaaagagaataaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaag

SEQ ID NO: 7509 - DNA, 300 bp, Homo sapiens
aattccgttgctgtcggaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaa

SEQ ID NO: 7510 - DNA, 300 bp, Homo sapiens
aattccgttgctgtcggtagactgagatcagtgtgtaggggtgaagcaaggagtcctactctgtttgactaaggtaaaaattaagaatcagtgagaaatggaatttgcaaaagtgcctgccagataatgttagaactggaccagaaaataggagttggtataaaactagaccagcgagctttttttccttcaagatgcagttcagtttattgcttttgtaaattagagattgtgtttcttgatctttattaaagtagaatacaatgttaacctacttcaaattttaaaaaatatacacac

SEQ ID NO: 7511 - DNA, 300 bp, Homo sapiens
aattccgttgctgtcggttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaaatagataaagatgtggaagacaaaagacaaaaagccattgaagagtttttcactaaagatgtcatcgtaccctctccttggactgatcatgaagggaaac

SEQ ID NO: 7512 - DNA, 300 bp, Homo sapiens
aattccgttgctgtcatgctgaggttgttaaacaggccccatgtagctgtccccacattggggtttgctttctacttcccaggtgtttctcagcgtgagagtttagtttgctttgtgctgctggacaggttcctgcagaatggcctgttgtacgagttttaagaatttaaatcccattacacagccctgacttcttatttgctagttctttccatcattcatttattttatccacttggagttagtctgtggctgccatgtgtttgtcaggtggcagaggatgagagatggatgaaaagg

SEQ ID NO: 7513 - DNA, 289 bp, Homo sapiens
  misc_feature 281: n = A,T,C or G
aattccgttgctgtcggcaagctcgggggtcaaaccgaaacatgcaattcactaaaatctttcaggaaaaaatgactttaaatactgtcatcataatcccactttgtacctccttctcttttcatatccatgctcaagtggaagttaacaaatccctgcccccagagagctgcccaaagcatcacgttttagaaactgtcccagaatttccaaactcatccaaaagcaagtgacatcaagtcagatattcttggtgctagaaactcagaaaaaaaaaaaanggggggtc

SEQ ID NO: 7514 - DNA, 300 bp, Homo sapiens
aattccgttgctgtcgaaaacatattagaactaacaaacttacaatggacatttaatagtggttttcctttctattctattttttaaaatgtaaatggagtaaatgataaaatgtagactgaatttatcataaagacattttcttttggtatactgcaaggaactatgaacttttagtaactactataagcaactgacaggaaaaaatggcaacagaagaaggaaagaggagagaatggggagcagacactaaggtgtagtgaaaggaggaaaatgaaggctaagtctaatgatgtgaat

SEQ ID NO: 7515 - DNA, 300 bp, Homo sapiens
aattccgttgctgtcggctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcacccaaaattttgcatcagaagattcagtcctagtg

SEQ ID NO: 7516 - DNA, 263 bp, Homo sapiens
  misc_feature 149, 163, 164, 167, 179, 182, 183, 185, 188, 193, 195, 198,201, 203, 208, 213, 215, 222, 224, 226, 227, 235, 238, 241,244, 250, 252, 253, 257, 259: n = A,T,C or G
aattccgttgctgtcgaaagccgattcatgtactgatgccaatcagctagagcaatgtaggctttttttaatttaaattattactacactttattactacacttgcagaaaagaaacatgttaaaatcatggcacacctgcagaatttnatatgacagagtgnncanatcatgtattcntgnntntanaatancnttnttncnctacntcttntntttcctnanannatatctantanttnttnagtctntnnttcnanaaat

SEQ ID NO: 7517 - DNA, 300 bp, Homo sapiens
aattccgttgctgtcgcagccacaaagctcctgcccatggggcgctctgaggggcagactgcctgttggcggagtcttgtggggtggaaatggtgaggtcactgtgatgccactttgcttagtcatcggccacagggtcacctggagaagagcatgagctcagcataaaagcaaggcccaccctgcaggggccagcagctgggagctgtccactaaccactatccttgcagctggacagcgaggcccctccaaaaggccgtctccacctgccaccgggaaaggacccggagcgaaggatg

SEQ ID NO: 7518 - DNA, 300 bp, Homo sapiens
aattccgttgctgtcgattatagccttctataaaacttataaaacttgcttgtaaaattccatatagagattgcaactgagagttggtcgtaaaactaaaaatattgttgggaacagagcaggtcaaaactcccatgattgatctaataatggaattatactggtaaaaagccactgcacttcagcctgggcaacatggcaagactctgtctctaaaaagagacaaaacagcataaaaatatgcttgatataaactctagccctcttctagttatttgttcatttgtacattttcatttc

SEQ ID NO: 7519 - DNA, 274 bp, Homo sapiens
aattccgttgctgtcgagactttgatggttatgaatggaaccaagttactgagttagagcattttctaattaaatatgaaataggagctgaaggcataatttattgattagaatgacagaaaatgtttttatgctgtacatgccttttgaacatttttcaaaatacttgtaactttgaagaaagtgtgtatattgttagaaggctgtaaggagagcaggtctctgctctggtggtgattttactcaagaggggatgtgaatatttatatttttg

SEQ ID NO: 7520 - DNA, 300 bp, Homo sapiens
aattccgttgctgtcggagaaacccaacacatgtaaggaagattagaatgtatgcaattttcctagttcccttctaaaacttagaaggacccgtcctgggaaagaacgtcataaaatacgaaaaatgtgttagaacactttattttcccagccgctttcaaatatatttttatcagtggttcattgttaaagaaggtgtctatactttagattttcagttttttgcagggaatcatggagctgagaatttcacagatactttataagccatagtacatgagcttaataggctgtgttttg

SEQ ID NO: 7521 - DNA, 300 bp, Homo sapiens
aattccgttgctgtcgattatatgccacctgggtttacagtgtagtctcttatcaggtaggtttgttctgagatgtatagtaatgatgactttcttcttcgcccaagtattttgtgtaccttagaccagtttagcaaatgaagtccaagaactatttgaataagtcattcttagaaaataactttaggaagcaactgactccattcatgtgtatgcctctaattgtaggttcacttctgtccgaatatgaatttttaaaataattttagcattatattagcaatttgcaatataccattt

SEQ ID NO: 7522 - DNA, 300 bp, Homo sapiens
aattccgttgctgtcgcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaa

SEQ ID NO: 7523 - DNA, 300 bp, Homo sapiens
aattccgttgctgtcgctgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgctt

SEQ ID NO: 7524 - DNA, 300 bp, Homo sapiens
aattccgttgctgtcgctcaactgaccgttggatttgcaatgtggacctgaagagtaattgtggtgaagttgtgagaatgaaactgaagtgggttcaagaaagaacgagaggagagaaagtggagtttgagtataaataactcttttggagaggattggtgtaattgaatggcaggggtatgagatttgaggtcaaggaaatatttttattattttttacgatgagagaaattgtagtacacatgtatatttatgggaatgactcagtagaaagaccaaaaatttcatatgtgagagaag

SEQ ID NO: 7525 - DNA, 300 bp, Homo sapiens
aattccgttgctgtcggcagaggggagaaggtgtcccaggaggagccttcctggaggggatgatagtccagcatgttctgaagtgggagtagggtgcggcaggagtagggtaccagagaatgagtgagtcaggcagcagcctccactgcgccttggacacaggtggctgacagtgtccacctggactggctttgcaccccttctgaggtcacagttgtgtcccttgaaaacttgggcaggagcacctgactggcccagcttgggtcatccctaggcccagcagtgcgggaggccaggaaa

SEQ ID NO: 7526 - DNA, 270 bp, Homo sapiens
  misc_feature 224, 225, 226, 228, 233, 242, 247, 248, 256, 260, 262: n = A,T,C or G
aattccgttgctgtcgcactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgaggggtgcccannntnatggncactgtccnttcanntagcctgnctangncccctgag

SEQ ID NO: 7527 - DNA, 300 bp, Homo sapiens
aattccgttgctgtcggtaatgtttcacttcttgaaccatgtaccaaatttgccaattttctgtccaagtgtttcagatgaataacaaaacgctgttcattgaagctttcgccacctttcttaaagcagcgtatgttccaagggaaaaaggcattgaaaagcaatcgtttgtttttatgaagaataggtgttcagattccttcagtttttttgaaattagaaatttcttaccttatgtgaaatattcacaaacgtgcacacttctgcagagacaaagcatttcactgcacgtgtaccagg

SEQ ID NO: 7528 - DNA, 300 bp, Homo sapiens
  misc_feature 280, 292: n = A,T,C or G
aattccgttgctgtcgaaggaattctgtggctgtgctgcgtttcagaaaataacccccagaggccttgggctgtggacctgggggttggaaggatgggggctcatttaaccctcagaggcagcgcctttgtctgtctatctggtgacaagagagagacaagtaaatgggggccgttgggacggcgggtgcctggagggcagctctgggctcatcgggcagtgcttagagcacaggcccctctgttgggggatggggaggagagcagtctgcccttgggancgtatgccccanggagactt

SEQ ID NO: 7529 - DNA, 300 bp, Homo sapiens
aattccgttgctgtcgggctgactcctgcttttttggagggtttaacttctctctcagctagaaggttaggcattgcaaataccagtggataatttttttcttagctttaaccccagcccatttcaaccccctctttgccctttgtatattcttttgaaaatatgatccagtagtgtttatgaatgtgtgttgtgtaaaatttagagattgatgttaaacaacagaattaaaggacaaagctgtcttttttgttggaattggggatgggagagcagctcaaagtgggaaatatggagaaa

SEQ ID NO: 7530 - DNA, 299 bp, Homo sapiens
  misc_feature 171, 173, 175, 178, 180, 185, 191, 193, 195, 196, 200, 201,202, 204, 206, 209, 210, 212, 213, 216, 219, 226, 227, 234,237, 240, 243, 246, 247, 248, 250, 251, 259, 261, 262, 263,265, 275, 277, 279, 281, 287, 289, 290, 291: n = A,T,C or G
aattccgttgctgtcgctttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttncntnccncnaagcnaaaccntnannaaannntngnggnntnnaanggngggccgnnttttccnccngtnggnatnnnanntaaggggncnnngnaaaaccaaancncntngaaaancnnnggagggcc

SEQ ID NO: 7531 - DNA, 300 bp, Homo sapiens
aattccgttgctgtcgggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgaga

SEQ ID NO: 7532 - DNA, 300 bp, Homo sapiens
aattccgttgctgtcgattttatatgttttctcctatatttcttgttttcatccaggactactagattccagtaagaataaaattaaacattagaggtttgtcttccatgttgtttaagaaaattagtttccctttttaaataattactaatatttgaagattatgaatcataaattaatcacaagtgccatacctattattttagaagcaattgagcaatataaatggtcttcagttttaccagttcttgatctgtagtaaattccaggggtggtggggtctgtgaaataatgaagaaa

SEQ ID NO: 7533 - DNA, 300 bp, Homo sapiens
aattccgttgctgtcggtcaaatttcatcaggtaagaagtgctaaagtgaacctgtaaactttgtttcaaaaaacaaaaaccgaagtttaagaaatctaaagatggtgtcagccttagacagatctctggactgtaatctgggaaaggtcaaataagatctccaatcgtgtacaattccaaatacatttgagagcagtgggtctgaaaatgtggttcccagaccagcagcatcaacaccatgaaggaagttgttaaaaatgcaaattctcaggctctcccctgtgctttaataaagtttc

SEQ ID NO: 7534 - DNA, 300 bp, Homo sapiens
aattccgttgctgtcgcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttca

SEQ ID NO: 7535 - DNA, 300 bp, Homo sapiens
  misc_feature 251, 256, 258, 267, 269, 272, 286: n = A,T,C or G
aattccgttgctgtcggagagtggaggccagagaagaccaaagctgaggaatgcgacctcaggatttccttctttctggggatagttctctttaggaggaagaggagttagcccctcacttgcttatccctctcctatgctctggagttcctctccacccttgcccccaccccacattgccccctcctgctcggtcagtgcctggccagctcaggcagcttgcgtcacagtaaggtaaagccagaatgagnattangnctgagcganantgnaaaagccattcctntgaccctacccacc

SEQ ID NO: 7536 - DNA, 300 bp, Homo sapiens
aattccgttgctgtcgcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccaggtgcggtggc

SEQ ID NO: 7537 - DNA, 300 bp, Homo sapiens
aattccgttgctgtcgtcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggatt

SEQ ID NO: 7538 - DNA, 300 bp, Homo sapiens
aattccgttgctgtcgaccccaaccctctctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaaga

SEQ ID NO: 7539 - DNA, 300 bp, Homo sapiens
aattccgttgctgtcgcactgaatgacttaaggctcgacaaatgatattcttggaaagtttaatcttgaggttttcaaatctttttttttaatgtctcccatgtttctcatttgctgattgattcattagttgctcttagtaagatttgtcagttggaaataatgaaggctgagactcatttctaaactcttccataaccatcaccagaagagcagccactgtgttgtgtgatgtaggctaatgcctcccagatagaggtaaagtcacaaggactattagaattccagtggattgtggaa

SEQ ID NO: 7540 - DNA, 245 bp, Homo sapiens
  misc_feature 239, 244: n = A,T,C or G
aattccgttgctgtcgggaagacagcccagaagcttgctattcagaaggctttgtcagatgcattccagaaactgttgattgttgttctagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcancttgna

SEQ ID NO: 7541 - DNA, 300 bp, Homo sapiens
aattccgttgctgtcgataccacctccttgcttggtatcttttacaaaatgttatactttatggatataaaggtgataaagattggaaataaatcttctaaatatgtaaaatgaaagcaacagcaacagcaaacacaattatcgtattctttgggagtaacaaatactggttttcattttaaaactaaggaaaattttatcagtacttaaattcaatccaaaaaaggttttataacacccaaactgtacatttaaaattatgctttcttaaggtaatggctagcattacctagtttgtag

SEQ ID NO: 7542 - DNA, 300 bp, Homo sapiens
aattccgttgctgtcgatattgttcaataatgtcctttcatttgtttctgattggtttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgtttccatttgtttgacatttgtctattatt

SEQ ID NO: 7543 - DNA, 300 bp, Homo sapiens
aattccgttgctgtcgggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagta

SEQ ID NO: 7544 - DNA, 300 bp, Homo sapiens
aattccgttgctgtcgactattaactaggcttcagtatatcagtgtttatttcattgtgttaaatgtatacttgtaaataaaatagctgcaaacctagttaatagtagtgtaacaatatgcatcattttgatgattacattattttaaacaacaaactacactgaaaaattaatgccgataaaattctgggggtgggaaggtaggatgtggagtgacatggttctatcctttacttatgagactcagaaatatatctacaaagccagatgctctgtcttcatatttgcagacatctagac

SEQ ID NO: 7545 - DNA, 300 bp, Homo sapiens
  misc_feature 184, 201, 212, 225, 239, 247, 262, 263, 269, 274, 279, 289: n = A,T,C or G
aattccgttgctgtcgatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgngattatttgaatagttntatattaatanaagaagacaaaantttttaaatgttanaaaaagcngatctgtcattgctnngtatcntaaantttangcttttatcnatgtatatttt

SEQ ID NO: 7546 - DNA, 300 bp, Homo sapiens
aattccgttgctgtcggctgttcaacattacttaatgacttgaaaatattttttattagttgtagaaaactcaacaattttcaaatattgctttggctacattcaccttcattcctctgggattccacttaacatttattaggtctttttgcttaattccctatgtctcttctatactttcctgtattttctactcttgtgtctcccttcactccaagaatttacttcttttttgtttgtttgtttgtttttgagacagggtcttgctctgtcgcccaggctggagtgcagtggcatgat

SEQ ID NO: 7547 - DNA, 300 bp, Homo sapiens
aattccgttgctgtcggaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcgggga

SEQ ID NO: 7548 - DNA, 300 bp, Homo sapiens
aattccgttgctgtcggtcccacccccacctcgccggagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgca

SEQ ID NO: 7549 - DNA, 300 bp, Homo sapiens
  misc_feature 177, 190, 232, 234, 239, 240, 247, 276: n = A,T,C or G
aattccgttgctgtcgaaatcatgtacagaattgcaagagacccacggagaattatctaccaacaatatgcatcatagaaatttagaaaacagaagaaaagtcactacagtcctaccactcttactgttacggtattagaaatatatatagtggatagccataagtataaatgatcncatatagcatgtnttttataaaaattggtttatactgtacattctatcttgtgangngatgnntttcacntgccactgtatcatgcccatttccctctntctgctgtctgtattcttcttgat

SEQ ID NO: 7550 - DNA, 300 bp, Homo sapiens
aattccgttgctgtcgggaaaactacaggtgttgtccaagctcttagcggttatccacgaacttcgacctactgaaaaggtggtgttggtatccgactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaat

SEQ ID NO: 7551 - DNA, 300 bp, Homo sapiens
aattccgttgctgtcggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttacc

SEQ ID NO: 7552 - DNA, 300 bp, Homo sapiens
aattccgttgctgtcgaagaaaattttctatgattataatattccaagtaagtttctcttttgagatcatttgtctattgtaggaagtcaggtaaataagtttagttttaaaaaacaaaaatttctcaaatcaggattctttctgaccctttaatctcagataatgataatagagtattatttcaaggattccccttctagcacaatcttgctcaagatcaggccaagaatatagacaggttcagtaaaccacaagtgctctaaacctgcttgaacctatgtaagaactgagcagtgggg

SEQ ID NO: 7553 - DNA, 297 bp, Homo sapiens
  misc_feature 154, 155, 159, 164, 165, 167, 172, 181, 182, 183, 190, 197,204, 207, 212, 218, 221, 224, 228, 229, 246, 247, 250, 256,259, 260, 263, 266, 267, 268, 273, 274, 280, 282, 287: n = A,T,C or G
aattccgttgctgtcggtagagacgggtttctccatgttggccaagctggtcttgaactcctgacctcaagtgacccacctgcctcagcctcccaaaatgctgggcttacaggtgtgagctactgcgccaggcctaatatcttttttttttttnnaaanaaagnntngtttngggcccagnnngaagtgnagggggnaaatttnggntaatngaaccntcngcntccnnggttaaaaaaattttcnngcntaaccntcnnganaannnggaannacgggntngcccnacaaccccaa

SEQ ID NO: 7554 - DNA, 300 bp, Homo sapiens
  misc_feature 256, 260: n = A,T,C or G
aattccgttgctgtcggattttttttttctccagaggcttagcgtaggtcataccccagatgttgatgatgaatatattgattgctatctcagggcgaaatctcaaaagtttgtgttgcccttttaggaatttcacagtttatattgacctataaccaagaggcaggttcattatgtttaattgcattaaaagataaaagaagtagacaaattgaaaggaaaaagagcccagagattggtacctttttatcaagcnacancatgccacaaactttgcatacataaaaaataataacctga

SEQ ID NO: 7555 - DNA, 300 bp, Homo sapiens
aattccgttgctgtcgctctacttttaaccagtctcataaaatgcctggggttcataggtgaagctggattgttgcaggaattctgcaattgttggcaaagcgaagggcagtttgactccttaattataaagttggatgtcatttgagaaactctgggaattggaagtagaacaaattcatactttccctataacttttaatttcttgtcatacattcagaaaacaagagatgtaaaattcataaaactgcttgtataaattcagaaaacgggattataaaagcaaagacaaattgtctt

SEQ ID NO: 7556 - DNA, 300 bp, Homo sapiens
aattccgttgctgtcgatataacccaggaacgtgacagtcttatgtgtttggcaaaatgtttagaaagtgagaaggatggagtgcttaataaagtcataaaaagcaacattcgcctgggaaagttagaggaaaaagtcaagggctacaagaagcaggcagcactgaagctgggggacatcagtcaccgtctgctggagcagcaggaggacttcgccggcaagacagcccagtaccggcaggagatgcggcacctgcaccaggtgctgaaggacaagcaggaggtgctggaccaggcgctg

SEQ ID NO: 7557 - DNA, 300 bp, Homo sapiens
aattccgttgctgtcgcttgcaccgtgtggacagactctccggttctggggaaatccagtccctgttactccattttggccagaaattcaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgt

SEQ ID NO: 7558 - DNA, 300 bp, Homo sapiens
aattccgttgctgtcgctggcttcctcagcattgccgagatgtacagctctgtggcagaccagtggtgcctgattgtccccatgcacacgcgcaggagccgggtctccctggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtg

SEQ ID NO: 7559 - DNA, 300 bp, Homo sapiens
aattccgttgctgtcggagatgtactgtgcttatggatatgaagactcaataacatgtcaattctccacaagttaataaatgtataaatttacttcaattgaggattttttattagacatagacatgctgattttaaaattcaaatggaggccaggtatagtggcttacgcctgtaatcccagcactttgggaggccacggcgggaggactacttgagcccaggagtttgagactatcctgggcagcatggtgagacctcatctctactaaaaatacaaaaattagccaggcatggtggt

SEQ ID NO: 7560 - DNA, 300 bp, Homo sapiens
aattccgttgctgtcgctctgtttctctggctaatgtatttttatcacacccaagaaatttaacgtttataagatgtaatcatttaatataccaaccatgtgtatactgcttcagttgctcctcagattcctgaatctaatcagatataacactttgcattttgtttaccggtctctctagtcttctgtaattttcccagttttttcccataatactgatttttttttcagcattaaagctagctctcttgtagagtagtccacagtctgaatttatctgattgtttcatgattagattc

SEQ ID NO: 7561 - DNA, 300 bp, Homo sapiens
aattccgttgctgtcgaaaggttacattctttttggttcatctactcagaagctatttaatgaatgttcactccatgtcaggcatgtggcatgttttcatctctaccagtaacgctgaactttcttcttgtgtgcatcagcctgttgttttcttttgtaaatgttctgttcgtgtccattatcaacttttctactagggtgtgactgtttctatgatatatttataacgatgtgtgtgtgtgtgtgtgtgtatacgatatttggggtaaatacttttcccagcttctttgacttttaatt

SEQ ID NO: 7562 - DNA, 300 bp, Homo sapiens
aattccgttgctgtcggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactcctggctcaggagaagctggcagaccagatggtgatggagtttaccaagaagaagatggctcgagaagcag

SEQ ID NO: 7563 - DNA, 300 bp, Homo sapiens
aattccgttgctgtcgcaatttctgagtctctttctatttaatgccaccaatttctgaggaactagagtgcagagtggattgcttttcagctttttctattaggattcagatagctttttaattgctgctaatatatttgtcattcatattgcttttttgttttcaaaattcagttaatattttttcttctcattcattttgactttgtaggttcatgccatttgtaaaaccctctttgttgtctttttattggaattttgagagggagttaaatgtctgtttttaatctaccatcttta

SEQ ID NO: 7564 - DNA, 300 bp, Homo sapiens
aattccgttgctgtcggacagcagctccgaggtcggcgggggtctgggtggccatggaggagccccctgtgcgagaagaggatgaggaggagggagaggaggacgaggagagggacgaggttgggcccgatggggcgctgggcaagagccccttccagctgaccgccgaggacgtgtatgacatctcctacctgttgggccgcgagcttatggccctgggcagcgacccccgggtgacgcagctgcagttcaaagtcgtccgcgtcctggagatgctggaggcgctggtgaatgagggca

SEQ ID NO: 7565 - DNA, 300 bp, Homo sapiens
aattccgttgctgtcgccaaaatgtatcccagtaaagggctttggtaaaaaatataaataatttgaacaagtgtccagaggggagataatgtacagaaggaaaaaagaataatgggcttttaacttcttttttttccctcagtttttatctttttcctatatagagatgggagtctcactatactgcgcaggctggtctcgaactctcttgggctcaagtgatcctcccacctcggcctcccaaagtgctggagttacaggcttgagccactgctcctggccagcttctactttaaacct

SEQ ID NO: 7566 - DNA, 300 bp, Homo sapiens
aattccgttgctgtcgacgagcttttgctgtgttggccagactggtctcaaactcctggcctcaagtcccaaattgctgggatttaggcatgaaccactatgcctggccataccgtacagaaacactcttatggtgtatgtatgcgtctatttggaacttagttttgtagtctttttttaaaatcatactttattatagtaccttgttatcattttgaatatgttaaatcaacactataatagttaaggtagacagaacattaggacataccgtattctatattttttcctctgtatttg

SEQ ID NO: 7567 - DNA, 292 bp, Homo sapiens
aattccgttgctgtcgtaatcttaaaaatacttgcctcaaagatttattgggataactaagatctgtaatacttggagataggaactatgtcacatagtgcatgacacatgaaaggcacttaatattcattgaattgaattaaatctcacagatttaaataaaaggcctttgccttaatgttcaactttgtatttggtatgaggtctctctgtctcccttcaattaaatgatatttagaggtatgctcacaatagattagacatagttaatttttttttttttttttttttg

SEQ ID NO: 7568 - DNA, 293 bp, Homo sapiens
  misc_feature 225, 228, 230, 232, 238, 241, 243, 247, 248, 252, 253, 255,256, 263, 265, 267, 268, 272, 275, 277, 279, 281: n = A,T,C or G
aattccgttgctgtcggttgagtcataaaataaaaaaactagcaaatccagctctatgctcagagaattaccagaaaataaaattacatgaagcttgaatatagggagatggaaagatattagacaaatattaaagaaaatctgggccaggtgtggtggctcacacctgcaatcccagcactttgggaggcccaaggtgggaagattacttgaggcaaggggttnganancngcctgntcntnatanngaanntnngctcttnanannagantgngntnantagagtaattaa

SEQ ID NO: 7569 - DNA, 300 bp, Homo sapiens
aattccgttgctgtcgtatatgccaagaaccaaggtgttctgtcatcaaaattgattttttatgtgtgaattgacaacttgctaaagtcccccaaatttgttgtttctaaagaattggaaaccatttgagaggagctattgtaagaggggacttcagccttgatcattagccgtcaggagctctccctcaggaagatcagatttaacagtttttgagaaacttgagattctgaaatgctccacggcctgcttaccctttggaaagactgtaaggggtagaagtacccaacagaagaccac

SEQ ID NO: 7570 - DNA, 300 bp, Homo sapiens
aattccgttgctgtcggtttagcactcacatatttttgttcaatctttacttctcacacaaacagaaaaaggaaattatatattctgtatcaacaaagatttaacaaaacatccatacactacaactgtctacttactaaaattaagaattagtatattatcttttttcttcttatattaaaactatcttttcatacactattttaagtttatgaactgaaagtcttttagagataatttacttcaatgaactattattatttatattttataagcaaattgtcacaacttggtattagc

SEQ ID NO: 7571 - DNA, 300 bp, Homo sapiens
aattccgttgctgtcgcatctgtatgttgtggtgtcatagaaagagtccagacctggagccagagggagttgaattcaaacaccttgatttcttattatcagctgtgtcaagatcaaatcactcctctttggcatgctgtttttttctagaagtattactcttgccttagctattaccatcccctctcttgcttgtaggttgatatttacttgctaattcactctcagtgcattgtttttgaatcttagcctagttttttgtttgtttgtttgtttgttttgacagtctgcttactgcaa

SEQ ID NO: 7572 - DNA, 300 bp, Homo sapiens
aattccgttgctgtcgggactacaggtgcccgccaccacacccggctaatctttgtattacaggatagagttcttggaagcctggcgtggagggagggagagcaggtagcacagttacagaaggatcttcgggatatggaaatgcggtatttgtggacactcattcatctaacacacatttgttgagctcctaatgtgtatagaactgaagggatggagtcatgggcagtggaaaagctgaaattgtgtaaaagagagagaaggatcagtggctatggtctcgaagatgacgtggaagtg

SEQ ID NO: 7573 - DNA, 300 bp, Homo sapiens
aattccgttgctgtcgaagggatccagtaactgctcccagggaaaggatatcagcttgacctgcagctgacagctagtagtaactgtaagccacatgagcgaacaatctaggccatccagcccagaagaacattaagatgactgcagctccagccaacatccggctacagcaacctacgagaagccaaataagagcagcgtagctcagtcctcccagaatttgggacccagaaaataaaagggaaactaaacaggtaaacaagttgttgttttacaacactgtgtttgagagtaatgtgt

SEQ ID NO: 7574 - DNA, 288 bp, Homo sapiens
  misc_feature 270: n = A,T,C or G
aattccgttgctgtcgcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgncaccccccccccatatgc

SEQ ID NO: 7575 - DNA, 300 bp, Homo sapiens
aattccgttgctgtcgagaaccttgtggtcatcaataaagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttaaaacccgtcaggtggtgaagaagtactggtatgaggcctgctgatggcagtagaggtggtataa

SEQ ID NO: 7576 - DNA, 300 bp, Homo sapiens
aattccgttgctgtcggaattccattggccagaacatagtcacatggtcatgcatatgagaagtaaaatcttggaaatgcactttttatacaggatgattatttgcccagccgaaatgtagggtttccattattatcaaagaaaaaagagcagaataggagatagctacaagtctctatctcttacagaatgtaagtcagacacatcacttgaggggcttaaaatttttaacatttcttgatgctttatgcttatcatttgtaatggaagatttgtatggtggtagccttccataaagac

SEQ ID NO: 7577 - DNA, 298 bp, Homo sapiens
  misc_feature 69, 73, 78, 89, 93, 100, 114, 117, 121, 130, 133, 152, 154,156, 157, 164, 171, 187, 193, 205, 206, 211, 218, 228, 232,237, 247, 256, 259, 272, 274: n = A,T,C or G
aattccgttgctgtcgagacttttgtatatttatcttaaattatatatctgaagtttttttttttttantggnagttnaggcttccagngccntatcagnctttatataaatcngtngaanaatcgtttnttntaaaatcaaagtaaatttntngnncatgttnaaggagngaaaaggaatttgggnatatgnaattttgctagnncttanggcttcnatctaaaaangttnatganggaccaggcncgggggctnatncctgggatcctancnctttgggaaacccaggcggccgga

SEQ ID NO: 7578 - DNA, 300 bp, Homo sapiens
aattccgttgctgtcggccgccccaggggccctgggagctgcagggcatattgctgctgagccagaatgagctgtaccgccagatcctgctgctgatgcacctgctgccgcaagacctgctgctgctaaagccctgccagtcttcctactgctactgtcaggaggtgctggaccggctcatccaatgcgggctcctggttgctgaggagaccccaggctcccggccagcctgtgacacagggcgacagcgattgagcagaaagctgctgtggaaaccgagtggggactttactgatagtg

SEQ ID NO: 7579 - DNA, 280 bp, Homo sapiens
  misc_feature 232, 233, 237, 243, 246, 247, 254, 255, 257, 263, 265, 269,270, 272: n = A,T,C or G
aattccgttgctgtcggtacatggtcccactttttttcttcggtctattattggactttgcatttccatatacattttagaatcaatttattccacaaaaagctaccaacaacaaaaaagcctgttgggattttattggaattgtgtcagatctatagatcaatttgggaggactgatttttagacttgctcaagtattggatactttctttttttttttttttaaaacggnntttngctttngtnncccaggnngnagggcntnggcnntntttgggct

SEQ ID NO: 7580 - DNA, 300 bp, Homo sapiens
aattccgttgctgtcgcccatcactacagtcaattttagaacattcattatccccaaaagaaccctgtacccattagcagttattatctttactttttaaatgcgggaaataaacctacatagaaagaccagaaagactttatgctcttgaactgtataaactgactccagcctacctgttgtaccttttgttgttgttgttgttgttgttgttgttataccttattttctactagttcccataatacatcatttatttaattcaggctgttttcctacttgtgctacaaagtgttatta

SEQ ID NO: 7581 - DNA, 300 bp, Homo sapiens
aattccgttgctgtcgaaattttccagttcttttttcagcttctttatttcctcctaatggaaacattatctttaaaagttgcatataggaaatatacatattttacgtttgaacaaggagatttaattgtaaatatgaaagccaaagtattcctgaatggtcaaatacagcaataaaggcagaagaattaagatttttctttgttccattgtacagtgtaaataactaagttgttaactgtcaagtccagttatgtattctgtaagttgtgttctagtctttgactaaaatttatcatc

SEQ ID NO: 7582 - DNA, 278 bp, Homo sapiens
  misc_feature 24, 49, 55, 248, 250, 252, 254, 262, 263, 267, 271: n = A,T,C or G
atcgagaactcttactacaagctncttgttctttttgcaggatcccatngattcnaattccgttgctgtcgccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtctactcaaccatgtatccatagcagtccaaattngnantntgctgttnnaatntatnacaatat

SEQ ID NO: 7583 - DNA, 300 bp, Homo sapiens
aattccgttgctgtcggggagtccttgttgccatccatccctagggggtaattttgttccctgaggctgctttctagggacttctggtcgcttgttttatcctggaccagacctgaaagcagagcctgaaataaggccttctatgcacatcatttatgtaggaggtggccctaggaagcaggcccaatgcgccatgggaaaaaccagtaccagggtgttttgctgagttgagcactgtggtgggcagctggacatgagcccactggaatcttctgaagagcccaagagcctcttctcagt

SEQ ID NO: 7584 - DNA, 300 bp, Homo sapiens
aattccgttgctgtcgggcggcaggtgatgcagtttggacggattgatggcagtgcgtacattctggacttccagtatccgttctcagccgtgcaggcctttgcagttgccctggccaacgtgactcagcgcctcaaatgaagagactggtgtggggaggagagagatgcagagagcctttggaagaggtcttcggagatgccagaggagccctctaggggtccgatgcctgggaggaccacaagccaacagcaaaactggaaaagcccggcaggcccaggagagggcgctgacctgtgg

SEQ ID NO: 7585 - DNA, 300 bp, Homo sapiens
aattccgttgctgtcggacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggag

SEQ ID NO: 7586 - DNA, 300 bp, Homo sapiens
aattccgttgctgtcgcaaaaaacaacaacaacaaaaaaaaactgttaacaatttttctgtctgtgttcatgaggtgtgttagtctgtttttggttccttgtaatgtcttttttctgagttatttgctggcccttccctttaattttctgcaagagtttgtagaaaattgtattacctctcctgaaatatttgctagaattcactagtgaagctgcctggggctggagttttctttaatatagagctgttcagatagtctgtttattcttttccgtttctgaaagtttgcatcttttaag

SEQ ID NO: 7587 - DNA, 268 bp, Homo sapiens
  misc_feature 251, 252, 260: n = A,T,C or G
aattccgttgctgtcgtggagatggagcggatgatgcaggcgggcactcccatgggcatggagtttggtggaggccggggcctcctgagccctcccatggggcagtctgggctgagggaggtggacccacccatggggccaggcaacctcaacatgaacatgaatgtcaacatgaacatgaacatgaacctgaacgtgcagatgaccccgcagcagcagatgctgatgtcgcagaagatgcggggccctgnngacttgangggcccca

SEQ ID NO: 7588 - DNA, 300 bp, Homo sapiens
aattccgttgctgtcgaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaa

SEQ ID NO: 7589 - DNA, 300 bp, Homo sapiens
aattccgttgctgtcggtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccac

SEQ ID NO: 7590 - DNA, 252 bp, Homo sapiens
  misc_feature 79, 80, 87, 123, 124, 144, 153, 232: n = A,T,C or G
aattccgttgctgtcgtggagactttgattcgaagcccagttgggccgaccaggtgggggaggtgtgagaggttttacnnagatctnacttgctagtccacaaatgccacatgtggacatgcnnacccactcaccctgtgctgnctccacatntgtcaagccctgaaacgcttcacaagacagacttttctcttcgaagggaaaccctatcttgcattttactctacgctgntctttttttttgagacttga

SEQ ID NO: 7591 - DNA, 262 bp, Homo sapiens
  misc_feature 169, 172, 173, 176, 180, 181, 187, 192, 193, 194, 198, 201,204, 205, 207, 208, 216, 219, 226, 227, 228, 230, 233, 244,245, 247, 250, 251, 261: n = A,T,C or G
aattccgttgctgtcgatgaggtgctggtgtgtggatggatgaggtgctggtgtgtgggtggatgaggtgctggtgtgcggatggatgaggtgctggtgtgtggatggatgagatgctggtgtgtggatggatgagatgctggtgtgtggatggatgaggtctgtgtgnatnnatnaatnnctattnctttnnncctnaangcnntnnttcatttntantattatnnncnttnctttcaaactnntnttnncattattatnt

SEQ ID NO: 7592 - DNA, 300 bp, Homo sapiens
aattccgttgctgtcgccggcctcctatgccttctttccgggcctgttttaagagcattttcagaatacacacagaaacaggcaacatttggacacatctcttaggttgtgtattcttcctgtgcctggggatcttttatatgtttcgcccaaatatctcctttgtggcccctctgcaagagaaggtggtctttggattatttttcttaggagccattctctgcctttctttttcatggctcttccacacagtctactgccactcagagggggtctctcggctcttctctaaactggatt

SEQ ID NO: 7593 - DNA, 300 bp, Homo sapiens
aattccgttgctgtcgcgacagcaacggtgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaaggga

SEQ ID NO: 7594 - DNA, 300 bp, Homo sapiens
aattccgttgctgtcggtttgcttaacagagtaaaaatgtttttaaaaagtttaaagtttataaagtaaaagcattacaataacctaattttaatttattatggaagaaagacatttttaaagataaatttagtttagcctaggtatacagtctaactatagctggagtcttcaacatacctctatcaacatttgataaaacaagccagaaatcatcaaggatatagaaccatcaccatcaaccagcagaatctcattgacatttatagaacacttcacccagcagcaggatacacattc

SEQ ID NO: 7595 - DNA, 300 bp, Homo sapiens
  misc_feature 283, 292: n = A,T,C or G
aattccgttgctgtcggatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcattggttccatttttttttttaattcttcccttggattaatatttnctactgaanagaaatga

SEQ ID NO: 7596 - DNA, 292 bp, Homo sapiens
  misc_feature 174, 178, 186, 190, 191, 217, 223, 229, 245, 260, 261, 281: n = A,T,C or G
aattccgttgctgtcggagatatgcgggcaattcagcctgatgcaggttattacaatgatctggtcccacctataggaatgttcaataatcctatgaatgcagtaacaacaaaatttgatcctacatcaacaaattaagcaaagtgtcctgtattcttagtgctttggactaancaangaatacgnttanntacttgaccacttaccctcctatcantggtgnctaatncctatgttacacgatnaagacacaggtttannactttgcccatatagttaanttattgacaga

SEQ ID NO: 7597 - DNA, 297 bp, Homo sapiens
  misc_feature 142, 152, 163, 169, 174, 181, 191, 193, 198, 205, 209, 223,227, 231, 233, 236, 250, 254, 256, 260, 269, 272, 274, 285: n = A,T,C or G
aattccgttgctgtcgggctggagtgcagtggctcaatctcggctcactgcaaactccgtctcccaggttcacaccattctcctgcctcagcctcccgagtagctgggactacaggcacctgccaccacgcccggctaattntttttttttngggattttaantaaaancgggntttcatnatgttacccngnatggngctaatntccngacctggggatccncccntttngnccncccaatgggctggnattncnggcntgagccacnacncntagccttcccnatctatttttca

SEQ ID NO: 7598 - DNA, 300 bp, Homo sapiens
aattccgttgctgtcgaatctctgtattatagctatttgtctaacattaccccacatgtaataaataaaacaatatgagcataattgccccataaagaactcatgtcctgaattaataagtcttttcattgccagtcacttgtgcaatttatagagactatcaacttttttgcaccatatatgaaggaaacaaagtgcaaaaagtttgctctctcccttaagaaaattgagtgcttatagcctatgtcttccatataaaaaagtaagaatatcagtctttttaatgttattctaagaaaa

SEQ ID NO: 7599 - DNA, 300 bp, Homo sapiens
aattccgttgctgtcggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagtctcccctcatcaggacgcctccttcctgtacacggagcccctgggccgggtgctgggcgtgtggatcgcagtggaggatgccacgctggagaacggctgtctctggttcatccctggctcccacaccagtggtgtg

SEQ ID NO: 7600 - DNA, 267 bp, Homo sapiens
  misc_feature 133, 155, 160, 171, 172, 174, 177, 179, 180, 181, 185, 192,194, 196, 198, 199, 200, 203, 204, 206, 212, 218, 219, 220,221, 225, 226, 230, 231, 232, 234, 235, 241, 243, 247, 250,254, 259, 263: n = A,T,C or G
aattccgttgctgtcgacgcattctaccttttcctacaatgaatccaccagcagaaattcctgtacacatcttatcaacaaagaatttgaacctcaaagaattctcactgtgttacctaggctgcagtgcagnggtgcgatctcaactcactgcnacctntacctcctggnntnaancnnntctnctgtctnancnannntanntntcattntctacnnnncttnnttgnnnannctagtntntttntcntatntcatntctnccac

SEQ ID NO: 7601 - DNA, 293 bp, Homo sapiens
  misc_feature 87, 110, 127, 138, 140, 142, 145, 157, 162, 163, 167, 168,170, 174, 175, 177, 178, 181, 187, 188, 190, 194, 195, 196,202, 204, 207, 208, 209, 210, 214, 215, 216, 218, 219, 220,223, 227, 228, 234, 236, 238, 239, 245, 247, 254, 255: n = A,T,C or G
  misc_feature 260, 265, 269, 270, 273, 277, 278, 280, 285: n = A,T,C or G
aattccgttgctgtcggaggactgcttgagaccagcctggggaacatagtgtgaccttgttgctatgaaaaaaaaaaagaaaataanccaggctgatggcacatgcctcnagtcccagcttcacaanaggttgaggtnananaantgcttgacccanaagannaganncnatanngnnganattaanngnaggnnngcattntnctnnnntagnnncnnnctngacnnttgtcntnannattctncngtatttnnccaangaatngacnnatnaagnntnctctnctctaaat

SEQ ID NO: 7602 - DNA, 296 bp, Homo sapiens
aattccgttgctgttccgttgctgtcggcctaagcataaaaccaaaattataaaactcctagaagataacacaggagaaaacctggatgaccttgggttggcaatgactttttagatacaataccaaaggcatgctccttgaaagaaataattaattgagaagccagaaggcaaaatggtacagccattttggaagacagtttggccgtttctcacaaaactaaatatactcttaccataccatgcagcaattatactccttggtgtttacccaagacttgaaaacttgtgtctac

SEQ ID NO: 7603 - DNA, 286 bp, Homo sapiens
  misc_feature 126, 128, 129, 151, 168, 169, 171, 180, 188, 190, 191, 192,200, 202, 203, 204, 206, 219, 220, 225, 232, 234, 235, 236,242, 248, 252, 264, 271, 272: n = A,T,C or G
aattccgttgctgtcggtttgatcccataaaacccaaacctccacaatctaaattgcttcgtgaagataagaaccataacatgtatgttgcaggatgtacagaagttgaactaaacttactgtacngnnttataggcacagtctaagaatncactattacctacaggnncngtaatatanaagaaatngnnntgaggganannnancactctttcttannaactnatcagcncnnntagatnttgggntaanaaaataccgggngaaaccnncataaaatgattaa

SEQ ID NO: 7604 - DNA, 300 bp, Homo sapiens
aattccgttgctgtcggtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcgtgtcatataaaatgtgccacatggtagttgtcaagctgtggtagtcatgtacacttttttcttttttttaactttctaaaaggaaaa

SEQ ID NO: 7605 - DNA, 300 bp, Homo sapiens
aattccgttgctgtcggtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagc

SEQ ID NO: 7606 - DNA, 258 bp, Homo sapiens
  misc_feature 182, 191, 201, 204, 207, 208, 209, 212, 214, 215, 216, 217,218, 220, 224, 229, 230, 231, 233, 235, 236, 247, 249, 254,255, 257: n = A,T,C or G
aattccgttgctgtcggtcggggtttcgtacgtagcagagcagctccctcgctgcgatctattgaaagtcagccctcgacacaagggtttgtcgaataattgcttcattttcttgagcaatactgaagcaggatgaagtaagaggaatgcattcattaaaacatgctttgctttatgaattnttggctctnttttatgtcnctnttnnntantnnnnnantttnattannntnannttattgttatntnattannana

SEQ ID NO: 7607 - DNA, 300 bp, Homo sapiens
aattccgttgctgtcggcctaagcataaaaccaaaattataaaactcctagaagataacacaggagaaaacctggatgaccttgggttggcaatgactttttagatacaataccaaaggcatgctccttgaaagaaataattaattgagaagccagaaggcaaaatggtacagccattttggaagacagtttggccgtttctcacaaaactaaatatactcttaccataccatgcagcaattatactccttggtgtttacccaagacttgaaaacttgtgtctacacaaaaatctgcacg

SEQ ID NO: 7608 - DNA, 300 bp, Homo sapiens
aattccgttgctgtcggtcggtcttcctccggcccgggccctggcccagctagccggccatggaagtgaagaaaatgtttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagagcttcatttatgatctcgatactgtcttgccatttccctg

SEQ ID NO: 7609 - DNA, 300 bp, Homo sapiens
aattccgttgctgtcgccagaggcagatgtgttgctgagcagaaatgacaaagaggtggtttctgtcccttgggcctgagggtccggtggcagagccagacatgacaacaatgtaaagcaccagcaaaatgtgatgtcaaagggaagcagaaatacattcaatctgataggaggacctaggaaggtctctgtgaagaacaggaaggattgcaccagaaagctcctgctgcttctgtaccccgcctgtccctcccagctgcgcagggccccttcgtgggatcatcagcccgaagacaggga

SEQ ID NO: 7610 - DNA, 295 bp, Homo sapiens
  misc_feature 143, 147, 153, 157, 165, 168, 186, 190, 194, 198, 200, 202,206, 210, 213, 218, 225, 237, 242, 252, 256, 261, 267, 268,286: n = A,T,C or G
aattccgttgctgtcgaagaggctgaggcgggagaattgcttgaacccaggaggcagaggttgcagtgagccaagatcacaccattgtactccagcctgggcaacagagtgagactctgtctcaaaaaaaaaaaccaaaaaanaaanaaaaanaaanaaggaaanaangggaaaggaaaggaaaanaganaganaaanananaaanaaanacncttcntttccgnaaagccagccgnattcntcccagcgtntttnttggngtctgnncatggataaagcctcccnattcccccg

SEQ ID NO: 7611 - DNA, 300 bp, Homo sapiens
aattccgttgctgtcggatgaagccatctggtcctgggcttttctgtgttgggaggtttttgattactgattcaatctctctcattattggtctgatcagactttccatttcttcatgattcaatcttggtaggttgtgtgtttcctctagaaattggtccatttcttctaggttattaaatttgtaggcatacaattcttcataatattctcttataatcctttttatctctgtcgtattggtagtaatgttccctctttcatttctgattgtagttattgaatgttctttttttttct

SEQ ID NO: 7612 - DNA, 300 bp, Homo sapiens
aattccgttgctgtcggtaacttaaatactatcgtataataatcatatcatataaaagtcagtgcaacttacattacatggtgagataagagagagaagaaaacaaaggtactgcttaatatacacattcacacagacatattcataataaaataggaggaaatacttacaacaattacaatcctcatttctgtagctgttcacatggtcgtggctggtatttataattactttgtctactatccaatctgtattccccttcccttcagaaagcgcctcagctgggcatggacccttacc

SEQ ID NO: 7613 - DNA, 300 bp, Homo sapiens
aattcgttgctgtcgcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggg

SEQ ID NO: 7614 - DNA, 129 bp, Homo sapiens
aattccgttgctgtcgggggattttgtgggaccgctgcccacagatccaggtgttggaagggcagcgggtaaggttcccaagccagacccaacacccttaccacttggcacccagagggggctgcacct

SEQ ID NO: 7615 - DNA, 300 bp, Homo sapiens
aattccgttgctgtcgatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtg

SEQ ID NO: 7616 - DNA, 296 bp, Homo sapiens
  misc_feature 105, 109, 118, 125, 126, 140, 141, 143, 150, 153, 155, 157,159, 162, 164, 166, 172, 178, 179, 184, 186, 189, 191, 195,196, 203, 213, 214, 216, 218, 219, 220, 221, 222, 228, 229,230, 236, 237, 240, 241, 244, 251, 258, 260, 263, 270: n = A,T,C or G
  misc_feature 278, 280, 282, 284: n = A,T,C or G
aattccgttgctgtcgagaggagaacaaactggttgctgaagccatggtttccctgggaagggggacccacctgtgcggcacctggaattcagaggaagggctcncatncttgtgggnaaatgannaacatggccattannantgctggnatngngnangcncncntatctngacagnnactangnatncnaggnngactttnctgaatatgnngnannnnntttacnnntccctnntgnntgntacctgngtgcggntnctntgacaanctggtgcntnantncattccgaatca

SEQ ID NO: 7617 - DNA, 283 bp, Homo sapiens
  misc_feature 150, 169, 173, 175, 191, 197, 198, 200, 201, 202, 203, 204,211, 214, 221, 223, 225, 228, 232, 233, 234, 239, 240, 243,246, 247, 249, 250, 251, 254, 256, 258, 259, 262, 266, 267,269, 272: n = A,T,C or G
aattccgttgctgtcgtgaacttttggctgaacctcatcactcgaactccagcttcaagaatgtgttttcatgcccggcctttgttcctccataaatgtgtcctttagtttcaaacagatctttatagttcgtgcttcataagccaattnttattattatttttggggnactntncttcggaagattgccntgaagnntnnnnnaattaanagngactttngnanaanactnnnattanntangtnncnnnacntnannaanattnnangantttgaggagtt

SEQ ID NO: 7618 - DNA, 292 bp, Homo sapiens
  misc_feature 161, 165, 166, 169, 170, 172, 176, 177, 183, 185, 186, 187,192, 194, 201, 204, 205, 208, 218, 219, 223, 226, 227, 228,230, 234, 239, 241, 247, 249, 254, 256, 262, 265, 267, 270,273, 280: n = A,T,C or G
aattccgttgctgtcggctgggctgaccacgttactcatccccgttaacattctctctaaagagcctcgttcatttccaaagcagttaaggaatgggaaccagagtgttttaggacctgaagaatctttatgactctctctctttcactcttttttttttngccnntanntnaaanncaaagngnnngtttnancgttttngtnntcntcgggccccnngttncannnangggncaaangntttggntntaagncnatcccnccntnaanttnggggacnaattttaattcc

SEQ ID NO: 7619 - DNA, 269 bp, Homo sapiens
  misc_feature 33, 39, 167, 175, 177, 183, 184, 189, 192, 194, 196, 198,206, 207, 208, 209, 210, 212, 214, 219, 224, 227, 231, 232,238, 240, 241, 243, 244, 246, 248, 249, 250, 253, 262: n = A,T,C or G
ccggaatacctctactcggtcattttgcaggancccatngattcgaattccgttgctgtcgattgtcagtttgatatttattttaaattgtggaactagatgcataaattcacatttctgcctttcctttgcatcttctcatatattgtgtttttttttttttcccnaaaaaaananttaaanncattnttnancngnaaaaaccnnnnntntntgtancccanganttanncccggncnnanngnannnatnttaatgtanaatttta

SEQ ID NO: 7620 - DNA, 265 bp, Homo sapiens
  misc_feature 145, 147, 160, 175, 181, 187, 188, 189, 192, 194, 201, 203,204, 205, 207, 216, 218, 220, 226, 229, 235, 239, 240, 245,249, 250, 251, 253, 257, 258: n = A,T,C or G
aattccgttgctgtcgaggagatgcagttcttaatgaagctgctcaaattctgcgattgctgcacatagaggagctcagagagctacagacaaaaatcaacgaagccatagtagctgttcaggcaattattgctgatccaaagtnanaccacagactgtnaaaagttggacgatnagtacntgatgnnntcngntaggtancnnnanctattatgncnanctacanagnctcggngccnngcagngctnnntncctnnattcttg

SEQ ID NO: 7621 - DNA, 300 bp, Homo sapiens
aattccgttgctgtcggtccagtgccaagagggcccggcaagaagaagtgacaatgaagtcttttcttgcggacactccctcctgtctcctattttctgtaaataattttctccttttttctctcttgatgctcaccaccaccttttgcccccttctgtctgactttataagagacaggatttggattcttcagaaattacaggaataatcatttttccttacccagttgtggcaagggccaggcaccacccatctaatgatgaagaaggacctaaaatttggtttgctaatacccaact

SEQ ID NO: 7622 - DNA, 300 bp, Homo sapiens
aattccgttgctgtcgatgagaataaagttagaatgagaatgttcctagcatggtgcctggcatgagcagattctcagcagatgggccctcctgtaatccgctgagggctctcctgcagtgccagcagggatcctagtcattgtctccaccactcctgtctgtcttcacccagaaccttgtctggatcctgggaggaagcaaacatctcctggtgggaatgtgaggccctgccaggttgtaggagtaactggaaaagggcaggtggccctgcccactatgtgggcacctcatgataaatg

SEQ ID NO: 7623 - DNA, 300 bp, Homo sapiens
aattccgttgctgtcggaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccact

SEQ ID NO: 7624 - DNA, 300 bp, Homo sapiens
  misc_feature 153, 159, 166, 172, 173, 180, 187, 199, 201, 203, 205, 208,218, 225, 226, 234, 236, 238, 244, 252, 258, 265, 269, 271,273, 274, 277, 278, 279, 282, 284, 287, 288, 289, 293: n = A,T,C or G
aattccgttgctgtcggaactgggttaggtgccgctgttgctgctcgtgttgaatctagaaccgtagccagacatgggactggaggacgagcaaaagatgcttaccgaatccggagatcctgaggaggaggaagaggaagaggaggaataaanggtaanaactggnttacanntgctttnatatgangaatcaaaggcnanancnctntgaggtagtnttacctnnacctgcgntntnctatgntcttttantgctgngttgaanggtntnannatnnntananatnnnaaanccagctg

SEQ ID NO: 7625 - DNA, 300 bp, Homo sapiens
aattccgttgctgtcgaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagata

SEQ ID NO: 7626 - DNA, 261 bp, Homo sapiens
  misc_feature 174, 177, 184, 187, 188, 192, 194, 195, 197, 198, 199, 200,203, 204, 205, 210, 211, 219, 220, 221, 224, 227, 230, 233,240, 242, 243, 248, 249, 250, 253, 254, 256, 259: n = A,T,C or G
aattccgttgctgtcgggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggattnatngatatgnatnntaanannannnngtnnnttaannaaagttcnnntanatnatnatnttaatcngnnattannnaanntntgngc

SEQ ID NO: 7627 - DNA, 300 bp, Homo sapiens
aattccgttgctgtcgccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatg

SEQ ID NO: 7628 - DNA, 300 bp, Homo sapiens
aattccgttgctgtcggagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaac

SEQ ID NO: 7629 - DNA, 300 bp, Homo sapiens
aattccgttgctgtcggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtg

SEQ ID NO: 7630 - DNA, 300 bp, Homo sapiens
aattccgttgctgtcgaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaagg

SEQ ID NO: 7631 - DNA, 300 bp, Homo sapiens
aattccgttgctgtcggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtt

SEQ ID NO: 7632 - DNA, 242 bp, Homo sapiens
  misc_feature 199, 200, 201, 206, 208, 209, 211, 212, 218, 225, 227, 233,236, 237: n = A,T,C or G
aattccgttgctgtcgattttattttgatccttgttaaatttttattttaattaataaggtagtcattcctgtagagggataagatgcttgtagagttgtgggtatcattccaaatagaactgttatgatttgggaaatattctttactacaaaggacttatttcataattacaaattttccttcatatttgcctttgnnnataananntnnaggaangacattntntagcantannaggaa

SEQ ID NO: 7633 - DNA, 300 bp, Homo sapiens
aattccgttgctgtcggtgtgtgtgtgtgtgtgtgtgtgtgtgtatggagatgctgaaagagcattgataaaattctagactttcctaacaataaccccaagtaaaacaagaatagaagaaattgctaatgttataaagactacttgtataaaactaatgtctaaatagggaagcactaaagccatttcctttagaatcagaaacaaaacaagaatgcacattatcatcattattattcaacattgttttagaaattctagagactgcaatacacaagaaatgaaatattgggtatgaat

SEQ ID NO: 7634 - DNA, 260 bp, Homo sapiens
  misc_feature 165, 166, 174, 175, 178, 180, 181, 187, 188, 192, 194, 195,197, 198, 200, 203, 208, 216, 218, 219, 222, 223, 224, 225,228, 233, 237, 239, 241, 244, 245, 253, 256, 257: n = A,T,C or G
aattccgttgctgtcggaaatgcaaggggctgcatgacctaccaggacagaactttccccaattacagggtgactcacagccgcattggtgactcacttcaatgtgtcatttccggctgctgtgtgtgagcagtggacacgtgagggggaggtgtgggagggttnnagtctgcnnggntnntgctcnntacntnncnntnctnctttnctaaccgncnnatnnnngcncatgnagantntntanngcactttnctnngtc

SEQ ID NO: 7635 - DNA, 284 bp, Homo sapiens
  misc_feature 142, 150, 151, 158, 159, 165, 166, 167, 171, 172, 174, 178,182, 183, 185, 188, 189, 191, 192, 195, 196, 198, 200, 202,205, 208, 209, 212, 213, 218, 222, 227, 228, 231, 232, 233,235, 236, 241, 242, 246, 248, 250, 251, 252, 259, 260: n = A,T,C or G
  misc_feature 264, 266, 267, 269, 270, 271, 273: n = A,T,C or G
aattccgttgctgtcgaaaatgcccagtcaggtctgaatcgtcagtgcattatattgactctgagcactttagaatttagagttgcaattgaatgccagctgtggagatggggtgcatatcagatatataaataaagctcangtttgttnnggaaccnngtattnnnaaanntncttntganntnttnntnnttnnantntntanagnnatnnctttntttntaaannttnnntnnagggnnatantngnnnttttgtnnatananncnnnanacctgtttttt

SEQ ID NO: 7636 - DNA, 300 bp, Homo sapiens
aattccgttgctgtcgcgcactccctctttctctcttttcctgtatctttcccttttaatttgctataggaaaaacttaaacatgagtgagcaaagaggaggatgcaactgaatatttttggaaatgtggatatcatataagggcttggaagatcaacactgggatgatgatgagcagaatggtcatgaagatgcccaaaatcagggcccagatgttcaggcacttggcggtggaggcataggcctgggcgccagtcaggtcgccaaccatcttcctgtgcctagacttcacggagtaag

SEQ ID NO: 7637 - DNA, 300 bp, Homo sapiens
aattccgttgctgtcgggcacgtcctcgtgtatcctgtggaggaccctgaccccgcaccccaccctcgaggccagaaatcggttgcctctggggacctgagaagcgagaccactcgcgcccctgacttgcaagttggggtctttattggcctccgggattctgctcgtggcggtttctccaggctggtgatgggcaagccgggtgtaccaagtccaggatgcacatgaggagccgtttgtaaccgcactgaatcacctcatgactagcggggcaggcctctaattcaccgcaggaatttc

SEQ ID NO: 7638 - DNA, 265 bp, Homo sapiens
  misc_feature 256, 259, 264: n = A,T,C or G
aattccgttgctgtcggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttataagcctccatgtggctctgaatgcaagctatatatagtgagtttttctaaattaagggaactctgctttttttttttttttttaaanaancgggnc

SEQ ID NO: 7639 - DNA, 300 bp, Homo sapiens
aattccgttgctgtcggtggaggggcccgttcgaagagtcgtgagggggtgacgggttaagattcggagagagaggtgctagtggctggacttgacctggaaagaatcttctgctgactctcaacttttcctggaaaaaatggatcattcccaccatatggggatgaagctatatggactccacagtaccatgcaccttttcaccataccccaccccttcaccttacactcccatgggggaaggagacagcagcatgatgatgatgcctatgacctctacttggctttaagaatgtggac

SEQ ID NO: 7640 - DNA, 300 bp, Homo sapiens
  misc_feature 253, 260, 287: n = A,T,C or G
aattccgttgctgtcggaatatgatactttggaggggaaatgcttggcgtgtgtacaagtatgaggagaccaacttacacaacccatcaaatacttatgctcctcatagccaaggaggtattccacctcctgctggaatgtaattaaagggagaaacacactgtatgaaatatatgtctatatcatgacttgttgccaacatcttgaggcacattatttgtttccaataaaagtaatgttttttttttttaancccccantgagatatcacctcacacccatcagantggctactgtaaa

SEQ ID NO: 7641 - DNA, 267 bp, Homo sapiens
  misc_feature 164, 175, 178, 187, 193, 208, 210, 214, 223, 225, 227, 228,229, 234, 239, 242, 243, 250, 251, 255, 256, 257, 258, 259,261, 262, 265: n = A,T,C or G
aattccgttgctgtcggtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgntgaagactggncantcccctatngacttntgatcacaccagaangnatcncattcaagnancnnnccatntatanttnnccttacnntaannnnntnnctngc

SEQ ID NO: 7642 - DNA, 300 bp, Homo sapiens
aattccgttgctgtcgggagtaccgggattctgatggaacctcatctgtttgaattactagcccagagggtcatcactctttacctgcaaacagtaccttctctgatgtctgggagaggtggtttatttcccatatacttgttaagtgtagatcttggggaagaacaactaacaccagaaacatcacatgttggctgttggggaggtgcttgtccattttgtatcccttttattttttcccaatcaacagagatccagttagaaggagcagcaagaccttccaggaggccatgctggaag

SEQ ID NO: 7643 - DNA, 300 bp, Homo sapiens
aattccgttgctgtcgcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaaggattactgtagatgcagtatatggaatcaggaatcttaacttcatgtgagctattggagtttcctttgctatcaggatcataagggagggtctatgcagcgtatacaagctattcttaaggagaccggccagatt

SEQ ID NO: 7644 - DNA, 300 bp, Homo sapiens
aattccgttgctgtcggttctgttttgtttttggtttctcccttgtgtcagttctcttctggcccagctgggtggctgtggaagtctgtgaggtggcccaaccacaagcatacctattaagagaagcccagagcttccagcccccacttcgaaaactctctctggcccacatagcaaactccttcttccgtatttttcccaaccccagaatttttttaaaaaggccactttgccggaaccttctttgggccattttggtttccaatcaagcccaaggttatatgaataaagggggttaac

SEQ ID NO: 7645 - DNA, 300 bp, Homo sapiens
aattccgttgctgtcgagcactctatgttcgttatctcatttgctctaagtatgtaaatagggaactgatgaataaaaaggtgagtgaaatgacttggtcacaaaaaaagtgataaaaatggggattacagttcagtttcattgactcttagaattttttctccttctccccagcttttcattttgaaaaaattcctaacatacagtaaagaacagaacaacaagcacctagattaaatagtcattaatgttttgccatagttgcttgatttttctttctacacacacacacacacacac

SEQ ID NO: 7646 - DNA, 300 bp, Homo sapiens
aattccgttgctgtcgcttttacggaattaagcagagaaaatgatgaagagaaagtcacgtttaatttgagtaaaggagcatgtagctcatccggagcaacatcttccaagtcaagtactctgggaccgagtgcactgaagacgataggaagttcagcatcagtgaaacgaaaagaatcttcccagagctcaactcagtctaaagaaaagaagaaaaagaaatctgcactggatgaaatcatggagattgaagaggaaaagaaaagaactgcccgaacagactactggctacagcctgaa

SEQ ID NO: 7647 - DNA, 300 bp, Homo sapiens
  misc_feature 243, 255, 264, 272, 276, 279: n = A,T,C or G
aattccggtgctgtcgagcctctagacattgcggccgctatctacgtagatccagacatgataagatacattgatgagtttggacaaaccacagctagaatgcagtgaacaaaatgctttatttgtgaaatttgtgatgctattgctttatttgtaaccattataagctgcaataaacaagttaacaacaacaattgcattcattttatgtttcaggttcagggggaggtgtgggaggctctnatgtccaccagnagttgttcnacccctcnccangtnccaggtgggatcacctgatac

SEQ ID NO: 7648 - DNA, 244 bp, Homo sapiens
aattcaaggcctctcgagcctctagacattgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggggaaggttta

SEQ ID NO: 7649 - DNA, 300 bp, Homo sapiens
aattccgttgctgtcgggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaa

SEQ ID NO: 7650 - DNA, 300 bp, Homo sapiens
aattccgttgctgtcggccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggacca

SEQ ID NO: 7651 - DNA, 299 bp, Homo sapiens
  misc_feature 238, 245, 250, 254, 256, 259, 260, 264, 266, 271, 285, 287,288, 290, 291: n = A,T,C or G
aattcaaggcctctcgagcctctagacattgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggagntttcccntaatntaananctnnatgncnctagnatgttacatgatgncnngnncctgtgct

SEQ ID NO: 7652 - DNA, 291 bp, Homo sapiens
  misc_feature 239, 244, 251, 264, 267, 273, 279, 282, 283, 284: n = A,T,C or G
aattcaaggcctctcgagcctctagacattgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggntttgnccccctntggcctttcctancanccttcnaacctnacnnnacacctc

SEQ ID NO: 7653 - DNA, 300 bp, Homo sapiens
  misc_feature 278, 290, 293: n = A,T,C or G
aattccggcctgtcgagcctctagacattgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggagggttttacaatgtccgctccatgcccatccgcaaggacgacnaggccaggtagntcnaggacac

SEQ ID NO: 7654 - DNA, 300 bp, Homo sapiens
  misc_feature 245, 247, 252, 253, 255, 258, 262, 264, 267, 271, 281, 282,283, 285, 289: n = A,T,C or G
aattcaaggcctctcgagcctctagacattgcggcccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttantnctagnnanatnttgnanatnattncttttaatcnnngnattntaattacatgt

SEQ ID NO: 7655 - DNA, 291 bp, Homo sapiens
  misc_feature 245, 248, 250, 283: n = A,T,C or G
aattcaaggcctctcgagcctctagacattgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttaancangntcttgatgaatgtgctttgtgccaaaatgcctncccattgt

SEQ ID NO: 7656 - DNA, 297 bp, Homo sapiens
  misc_feature 235, 261, 272, 281: n = A,T,C or G
aattccgggctgtcgagcctctagacattgcggcccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggnaggtttttctggacagttcacgctgncaatgaaatgngacctatgntatccattgtcctgga

SEQ ID NO: 7657 - DNA, 300 bp, Homo sapiens
aattccgttgctgtcggttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgctcttgctc

SEQ ID NO: 7658 - DNA, 300 bp, Homo sapiens
aattccgttgctgtcgctgtcagccacaatgccttctgatgtgcttgaggtgaccaagaagttcatgagggaccccattcggattcttgtcaagaaggaagagttgaccctggagggtatccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcat

SEQ ID NO: 7659 - DNA, 300 bp, Homo sapiens
aattccgttgctgtcgggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgc

SEQ ID NO: 7660 - DNA, 300 bp, Homo sapiens
aattccgttgctgtcgaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaaccagggaatactattaaaaagcagtt

SEQ ID NO: 7661 - DNA, 300 bp, Homo sapiens
aattccgttgctgtcggatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtga

SEQ ID NO: 7662 - DNA, 1076 bp, Homo sapiens
  misc_feature 2, 5, 9, 11, 30, 45, 49, 51, 64, 77, 82, 95, 97, 99, 104,105, 113, 115, 120, 131, 132, 136, 149, 151, 153, 161, 163,165, 191, 193, 214, 220, 233, 236, 238, 270, 281, 285, 293,296, 310, 312, 313, 316, 317, 325, 333, 336, 337, 338: n = A,T,C or G
  misc_feature 344, 345, 351, 357, 362, 371, 383, 390, 403, 433, 443, 444,454, 461, 465, 471, 477, 478, 483, 485, 490, 496, 497, 504,505, 506, 509, 517, 523, 531, 533, 535, 541, 542, 577, 582,588, 592, 608, 610, 611, 620, 623, 627, 632, 633, 643: n = A,T,C or G
  misc_feature 653, 659, 661, 666, 667, 674, 678, 689, 690, 692, 699, 707,710, 711, 722, 725, 726, 730, 735, 752, 755, 756, 792, 795,801, 806, 820, 843, 861, 872, 883, 885, 896, 897, 899, 905,913, 919, 923, 925, 930, 940, 941, 950, 951, 954, 956: n = A,T,C or G
  misc_feature 972, 985, 995, 996, 999, 1002, 1013, 1022, 1024, 1026, 1030,1036, 1041, 1042, 1053, 1055, 1057, 1062, 1064, 1066, 1067,1068, 1076: n = A,T,C or G
cncangttntngaaaaccccctttttgggnaaaaaactccccccnggtntnctttttttttggncaaggggaatacnccaancccgcaatttccngnanaggtnnaggggggnanggganggcaggggaanngagnccggggcttggcntncngaaaaccngnanttttttgtgggacgggggggagggcncnggggggaccggaataaaagcngggggntgggggaaaaggnaantnggttttcaaaggggaatccaaaaacggggcgnaatggttagangggnggaccctnggnccctggggggaagngnnacnngaatttgnaaaggganggnnnaaatcnngggaangtcccnggaanaacgggganaagggggcccangagggangggctccccaagnggattttttaacggacacatggaacgaagnaaggtttgtnnggagggctcnaaaatgngccngggaanggggcnntccangnggggngggtanngtaacannntcncggacaanatgggnggccactnantngaaaannaatcttgttgctattaaaaaataaagctgacccancgggngaagtngctnaatggggaatgcaaantnnttgaggggnccngggngacgnnactaaattgnggtcaaattnttgaananacggnnaatgggngaantggcaagtganngnaacctantactcaangannttttattgatnggnnaganggagnaagaccttgggaagaanccnncttggggcttatgaaacggggaataaaatagggggnaangtggcnatccntttcttggggacangggaacttgctcaggggggaaanggaacatggaggcggggnggcgcaagggncctgctcaatngngttcttaatgnnanccttgncttaaaanggagantaangngaaanaagtgggggnnattgttggnnaantntatttggggggaatantgggcacgggctnaataaataanngcncgnaggcccataangggaggccncnangggnaccccntggannattgggcagangnanctttntnannnaggttaan

SEQ ID NO: 7663 - DNA, 745 bp, Homo sapiens; identical to SEQ ID NO: 3354
  misc_feature 507, 616, 629, 651, 658, 670, 682, 694, 716, 719, 720, 721,722, 723, 724, 726, 736: n = A,T,C or G

SEQ ID NO: 7664 - DNA, 674 bp, Homo sapiens
  misc_feature 16, 17, 18, 19, 20, 191, 529, 548, 588, 591, 592, 595, 597,599, 601, 602, 604, 605, 606, 609, 611, 612, 632, 635, 637,645, 646, 655, 657, 661, 662, 664, 667, 674: n = A,T,C or G
acgaggctgcatctgnnnnnaggatgccaccctacgctgcgctggctgcgatggggacctcttctgtgcccgctgcttccggtgggtgcaggtggaatgttctgtgcgagagctcaagggctgcctggatccctgacttgtatccctttgttccacagagagggccatgatgcctttgagcttaaagagcnccagacatctgcctactctcctccacgtgcaggccaagagcactgaagacaccctggtcctcccggaagggcagtcccacaggcagcggcacccatttctgggccccgccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacangcccctccctggcacttantgggtctaataaagtatgttgattcattgggaaaaaaaanccnntcntngntnnannnaananncctccccccccttaaaaaanttntngggggggnnttttccctnancccnnanttnaaaaaan

SEQ ID NO: 7665 - DNA, 747 bp, Homo sapiens
  misc_feature 2, 3, 4, 5, 6, 7, 8, 9, 10, 11, 14, 15, 17, 18, 20, 22, 23,24, 26, 27, 33, 464, 585, 618, 622, 624, 625, 627, 629,630, 634, 635, 637, 639, 640, 642, 643, 644, 646, 655, 657,673, 678, 688, 697, 700, 704, 705, 709, 710, 711, 712: n = A,T,C or G
  misc_feature 724, 725, 727, 728, 729, 730, 731, 732, 733, 736, 744, 747: n = A,T,C or G
gnnnnnnnnnnttnnanncnannncnnatcgantcgcacgagctgcatctgcaatgaggatgccaccctacgctgcgctggctgcgatggggacctcttctgtgcccgctgcttccggtgggtgcaggtggaatgttctgtgcgagagctcaagggctgcctggatccctgacttgtatccctttgttccacagagagggccatgatgcctttgagcttaaagagcaccagacatctgcctactctcctccacgtgcaggccaagagcactgaagacaccctggtcctcccggaagggcagtcccacaggcagcggcacccatttctgggccccgccacaggacgtccgatgggagagcttgtctggctctactgatgatggataggccccttcctgagccttggtgtccctggaatgaggaaagattctccattcgagagaatgactgggagggaagaagtcngggccctcctattagaagcccagactggaagtgagaggcatgatggggaaaagaccagactgaatctacgggtgagccctgtaacctggctctagggcacagcccctcccctggcacttantggggtctaataaagtatgttgatcattggganaaananncncnnatcnncncnncnnncnccctccccntnaaaactttgggggccntttcntcaacccccnctttaaaanacnttgnngttnnnnaccccctcttanntnnnnnnnttnctctcccnccn

SEQ ID NO: 7666 - DNA, 754 bp, Homo sapiens
  misc_feature 2, 5, 6, 7, 10, 11, 12, 13, 14, 15, 16, 17, 18, 20, 21, 22,24, 25, 26, 27, 28, 29, 31, 33, 35, 36, 37, 38, 57, 59,61, 88, 92, 96, 114, 121, 142, 145, 160, 162, 178, 189,190, 191, 206, 213, 232, 233, 257, 264, 270, 288, 294, 295: n = A,T,C or G
  misc_feature 302, 321, 324, 326, 327, 338, 339, 341, 352, 360, 365, 369,374, 380, 390, 394, 400, 406, 407, 411, 434, 456, 466, 474,477, 479, 481, 484, 486, 503, 505, 506, 510, 519, 527, 534,544, 554, 555, 558, 560, 561, 562, 566, 568, 569, 585: n = A,T,C or G
  misc_feature 590, 601, 602, 603, 604, 620, 630, 631, 632, 634, 635, 636,640, 641, 643, 647, 648, 653, 654, 662, 672, 673, 674, 675,677, 678, 680, 681, 682, 684, 685, 688, 695, 696, 701, 702,703, 704, 705, 708, 709, 710, 711, 712, 713, 715, 717: n = A,T,C or G
  misc_feature 720, 722, 723, 726, 727, 734, 735, 736, 737, 743, 746, 747,751, 752: n = A,T,C or G
gnggnnnttnnnnnnnnngnnngnnnnnngngngnnnnttctaatgcttccaacagncncnggggctcgaactcgctccacgcagccnggcngtgngaattcggcacgaggacngcacacntcacggggtgccctcccaacnctncgcatgcgagacccngngccaatatcggggggntcaatgaccannngggctcagcatgganaaacagngccctgcctgaagggcagnnagaatcaaaaggatcttacccctngtatcangagggnggctatgctccctccatnccaagnngagcccnggactagaaagcacgatgncgncnnacatctactgnnancgcctaaacanaatccctnctccntgangggcnaaacgncctcatcccnaatncaacantgggcnngaangactgaaaatcgccggaactcancaccatgatcggaccgggacantcagaccctntcctgccncancnancgncnatcgatccgaaaagtgnanntatnagcacaacnacgggganggcatanggaccctgcnagaaagaacnngcncnnnctcncnnggactgccatgaaggntagcngcctaaaatcnnnncctgacactcggaggnccgccacaannngnnnaagnnanggcnngacgnnacactggntgaaaaaaannnngnngnnncnnggnaaacccnngcccnnnnnacnnnnnngngncgnannccnngcccccnnnnacgatnggnncccnngc

SEQ ID NO: 7667 - DNA, 761 bp, Homo sapiens; identical to SEQ ID NO: 5424
  misc_feature 7, 22, 219, 489, 518, 536, 565, 595, 625, 673, 691, 723,730, 738, 741, 748: n = A,T,C or G

SEQ ID NO: 7668 - DNA, 712 bp, Homo sapiens
  misc_feature 3, 13, 628, 686: n = A,T,C or G
agnttcgaattcngccgaggttacatcaagagataaatagagtgaagcagaactagtggtgcggaccagctcgccagcaacagaagggtttgtagtcggcctggcagtggacagggaggttggctagaactattaccttaggtccgtgataatatccctgaatccaacttttcagaaagaaataggtaacatatttttcaccaggaagcttcacccagacactgaacagaatggtctcagtgcactaatggaggctcagttaaagggttgtggtagcacaaggaagagacattctgacttggaaatttggagaaggcttcacaaatgaaggggcatttgaaatgagctttgaaggtgcaagagtattccaagttgagaagacaacctgagtggtgttgggtgaacagtcattctacctggctgtagtgtagtatagtgtagtgtagtgtaggaaacatcagaggagtggagtgggatatgagcctggagagagctggcggccatggatcattgaaagccttgaatgtctgatggggaggttgactttattttgtaggcaatggaaaccaccatggtttttagttgagcagcatgaaattaagcctgtgctttgcaaagattaatctancaccaccagattgaagccacaccccatttctggtataatccagtaaatatatacactntttctgtattggtccataaaggcttt

SEQ ID NO: 7669 - DNA, 1259 bp, Homo sapiens
  misc_feature 4, 7, 8, 9, 13, 15, 16, 18, 19, 20, 25, 30, 33, 37, 43, 44,46, 47, 50, 52, 55, 56, 58, 67, 68, 74, 77, 78, 79, 82,86, 89, 92, 95, 99, 100, 101, 102, 105, 106, 109, 111, 114,116, 120, 123, 131, 144, 146, 156, 157, 159, 160, 161: n = A,T,C or G
  misc_feature 166, 170, 173, 175, 176, 178, 182, 185, 188, 189, 190, 196,198, 207, 211, 212, 218, 222, 223, 224, 229, 236, 241, 242,244, 260, 262, 264, 265, 281, 283, 301, 302, 342, 529, 533,542, 547, 561, 563, 564, 575, 577, 578, 593, 600, 607: n = A,T,C or G
  misc_feature 616, 621, 625, 626, 635, 642, 643, 648, 656, 659, 666, 667,670, 680, 685, 691, 693, 694, 697, 700, 702, 704, 708, 711,714, 717, 718, 722, 728, 733, 735, 737, 740, 743, 745, 746,747, 748, 750, 752, 753, 760, 774, 775, 779, 780, 784: n = A,T,C or G
  misc_feature 789, 790, 793, 795, 802, 806, 810, 813, 817, 819, 826, 830,834, 835, 840, 841, 848, 851, 852, 857, 860, 869, 872, 873,879, 883, 886, 889, 894, 896, 898, 902, 924, 925, 931, 943,945, 947, 960, 962, 970, 973, 976, 988, 990, 991, 992: n = A,T,C or G
  misc_feature 993, 995, 999, 1000, 1004, 1005, 1008, 1011, 1016, 1023,1039, 1045, 1050, 1052, 1055, 1058, 1059, 1065, 1067, 1069,1082, 1083, 1087, 1096, 1109, 1112, 1115, 1116, 1117, 1125,1126, 1127, 1131, 1137, 1139, 1150, 1157, 1160, 1161: n = A,T,C or G
  misc_feature 1170, 1172, 1177, 1178, 1181, 1188, 1194, 1205, 1213, 1216,1217, 1223, 1238, 1242, 1250, 1253, 1257, 1259: n = A,T,C or G
ttcnacnnncaantnncnnntcgtnttatntancaangtattnngnncangntanntntcatatgtnnaaaacnggnnncgnttantantanacnctannnntannganangtncncttntanatctgtgncaaatatatcgtnangtgaactcanngnnnacacnacanatntnntngtanacncannnccagantncttgaactntctnncacaancatnnngaaanaaatacntagtnntnccaatttattgatcgnantnngcacgagaaaacaccntncatggcacctcgtttggnncaaataaggctatgtttttgaaagtaacctttccacaagncaataacagaagctatggtgaaatgtaaaaattcacaattctactttgtttcactgagtgcccaatcaacgattcatacagttgagatgaatgtgacaaaactctctatagataaatatatattgcctaagtttatctatatatatatgtctttgtgtgtaatattcatacacagatatattgcaanaganattaaatantcttncttacataaaccancnntaggatcattntnncagggaatatgaganttacacncataggntcctatgantggancatnnagacatatnataaacnntttangaaaagantangccattnnatntctcctgatntcatnaacttnannccncantnanttcncancanctnntttncatctncttangntngcnctnannnnantnncaattcntagtatggactctnntttnncgancaganngtntncttcatntccnaatntantatnanctaacanaatntggnnatatnntgccatntanntccgnaanacgcatatnatnncgtagnaccnacngtntcacntntnctcncttatctaccacattgatcgtnntagcancggtcgttacantntntcatatacatcgnanatctcgcnatntcnacatataattanannnnantatnnatgnnaangtnctctnatatgangtgcacataattcatncgagtncacgntntanatnnacatanantntctactgttttannccgncatgtcagnatatgtttcgagntcnctnnntcatcgannnacgncgtgcntntctcacgtctnttatcgnctnntatcatgcncnatttnntcntctgtantcattntatgcatatanagtgacgnacnnatctcnatcattttcatattntttnctcgttancanactncn

SEQ ID NO: 7670 - DNA, 768 bp, Homo sapiens
  misc_feature 2, 3, 4, 5, 6, 10, 16, 25, 29, 552, 621, 699, 712: n = A,T,C or G
gnnnnntttnagatcngctctttcntatntgcaggatccctcgattcgaattcggcacgaggtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagcccgggtgtggtggcacacacctgtagtcccagctactcgggaggctgangcaggagaatcgtttgaacctgggaggcagaagttgcagtgagccaagatcacactattgcacttccancctgggcgacagggcaagaactctgtctcaaaaaaaattaaaactgaccatctagtccttggcatctgggcacccttnaaaaaaagccttntagaactatagtgagtcgtatttacgtagatccagacatgataagatccattggtg

SEQ ID NO: 7671 - DNA, 752 bp, Homo sapiens
  misc_feature 9, 37, 38, 39, 58, 61, 70, 543, 611, 689, 750, 752: n = A,T,C or G
tcagctctntttatatatgcaggatcccatcgttgcnnnttctgcacgatcgtatcanganattcctgcncttattcttccttgaagtgcccgagcatgtagggcaagaaaggaaggctgaagcgctgtccctaggaggaatttctccttcaggggagcctcagttttgcccatttatctaattgaatcagttttttacccaatcccccgattttgtagggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgangcaggagaatcgtttgaacctgggaggcagaggttgcagtgagccaagatcacactattgcacttcancctgggcgacagggcaagactctgtctcaaaaaaaaattaaaaactgaccatctagtcctttgcatctgggcaccctnaaaaaaaaagcctttagaactatagtgagtcgtattacgtagatccagacttgataagatncn

SEQ ID NO: 7672 - DNA, 767 bp, Homo sapiens
  misc_feature 8, 9, 10, 11, 37, 39, 401, 416, 536, 583, 619, 649, 650,656, 667, 676, 680, 682, 684, 686, 691, 693, 698, 703, 707,711, 712, 715, 716, 723, 724, 725, 730, 731, 744, 747, 750,755, 763, 767: n = A,T,C or G
gaattcgnnnncagacaagaaaaatgattcaaaaaantnttgagccacttttggataaggaatcaattttttagaatcctactttggatttaccttgttctatagggagaactgagggaactgcacattcatccagtacctcagatgtggatttcacgggtgcttccagtgcaaaagaaactacctcgtctagcatttccaggcattatggattatctgactccagaaaaagacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttancacgatcaggagttncaactcaatcatctaaagaactccattaccaagttattttggtgctgcaggtagaatagcatgtggcgaaaaatcccgagttttggcacgtcgggtgacacttgatggaaaggtgcagtntcttgtggaatggggaaaggaccaactgcatcctgactgtaaggacngaacattatgttccactgcactctgattttctgtanggtaccagttccaaacccctaaaggagccnnggcttntactatttttnttttaaaancaanantncncaccncnctttnccccntatntccnntcnnccccccnnnttccnntcccccttccctnctnctnctctncccccacncccn

SEQ ID NO: 7673 - DNA, 1000 bp, Homo sapiens
  misc_feature 2, 3, 4, 7, 9, 11, 12, 18, 20, 21, 22, 23, 24, 27, 28, 31,39, 50, 53, 56, 60, 61, 69, 73, 74, 75, 76, 77, 78, 80,81, 82, 83, 84, 87, 90, 93, 96, 97, 102, 103, 105, 111,116, 118, 125, 133, 142, 144, 145, 149, 151, 153, 155, 159: n = A,T,C or G
  misc_feature 161, 167, 172, 174, 177, 181, 183, 184, 187, 191, 192, 193,204, 209, 210, 215, 223, 225, 232, 235, 238, 240, 245, 246,249, 252, 253, 254, 255, 259, 268, 271, 274, 278, 286, 292,293, 297, 305, 306, 313, 314, 317, 327, 328, 332, 334: n = A,T,C or G
  misc_feature 346, 350, 351, 356, 369, 371, 381, 388, 390, 391, 393, 397,405, 412, 413, 417, 439, 442, 443, 456, 460, 478, 480, 481,482, 488, 491, 508, 523, 531, 535, 539, 542, 548, 561, 573,577, 580, 587, 593, 596, 598, 600, 601, 602, 607, 620: n = A,T,C or G
  misc_feature 626, 636, 639, 642, 648, 652, 664, 670, 672, 673, 677, 682,685, 686, 697, 705, 712, 713, 720, 730, 734, 740, 753, 755,758, 764, 770, 772, 787, 789, 791, 800, 803, 812, 813, 816,817, 818, 824, 826, 832, 835, 842, 845, 848, 849, 856: n = A,T,C or G
  misc_feature 857, 860, 867, 869, 872, 875, 877, 883, 885, 889, 896, 903,906, 913, 916, 922, 925, 929, 936, 942, 943, 944, 946, 950,953, 961, 968, 976, 983, 990, 992, 995, 997, 998, 1000: n = A,T,C or G
annnctntncnnacatcngnnnnntcnnctnattcaaanccttttcaatntcnctnacgnntcataatnattnnnnnncnnnnnccnatnttnttnnatcanntntttttnatatnancatattnttacaatnccttattanannaatntntntntccntnctttanaacancntcntccnannaanttcnnntattttaattncctcnnacccnacctattncnattcaanatntancnaattnntanctnnnnaatntactaaacncanacncatnaccactantacctnnaatntacatcannctatttnntantcccttatannctancnttcttatcatantacnnctatntattctactcttnancatatctcanctcatcncnncnaccntctatatntattttnnttcncataaaattcttattcttcaancannaaaatcacatttnattncactatctcaataaaaantnnnactccntcnaatcctctctaacaatnattacattacatatnaattaaantcantctnctnattcanaatcatctattcntcccactataantatntcntcttcanttatantantntnnnattcnttccatttattantctcantacatactanatntanctatcntccnttccttaactcnctactncnnatanaatanaannttcaaattcantaatacantcataannctaaaanacaaataatntaanttatantcccacaccactnanccntataantattcntntatattctaatcatncntntattcttcnacnttttcattnncannnttcaantnatctantanatatttnttntanntcactcnntanctttatnantanttntnttttananacantataccntctaacnatnatctttntcntacttnaantctncatattnatcatnnntncatnatnactatttnaaaatcntatcacancttctancacactncnctntnncn

SEQ ID NO: 7674 - DNA, 727 bp, Homo sapiens
  misc_feature 2, 3, 11, 461, 473, 474, 475, 476, 477, 478, 479, 480, 481,482, 483, 484, 485, 486, 487, 488, 489, 490, 491, 492, 493,494, 495, 496, 497, 499, 500, 510, 511, 518, 528, 537, 538,540, 544, 549, 550, 559, 565, 566, 567, 568, 570, 574: n = A,T,C or G
  misc_feature 577, 580, 584, 585, 586, 591, 592, 593, 594, 595, 596, 597,598, 599, 600, 601, 602, 603, 604, 605, 606, 607, 608, 609,610, 611, 612, 613, 614, 615, 616, 617, 618, 619, 620, 621,622, 623, 624, 625, 626, 627, 628, 629, 630, 631, 632: n = A,T,C or G
  misc_feature 633, 634, 635, 636, 637, 638, 639, 640, 641, 642, 643, 644,645, 646, 647, 648, 649, 650, 651, 652, 653, 654, 655, 656,657, 658, 659, 660, 661, 662, 663, 664, 665, 666, 667, 668,669, 670, 671, 672, 673, 674, 675, 676, 677, 678, 679: n = A,T,C or G
  misc_feature 680, 681, 682, 683, 684, 685, 686, 687, 688, 689, 690, 691,692, 693, 694, 695, 696, 697, 698, 699, 700, 701, 702, 703,704, 705, 706, 707, 708, 709, 710, 711, 712, 713, 714, 715,716, 717, 718, 719, 720, 721, 722, 723, 724, 725, 726: n = A,T,C or G
anntcaatcgnacgagactgttcagttctggcttgaaaatgtgtgtgccatactgtgacccacgggcagcccctcctcctctactgtgtcaggtggaccagggtcacctctgttctgcgcagctttgagattctaggattctacggccggcacgaatggcatgggagggttctctgcacgggacggcataacggcatgccatccttcaggctggcaggagcctgcgcaggtgtggcaaaatcttgaaacagcctgtgtcctgcctggcttttcactttcctatttaatataagaaagcacttttttttctgctttacctacaaatgggttgaaaatggcctcctctgtcctctcctctcttttatacactctgtaaaatcacaaaggtgcttcaacaccgactgtcatgcagtgctgttttgtgaattggcagtttctgtataaactcttatttatataanaaaaaaaaaaannnnnnnnnnnnnnnnnnnnnnnnnanncccccccccnnaaaaatnttgggggggntttttccgnnancccnaactnnaaaaaaccnttgggnnnntnggcnccnccncccnnnaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 7675 - DNA, 1039 bp, Homo sapiens; identical to SEQ ID NO: 4680
  misc_feature 8, 11, 14, 16, 19, 26, 28, 33, 35, 41, 42, 43, 47, 48, 49,57, 59, 60, 64, 70, 72, 74, 102, 105, 126, 146, 147, 151,153, 157, 170, 196, 198, 204, 211, 213, 218, 233, 235, 240,246, 247, 250, 256, 257, 264, 266, 268, 295, 296, 297: n = A,T,C or G
  misc_feature 313, 317, 330, 336, 344, 354, 384, 394, 396, 408, 411, 422,430, 432, 435, 443, 445, 464, 474, 482, 489, 492, 493, 494,495, 499, 510, 513, 516, 522, 528, 538, 542, 554, 559, 564,569, 570, 574, 575, 580, 584, 589, 591, 598, 605, 606: n = A,T,C or G
  misc_feature 607, 610, 615, 630, 632, 635, 636, 637, 640, 642, 646, 647,649, 650, 652, 653, 654, 663, 665, 670, 684, 685, 688, 693,697, 699, 704, 712, 714, 739, 742, 743, 750, 752, 755, 762,776, 778, 779, 781, 783, 790, 792, 793, 795, 797, 801: n = A,T,C or G
  misc_feature 802, 804, 805, 808, 810, 812, 814, 821, 829, 834, 835, 839,842, 851, 852, 855, 859, 863, 868, 869, 871, 876, 877, 878,891, 892, 896, 897, 898, 899, 908, 919, 921, 930, 932, 935,936, 939, 940, 941, 945, 949, 955, 961, 962, 964, 965: n = A,T,C or G
  misc_feature 967, 970, 972, 979, 993, 995, 997, 998, 1004, 1012, 1015,1031, 1034, 1036: n = A,T,C or G

SEQ ID NO: 7676 - DNA, 759 bp, Homo sapiens; identical to SEQ ID NO: 4681
  misc_feature 3, 4, 11, 13, 20, 577, 655, 657, 748: n = A,T,C or G

SEQ ID NO: 7677 - DNA, 980 bp, Homo sapiens
  misc_feature 1, 2, 4, 5, 7, 8, 9, 10, 12, 13, 14, 15, 16, 17, 20, 22,23, 24, 26, 27, 28, 29, 30, 31, 32, 33, 34, 35, 37, 38,39, 40, 41, 42, 43, 44, 45, 47, 48, 49, 50, 51, 52, 53,54, 55, 56, 57, 58, 59, 60, 61, 62, 64, 65, 66, 67, 68,69, 70: n = A,T,C or G
  misc_feature 71, 72, 73, 74, 75, 76, 77, 78, 79, 80, 81, 84, 86, 87, 88,89, 90, 91, 92, 93, 94, 95, 96, 98, 99, 100, 101, 103, 104,108, 110, 111, 112, 113, 114, 115, 116, 117, 118, 119, 120,121, 122, 123, 124, 126, 127, 128, 138, 142, 143, 144: n = A,T,C or G
  misc_feature 145, 155, 156, 158, 159, 162, 163, 164, 165, 167, 168, 169,170, 172, 175, 176, 188, 198, 212, 215, 216, 222, 229, 249,259, 261, 267, 269, 274, 278, 279, 281, 285, 290, 292, 293,294, 295, 297, 304, 310, 311, 312, 317, 442, 446, 557: n = A,T,C or G
  misc_feature 561, 587, 664, 673, 698, 699, 709, 720, 743, 766, 795, 801,819, 825, 856, 863, 887, 892, 899, 917, 920, 922, 940, 948,952, 964, 970, 973, 976, 977: n = A,T,C or G
nntnntnnnntnnnnnnttntnnntnnnnnnnnnntnnnnnnnnntnnnnnnnnnnnnnnnntnnnnnnnnnnnnnnnnnncangnnnnnnnnnnntnnnntnncttntnnnnnnnnnnnnnnntnnntccccccccncccnnnncccccccccnncnnttnnnntnnnnanganntaccagtaggancgaagttatnctaccacatgaatnatnntgcggncttgtangagttggtggggcaggcagntgccttattntntgaccngngacanctgnnancacngggtnannnntntgctctntggcgnnnccccntgtgaccaggtgcatcttcagcctgcatccccttcccaggagccaggccactccctcagctgccagaggctgggtccctgctggggccagggtgggatggaaatagacatgagcaagacaaaatngcanatatgaaactgttgtccttgagggtgtcacatttgggggtggggacaagggtggggagataggcaagtcggcaatgtataccattgcagtgggttggggggtggcccacanaagnggagtcacagcctgaaacaccccctncacagcccttagaggccgggcttttatgattcccacttttacaggatggggaaactgaggcttcaccgtgcttaaanttacttgtnccaaattcctttaaactccctagtnnttgagtctcntaagtccattntcagcccatgggtgaaatagccngggggggaatttaaaaccctacnttgtgttcttttcccaaggggcccccgantcaaanggaaaggcttttggtatnaagaanggtcaccacccccgagccccagccttgattnttaaatnattttggttttaattcttgaaaanaaaantgaactngggatattaccagggaanccngngggccaaatttaatgganatgttttngccntaagggaaccancctgtnagnccnngcg

SEQ ID NO: 7678 - DNA, 1336 bp, Homo sapiens; identical to SEQ ID NO: 5093
  misc_feature 4, 5, 6, 8, 9, 10, 11, 12, 13, 14, 15, 16, 17, 19, 20, 21,23, 24, 25, 27, 28, 29, 30, 31, 33, 35, 36, 38, 39, 41,43, 44, 45, 46, 49, 50, 51, 52, 53, 55, 57, 58, 60, 63,65, 68, 70, 71, 72, 74, 75, 76, 77, 78, 79, 80, 81, 82,85: n = A,T,C or G
  misc_feature 86, 87, 88, 90, 92, 93, 94, 95, 96, 98, 99, 100, 101, 102,103, 104, 105, 108, 109, 110, 111, 112, 113, 114, 116, 117,119, 120, 121, 123, 124, 126, 127, 128, 129, 133, 135, 136,137, 138, 140, 141, 142, 144, 145, 147, 148, 149, 151: n = A,T,C or G
  misc_feature 154, 158, 161, 162, 164, 165, 166, 167, 168, 169, 170, 171,172, 173, 174, 175, 176, 177, 178, 179, 180, 181, 182, 183,184, 185, 186, 187, 188, 189, 190, 192, 193, 194, 197, 199,202, 204, 215, 221, 237, 239, 240, 247, 250, 251, 253: n = A,T,C or G
  misc_feature 269, 270, 276, 280, 289, 290, 309, 310, 313, 319, 326, 328,335, 345, 348, 351, 354, 355, 356, 357, 359, 364, 365, 366,367, 368, 369, 371, 372, 373, 376, 377, 383, 384, 385, 386,387, 388, 390, 391, 393, 394, 404, 406, 407, 410, 416: n = A,T,C or G
  misc_feature 419, 423, 425, 426, 431, 432, 433, 434, 437, 438, 442, 444,445, 446, 447, 455, 469, 472, 480, 482, 483, 484, 492, 495,498, 500, 501, 503, 509, 510, 512, 520, 521, 535, 537, 538,543, 549, 552, 553, 554, 557, 558, 559, 561, 562, 563: n = A,T,C or G
  misc_feature 567, 568, 572, 577, 578, 579, 582, 584, 586, 589, 593, 594,596, 603, 607, 610, 612, 614, 616, 618, 621, 625, 626, 628,631, 635, 642, 652, 663, 666, 667, 672, 682, 684, 685, 689,698, 712, 718, 725, 731, 737, 746, 750, 754, 756, 762: n = A,T,C or G

SEQ ID NO: 7679 - DNA, 1328 bp, Homo sapiens
  misc_feature 7, 8, 19, 21, 22, 28, 34, 35, 38, 40, 42, 46, 47, 48, 51,58, 75, 77, 86, 89, 90, 93, 94, 98, 106, 107, 108, 109,118, 126, 140, 146, 151, 152, 155, 157, 162, 169, 175, 177,189, 190, 192, 196, 197, 198, 200, 214, 219, 227, 228, 230: n = A,T,C or G
  misc_feature 231, 242, 247, 264, 265, 267, 270, 278, 295, 296, 302, 303,304, 314, 315, 316, 320, 329, 330, 331, 338, 339, 340, 348,356, 361, 366, 369, 371, 372, 379, 380, 384, 391, 395, 396,397, 404, 405, 409, 410, 414, 417, 423, 428, 432, 438: n = A,T,C or G
  misc_feature 441, 451, 452, 456, 459, 460, 461, 465, 471, 477, 478, 480,496, 499, 504, 515, 518, 534, 537, 538, 545, 546, 548, 550,552, 562, 571, 574, 575, 576, 583, 588, 589, 591, 592, 596,614, 623, 624, 629, 635, 640, 641, 648, 652, 653, 654: n = A,T,C or G
  misc_feature 661, 663, 665, 676, 681, 687, 695, 705, 714, 717, 718, 721,724, 729, 732, 735, 739, 755, 771, 774, 776, 779, 781, 785,789, 793, 799, 807, 808, 817, 818, 821, 825, 827, 834, 836,839, 840, 846, 849, 852, 855, 856, 863, 865, 866, 870: n = A,T,C or G
  misc_feature 871, 872, 875, 880, 882, 887, 895, 905, 930, 932, 941, 942,944, 946, 953, 961, 967, 972, 977, 979, 980, 986, 988, 990,992, 995, 1000, 1002, 1009, 1014, 1015, 1022, 1023, 1029,1033, 1040, 1046, 1055, 1056, 1059, 1071, 1074, 1075: n = A,T,C or G
  misc_feature 1077, 1092, 1094, 1101, 1105, 1111, 1117, 1122, 1130, 1149,1151, 1152, 1157, 1159, 1163, 1165, 1167, 1175, 1183, 1187,1192, 1196, 1199, 1205, 1221, 1226, 1229, 1235, 1255, 1257,1259, 1260, 1265, 1266, 1271, 1274, 1277, 1299, 1302: n = A,T,C or G
cttatgnnagatcttatcncnntaactngacatnnaanangnagtnnntcnctagccnattaacacattccgatntntattaaccnccnnccnncccnccccctcnnnnttccaaagntaaatcgngggagaaaatctcnttcggnccccnntgnantttgntagaganaatgtntnttgctatggttnngngggnnngnctatctttttactnggggnattttatnntnntaacacatctntgaangctatcctaccttactnnanatnatacgagnaaatcatgaccacttcnnatgacnnnaaacatagannncacnacccttctnnncgagtannnctcctagnacttattntatangtagnatnannaaattcnnaatnatttcgnacannncttttannttanntagnatnagactnattanttancgattnatntatactatannctanctnnncacntagcanacttgnnanacaggcagtacctagnctnattcngctcagcacanctntaatccaccaggaaanaannatataanncnancntgtaatatcntttttatcnctnnncactggnatcanncnncatntgattcatcatacgaatntatatttcnntcttnggcatnatatnnattcatnatannncgctctncnanacaccacatanataantatagngctatatnattaaattcncaatctggnacnnacnaanttaanaancanctanctacacacacaatcanaattcacataatgacntantntcntnacanatanatanctaatntagaaagnnttattctgnntancccncncttaatntngcnntctcgnttntgnatnncgataanannaacnnnatnttatntntacanaaaatagnacatatggcnctacatctacgtatgcgcatacacngncttatgaanntncncacgtgnacgagacntactancacangtaananntcttcncnantnagngctantntcacatnacacnntctaganntaactnattncacagancatacntcttatcannatnttaatataacgnacnncncattcatcacatcananctaacanagantgtganatatanactanctaagttnattaaaacatagttacatntnnatatnantctnancntatatcgnctcctatnttancttcnctcnatntgcaantgtatcaatactcatnactanagnattctntctctatattttaattttcntntnntatannttacntantcntcacaccctatactaagatttnatnanantctnatctanccactanatnnn

SEQ ID NO: 7680 - DNA, 740 bp, Homo sapiens
  misc_feature 45, 73, 112, 169, 237, 260, 367, 411, 412, 421, 441, 442,450, 460, 471, 479, 480, 491, 501, 530, 545, 561, 572, 573,600, 610, 614, 617, 623, 626, 628, 644, 647, 651, 656, 657,662, 669, 670, 681, 686, 688, 690, 697, 698, 702, 705: n = A,T,C or G
  misc_feature 712, 714, 715, 718, 736: n = A,T,C or G
caccccatcgtgtacttaactgtgcgtgacgtgtgcttttggtangcatcactgtgcccaagtatttcatgtncattgtaaagaggaaaaatacagatttctctataatgtnaccacttatttctaattgccacttttcatcttgtggaaatgccatgttctgattcantcttctgaatttgaacattattcaggttatttccaattgctgggaatatccttactgctaaaataaanccttagcattggaattgctaggncaaagattatgcatgctttttaagggcttttgaaatgtattgccagtctgtggcctgccaccctccctgaacatgcctggtcttgcttaaaatgtattgccagatantccttgggaagttcatgttgtctttaacaatgtgaaatagtacnnctattcacnttccttttgtctgacaattnngataagtnaataattgtntcccaccattntgtagtannggtttttaacntggaaatccnaatcaatacctgggctgaagcatcagtgnttccaccctacctanccaaaaaaaggattcnagggtattccnncaatcagtacctgccctaatatattanagcccttacngganatnaatcanaanangcttttaaaaacaaanaancccnggacnnggccnttttacnnaaatgcccccngcccntntnaaaaagnnactnggnttttaangnnatngaaaatggcctttgggcncgtt

SEQ ID NO: 7681 - DNA, 1003 bp, Homo sapiens; identical to SEQ ID NO: 5431
  misc_feature 17, 18, 19, 20, 21, 23, 31, 33, 44, 45, 51, 52, 63, 72, 75,80, 86, 89, 94, 96, 97, 99, 100, 122, 129, 130, 132, 136,147, 152, 156, 175, 176, 180, 183, 185, 186, 191, 196, 197,213, 214, 221, 229, 231, 234, 240, 244, 245, 248, 252: n = A,T,C or G
  misc_feature 257, 269, 277, 281, 282, 284, 289, 298, 299, 301, 317, 320,321, 322, 327, 338, 339, 347, 350, 355, 358, 360, 373, 378,397, 398, 403, 411, 434, 447, 460, 463, 474, 488, 493, 498,513, 518, 531, 533, 536, 539, 544, 549, 556, 563, 583: n = A,T,C or G
  misc_feature 595, 597, 604, 612, 620, 623, 627, 634, 636, 639, 642, 644,654, 660, 662, 664, 665, 670, 681, 682, 687, 693, 696, 698,711, 715, 725, 730, 745, 746, 751, 756, 776, 797, 798, 799,802, 811, 828, 833, 836, 844, 845, 856, 858, 859, 877: n = A,T,C or G
  misc_feature 882, 885, 890, 897, 907, 909, 911, 917, 925, 934, 935, 938,948, 955, 965, 967, 971, 973, 974, 976, 991, 1002: n = A,T,C or G

SEQ ID NO: 7682 - DNA, 740 bp, Homo sapiens
  misc_feature 7, 24, 38, 77, 106, 107, 429, 513, 528, 545, 630, 631, 676,683, 695, 716, 722, 729, 740: n = A,T,C or G
actttcnaatcgcacgagagacantctcctgcacacgnccctgtgggaaaagccagcttctgtttgcactggtcttnacaactcgttacctggatctttttacttnntttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgnaatcttgtcaactggatctggcgcttctacttttgaggggcttctttgacctcatttgcttggtggtggcccggcgtagtccanaccattctatactgngacttttttctacttgnacattacaaaaagtacctcaagggaaagaaagctcaatttgccaaccataagtgcccaaaacccatcacccacatctgttccttnnagggtgcttcggacagaattcttacacagcaaaaggcataaagangcttganccggaaaataanaaacttaactcttttgttccnaaaagncatcaanggctcctttan

SEQ ID NO: 7683 - DNA, 651 bp, Homo sapiens
  misc_feature 1, 38, 44, 47, 54, 57, 59, 60, 67, 68, 74, 85: n = A,T,C or G
ntgacattgtgattgcaaaaagcccaagtgatccacantcaaangtntgactgnganannaactggnnatgagncaatgaacttnttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcatttttgattataatccatcaatgacaacctaataccttgcaaagaagcaggattgaagtttccaaggagagattcttcagaatgtaaa

SEQ ID NO: 7684 - DNA, 820 bp, Homo sapiens; identical to SEQ ID NO: 4746
  misc_feature 538, 582, 589, 608, 628, 638, 648, 667, 675, 685, 688, 699,707, 718, 733, 755, 771, 805, 817, 819: n = A,T,C or G

SEQ ID NO: 7685 - DNA, 690 bp, Homo sapiens
  misc_feature 12, 32, 621, 634, 640, 669, 673, 681, 686: n = A,T,C or G
gtatcaatcgcngtaacctgttcccttgatcntgagttttagctcagataaccaggtattttgaagacgtgattgtccttggccctgccccatcccttccctttaaagttttaaatttttttcatgtcttttctttggccagaatttctctatcccctgcatgccttcctcggttaccataaatctgcattatcctaggaaagatgaagcccacagattgtacgatttcagagtacttcctgggcccctgtgtgatccgacagaggcctggtcatcaagttggacttccctatgtgaaaccataaactaacctgaggaagatactgaggggagaggggctgtgtaacggtgactgcctctaggccagccttctgccaggcagagaacaggaagctggcatgcagggtgtctggcactggtaaaatgacaccatgtttgtaagtgcattgtcctggcttttggtgggccgtgcaggagttcctgcctgaattatagtctttccatctcatatcttcatgtggagccctcaagctttaaacaaagtctttttatctccggttttcaagggtgggctcccattatctttgagaacctcataatgctgcttttcctttaaatttngttttacacttgnccgctnggtcagcacaagagctacttcacattttntggncccccacntcggnttca

SEQ ID NO: 7686 - DNA, 727 bp, Homo sapiens
  misc_feature 3, 22, 30, 40, 616, 656, 699: n = A,T,C or G
acnttcaatcggcacgaggctngttctggngaaagctcantaagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacagttataagaacagtcaattttttaaattttccaaattaaaaaattgcaccatgattttgaacaagcacttccaattacattacccatcttgtatgccataggtgggagtataattgtcacagcctttaggaatgtagttttccgggatttattgaaactttgaaccttttggcctactaagttcattcctaggaaactgcctaatgggaatgatctgacaagtgtacacaagcaaagtcattgcacctttggtctttaatacttaaaactaacccaaatgcccttgcagtaagggactggtttaataaatggtancctttatgccaatttgttctaaagtattcgtttaagagangtggaggaatctcttggattattagggcaagaattctaacttnggtaaaaaaaaagtggtgcaagcatttt

SEQ ID NO: 7687 - DNA, 460 bp, Homo sapiens; identical to SEQ ID NO: 4775
  misc_feature 4: n = A,T,C or G

SEQ ID NO: 7688 - DNA, 516 bp, Homo sapiens; identical to SEQ ID NO: 4658
  misc_feature 9, 10, 13, 112, 129, 141, 150, 170, 184, 186, 192, 193, 206,211, 213, 220, 226, 231, 238, 240, 273, 278, 289, 307, 315,320, 354, 370, 374, 378, 390, 407, 453, 473, 497: n = A,T,C or G

SEQ ID NO: 7689 - DNA, 1207 bp, Homo sapiens
  misc_feature 6, 24, 41, 110, 112, 133, 134, 137, 147, 154, 162, 164, 167,168, 170, 175, 177, 186, 187, 190, 201, 206, 209, 212, 214,217, 218, 219, 220, 222, 230, 235, 240, 242, 247, 248, 251,260, 263, 266, 268, 274, 277, 278, 291, 293, 294: n = A,T,C or G
  misc_feature 297, 309, 315, 316, 318, 321, 322, 327, 330, 355, 356, 358,362, 363, 374, 377, 378, 380, 382, 383, 388, 389, 391, 392,393, 396, 402, 407, 415, 421, 429, 432, 433, 435, 436, 438,445, 465, 466, 470, 471, 472, 474, 476, 477, 481, 484: n = A,T,C or G
  misc_feature 495, 506, 514, 516, 519, 523, 528, 530, 540, 541, 543, 546,547, 553, 560, 578, 580, 581, 582, 585, 590, 591, 593, 597,607, 618, 630, 631, 634, 639, 644, 653, 654, 656, 663, 669,677, 684, 692, 695, 718, 719, 725, 727, 729, 744, 745: n = A,T,C or G
  misc_feature 752, 759, 769, 773, 774, 790, 792, 793, 795, 796, 800, 804,811, 812, 813, 818, 820, 826, 833, 854, 855, 858, 859, 860,862, 868, 879, 880, 881, 885, 888, 889, 892, 894, 895, 897,908, 924, 925, 926, 936, 939, 940, 956, 961, 962, 964: n = A,T,C or G
  misc_feature 973, 993, 994, 1014, 1017, 1021, 1022, 1024, 1027, 1037,1041, 1061, 1073, 1085, 1088, 1096, 1109, 1115, 1119, 1122,1124, 1132, 1134, 1145, 1148, 1157, 1161, 1166, 1170, 1180,1185, 1188, 1191, 1196, 1198, 1204: n = A,T,C or G
agattntcgaatcgcacgacttgnccctgtggggtcttacncgatgtgtctctgagtagtaaaggcttagccttgttcctgttatgttgcaagaaggaggggaaggttcngngatttcttctgatttattctnnggntccatgtganccggccntcacgtgnanccnncngcacngnacgctcctnncgnatccacatacnccagntanacntnctnnnnanccaccacncccanctgcnantccanntcncccaacgcncangcntnagcctntannccccccaccctcncnnagncctactacaccnccattnnanccnnccccnaanatcaccccctttcctaccatcgtcnnancacnncccatctacantcnncnannaccgnntnnnccnccagtnatcanttcactcntacccncacgcctncanngnncnaactctnccctgccaatcatgttctanngcannncncnnctcntancctactcatcntattaaacttntctctttncnctntgcnacatnanactcctcttnngnctnnctcatnatccgcnctacactcaacattctgncnnnatnctatnngnaccntaaaataccntcacataatcntgacgcacatcnntcnctacnaatcnattgtcatnntnatctccncctctntaccatantctctcntaacagtnatntctcattctcaaacttcgccatnncccacnantntctcttacgcacacnntcctaanccctatncataccattnaatnncctgccttgctatgananncnncgancacntacacannntgtancnaactanatacaantatcgctccctctcactaacnnctnnncntaatanaacataagccnnnctancgnntcntnntnacaaccacatntactcttacgcactgnnntctctctttnggnntcctctttcgcaacgnctcannantccacacgntccttacgcccatcatcctnnccctacagtatgtaatcccntanattnntncanatattcatcnccangcccgctactgataccttcnctgctaccatcnctccccctatanttncgtctcgnaccaatctacgtntacacngttncananccaataancnacctcatgctncgnacatacganacanatgcncatnatccacattnccctnccncanacatntntctaanccc

SEQ ID NO: 7690 - DNA, 466 bp, Homo sapiens; identical to SEQ ID NO: 4660
  misc_feature 2, 85, 412: n = A,T,C or G

SEQ ID NO: 7691 - DNA, 723 bp, Homo sapiens
  misc_feature 23, 25, 37, 40, 62, 77, 651, 667, 682, 683, 684, 685, 692,693, 694, 695, 696, 698, 699, 700, 701, 702, 703, 704, 705,708, 709, 710, 712, 714, 718, 719, 720, 721: n = A,T,C or G
aggttttcgattcgcacgatatntntcacatgttaanaanatatgtacccaactgtgtttgnttgtttcctgactgngaacactgaagaggactagatcaaaaatgaccaattgagtagcaattgaacatttacagtgctgtgtgcagtgaacttctgtagcacccaaattgtggtgttgggaaaaaccattccaccttaaaagaaaccaagcctttctggcaaaattgctgattctaggttttgggcaagaaatgtacatgctgagctggaacattgtcataacagttagtaaggaggctgttaaagactatttagggtcatttcagaaagactggagaaatgactgtagaattcccactggccagagatcggtagaaacctgtgaagtgtgtttaaattcttgagttcataatggtattttaaaaaggaattggttactcttagattagagcatgataggaacaaatttattaccttgaacattggtaaatacaagaaagaacaatttatcctgcttttcctatgtgagtgtacctctggctaacaaaatagtagatatgggagagctatttcaattgataaatgaaaaaagaaatggcagaattgcaataccaccattttataacttttggtgaacgaatgggtctangtggtgagcgtcgatngctactacatccccnnnnaaaaaannnnntnnnnnnnnttnnnanangaannnnct

SEQ ID NO: 7692 - DNA, 464 bp, Homo sapiens; identical to SEQ ID NO: 4665
  misc_feature 4, 5: n = A,T,C or G

SEQ ID NO: 7693 - DNA, 709 bp, Homo sapiens
  misc_feature 5, 11, 15, 31, 488, 532, 538, 542, 586, 615, 651, 663, 666,678, 685, 705: n = A,T,C or G
atgtngaccanttcngcacgaggattaatcntcttgttctttaaaagtcaaaaggctttttgacctttaaataactcttacatctggtcatcactgttgaaatgttctactaaattttcagagtggaaaagttttaggcttaaaactgactggtaaaaatagaatatttctttgtattgatttttcagtatagctgtacagccagttatccttcgttaagtgtttcggtattaaaactgctcacatttgtaaatattgagcagctttattgtcagaacaagaatcccttggtttcccaatccccaacttttaacattgtaattaaacatcctgtataacctattttattctctgccaaacaattttatgactgctgtttttactctttgtgatgaaaatgggatggagaagataaggttctttgccttatggtggtatttattatcatcctccatcaatgcagattgggtaaatagagaaaaattcangccgggtgtggttgtgcacatctgtagtcccagctgcttgggangctgangcangagaatcgcttgaacccaggagtcagaagttgcagtgagctganattgcccactgcactccagctgagcacanggtgaaactctgctcaaaaaaaaaaaaaaacccttnaaactatggggngcntttccgaaaccnaactganaaaaactttgtgagttgccnccct

SEQ ID NO: 7694 - DNA, 1372 bp, Homo sapiens
  misc_feature 1, 4, 7, 10, 11, 14, 18, 20, 21, 26, 28, 31, 35, 36, 38,40, 42, 44, 49, 53, 54, 56, 57, 61, 62, 63, 65, 66, 68,72, 76, 81, 91, 92, 93, 95, 104, 106, 119, 120, 121, 132,144, 149, 153, 170, 171, 178, 181, 183, 186, 190, 192, 203: n = A,T,C or G
  misc_feature 205, 207, 208, 221, 223, 225, 240, 249, 250, 251, 260, 262,263, 264, 277, 281, 283, 290, 297, 298, 305, 307, 309, 314,315, 316, 323, 324, 326, 329, 332, 333, 339, 340, 343, 351,352, 353, 358, 360, 365, 377, 378, 381, 388, 390, 400: n = A,T,C or G
  misc_feature 402, 404, 407, 416, 420, 425, 432, 434, 435, 436, 439, 440,441, 442, 456, 459, 463, 467, 469, 471, 475, 478, 481, 482,496, 514, 515, 516, 517, 523, 527, 530, 531, 536, 539, 540,548, 549, 550, 551, 554, 561, 563, 564, 568, 571, 577: n = A,T,C or G
  misc_feature 578, 579, 589, 591, 592, 593, 600, 605, 614, 615, 617, 623,625, 636, 638, 646, 647, 650, 655, 670, 682, 684, 687, 701,706, 711, 715, 720, 731, 735, 744, 748, 750, 756, 760, 770,773, 777, 779, 788, 801, 804, 810, 816, 819, 826, 829: n = A,T,C or G
  misc_feature 831, 838, 839, 840, 841, 845, 851, 859, 860, 869, 873, 876,878, 880, 882, 885, 891, 898, 899, 902, 904, 906, 908, 925,933, 941, 942, 943, 944, 960, 962, 963, 972, 979, 1000,1003, 1007, 1023, 1027, 1032, 1033, 1035, 1038, 1039, 1044: n = A,T,C or G
  misc_feature 1049, 1060, 1072, 1077, 1080, 1085, 1090, 1099, 1102, 1106,1114, 1115, 1117, 1119, 1120, 1134, 1136, 1138, 1152, 1163,1170, 1171, 1173, 1191, 1198, 1204, 1206, 1212, 1217, 1227,1229, 1233, 1236, 1238, 1241, 1249, 1255, 1259, 1276: n = A,T,C or G
nacntantannttnatantnnttctntnatntccnntncntncntctcnttgnntnnggtnnntnntntttnttcngtttncccccccccnnntnccccctttntnttttttcttttgnnnccgtagaccgngtgaaatgattngctgngccncccggtatgttattttnntatatgnttncnatncatnantttttctatgngncnncacttttctaccntntngggggtgttttttanctccattannnattctattntnnnacttcttgattantatnangtctttntcttttnncccatcntntntcttnnncactgtnnanctnttnntccctnnttnttatcttnnntttcntnttacntaaattctctcnntcnttatttntntcttcatctntntngcnttccatttntttnttttntcctttncnnnctnnnnttcttttactcttnccntctnctcntncncctnctncanntcattttttcttanctatacgcgttattaagnnnnctactncgtnctnnatatnttnntactatcnnnntcncttttgntnnagtntantccctnnngtatttctcntnnngtctatntgctntattatttnntntctgtntntcttctactcncnatatcatnnacnatacntatatatatatacancttgtttctatntntanctacataatgttcntttantcttntttnttctnctagtatgttncttnattatctanttcntntttatntatnctatcttctnatnattntntcatacctntattcgtatatanagnaactcnacatgntangtgtccnttncnatctcannnnttantctttncattcttnngttatctgncgtnttncntntnacntgatantcatatnnccntnancntatatgatgaatcacgntgtctttntcaagctnnnntctctctttccttctntnnataaacttntgactcngtagtttacttgatcttttcnatntctnaacatcactccattcncttncgtcnngnacnnctctnttctntactattcttntctactcctctnctctnttngttanttacncctccgatnctnttanttctcacnntncnnattttctaatgtantntntggtatatttctgntatctctacanccgatcnnanctacgttcgtatagtatnctaatanttgatntnatctantgttnttttatcctncnttcntantnctntttacatnactctntttntctgttttctttatctnctatngtnaantttcctatgngtatnatncngttnctctctannatttcatcttctatctntanntctcattgtatgcttctttngcttcttcncn

SEQ ID NO: 7695 - DNA, 464 bp, Homo sapiens; identical to SEQ ID NO: 5102
  misc_feature 2, 6, 47, 76, 77, 135, 142, 159, 163, 164, 171, 179, 180,182, 203, 205, 225, 228, 231, 232, 233, 234, 241, 249, 278,280, 284, 288, 289, 305, 308, 310, 326, 332, 344, 354, 363,379, 380, 383, 384, 390, 397, 398, 400, 405, 416, 436: n = A,T,C or G
  misc_feature 441, 448, 457, 462, 463: n = A,T,C or G

SEQ ID NO: 7696 - DNA, 922 bp, Homo sapiens
  misc_feature 1, 2, 3, 5, 6, 10, 12, 14, 15, 16, 17, 18, 19, 20, 21, 22,24, 25, 26, 27, 28, 29, 30, 31, 32, 33, 35, 36, 38, 39,40, 41, 42, 43, 44, 45, 47, 48, 49, 51, 53, 54, 56, 57,58, 59, 60, 61, 62, 63, 66, 67, 70, 72, 73, 74, 75, 76,77: n = A,T,C or G
  misc_feature 80, 84, 85, 86, 88, 89, 92, 94, 95, 97, 99, 100, 101, 107,109, 110, 111, 112, 113, 114, 115, 117, 118, 120, 130, 131,132, 133, 134, 135, 136, 137, 144, 147, 148, 150, 153, 154,156, 157, 159, 160, 163, 167, 172, 200, 204, 216, 219: n = A,T,C or G
  misc_feature 220, 226, 227, 235, 241, 245, 246, 272, 278, 279, 682, 720,727, 764, 768, 850, 859, 882, 899, 920, 921: n = A,T,C or G
nnncnntacncntnnnnnnnnncnnnnnnnnnntnntnnnnnnnntnnntntnntnnnnnnnntgnnttntnnnnnnatnggtnnnannttntnntntnnnattacntnnnnnnncnntnccccccacgnnnnnnnnccccccntcnntnttnntnntnnttnaatntcgantccgcacggaggatatactacttatggnacantgagggtgcaanggnntcctannattcatgnggatgntccnnggtgtgaggagggaatctgcaattgnttgctnnacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccaccttggagcatgggctaacacccggaggaaaaggaaaagacagagtcaagacaggggacaatgaaacctttgaagtgcccantctatgaaagaggcccgggggtgggactaagaatccantgccgcncccaagagtttgaccaaccacccccctacagcaactnttgnggatccccccatcacctgagggaggaaccaacctacccattccaaaaggggtccaagggataagcccaaacctggggaacanaagcgaaanggcctccaaaggggggtccattnggccccaggaagggaancccttgggaaaaaactcccannt

SEQ ID NO: 7697 - DNA, 864 bp, Homo sapiens
  misc_feature 258, 429, 436, 492, 558, 581, 586, 595, 596, 600, 610, 617,633, 645, 646, 654, 662, 700, 708, 737, 749, 759, 763, 764,765, 774, 783, 800, 808, 811, 849: n = A,T,C or G
ttgaattccatacaagctacttgttctttttgcaggatccctcgattcgaattcggcacgaggagggaggatcccctgggttgtgcatatggcgggaaggggtattccaggagtggaggatgtcagcagggtgggaatgggatcagtgaggggaggaggagcagaggagtcagaaggatctaagggtagggctgaaggtgggaaaacacctgtagggctgtttaggacacggaaagggccttgactttgctgccaacnaagatgtgaagctccaggcaagggtaacaatctaacttacattttatgagggtcctgtggcagctgtggtgagaacagactttaagggtgctgaggtggatcacggagacctgtggccaggctcttgtgtggtaaatctggtttgggagaatggtggagaactggatgcangtaggancactggaagtggcaagaaatgactggattcttgaatattttgttcaaaagttgganccgaaccccggttttgtttgatggaccttgaattgttggggtgttgattaagaaaagaagaaggangttcaaaggaccaattttcttgnaaggnatctttaanntccnggaagccaanccttggnaaaaccaaggaaaggncttgccttgttnnaaattggnaaaaaatngggaaattgggaaaacccttggggtttttttggggttngggggggnattttttcaaacccccatttggggatttnccccatttccanttttttggangggnnngttttttcnatttcaaanccaatttccccttaaantgggggtnggnaattaatttggggaaccttggggggccccaaatttttngggaacctttttacc

SEQ ID NO: 7698 - DNA, 619 bp, Homo sapiens
  misc_feature 8, 177, 227, 236, 346, 457, 472, 487, 581, 590, 606, 615,616: n = A,T,C or G
ttgattcnatacaactacttgttctttttgcaggatccctcgattcgaattcggcacgagaagagacagcctctctcttctgtctcagaagctctgtgtttgggaaactttgagcccatggagtagcagggtctgcatggtggagtaccaggtttccctggcaatccaggtctcctntgaggaagcattctgacttcccactgaccacggaaggcatgtcagcttcntgcctcggnctagagttctgataatcggggctgaggggtgaaaagaaatccagtcagacagacagtgggggagacaggtccctgccctttatttgccgggatcaatcagggactcccanaaaggaaggagaatggtgagaaggccctaagagttcgtctctcacctggggctgtgacgtggcaccacaactgaaacagctatgggtggcggtgtgtgttaacctcacgtnctgaactgacattgncaaagaggaggagtntacattcagatggcaggcgttcaggaacaacacattattaatggctagcagtgacatatgagaaacagatcttatatctccaggtagcacccanctgttgttntcatatcttgagaganaatggatannact

SEQ ID NO: 7699 - DNA, 721 bp, Homo sapiens
  misc_feature 6, 7, 40, 117, 132, 155, 173, 197, 583, 584, 597, 615, 618,719: n = A,T,C or G
ttgaannccatacaactacttgtctttttgcaggatcttntagacctttgtgaaccagatgatgaaagtggctatgatgttttagccaaccccccaggaccagaaagaccaggatgntgatgacgatgcctntagcggatgtgtttgaatttganttttcagagacccccctnttaccgtgttataacatccaagtntctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctgggaagccttcaaccctgaaagtaaggagctgttagatctggtggaattcacgaacgaaaattcagactctgctgggctcctctgtagaagtgggcttccaccccagtgatctggcctcagacaactactggtgagcaagctggcccaccatgtacagtgtggtatagtggttaatccttgtgcatatgtgcataatacaactattctgnnaagaaaggcactntacatatgaaaatatttnttntttatataagaaaaattactccagtcagaaaggacttaaaaacatgtttttttcctttttaaacttttaaagtcaagtttttatgaaagtgggttttaatngt

SEQ ID NO: 7700 - DNA, 738 bp, Homo sapiens
  misc_feature 3, 111, 596, 627, 657: n = A,T,C or G
ttngatacagctcttgtcttttgcaggatcttatcgattcgaattcggcacgagccctatcttatgagaaaagtaactttgaaaggactaatacatcctgttcttagcttntgcttccttcaggccttctctatgaagccagcctattctgctcagcgctttggaacactgattctatttcatggaccgaagcattgcccaattgtagaattgcaataaagccaactgagatctttaaattggctataattcatcctttggcaatacagtaaaaaaaaaaaattctcacaattctgtagaagggtatgagatatacaataaaagacacccccaccctctgcaatctaccactcacagtagtttatctggtggtttccactttttaacaatggtctgggccaggtgcagtgactcactcccgtaatcctagcactttggaaggtcgaggcgggcaggttgcctgagctcaggagttcaagaccaacctgggcaacacagtgaaacccctgtctctactaaaatacagaagaaaattagccgggtgtggcggcatgcgcctggtagtcccaacttactcgtttggctgaggcaagganaaattgcttggaacccatgaaggcaaaaggntggcagtggagcccgagaatcattgccggnttgcacttccaaccctgggggtggacaagaaaccgaagaacttttgtcttttaaaaaaaatttaaattaaaaaaaaaaaaa

SEQ ID NO: 7701 - DNA, 715 bp, Homo sapiens
  misc_feature 1, 13, 138, 154, 161, 175, 480, 518, 520, 607, 628, 645,648, 680, 709: n = A,T,C or G
naattccatacanctacttgttctttttgcaggatcccatcgattcgaattcggcacgagagaaggtcgcctctaccttgcccagaacacaaaggtgctgcagatgctggagggaaggctgaaggaggaggacaaggntttcatcaccaggganaatgttnttggggccctgcanaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtgggcaggcctcgtgctcaaagtcctttcggatcttcttggccatgaaaaccatgagatacagcccgtattgtgaatggagctcttgtacagcatcctttctgttccatcctttctggaggaagcaagancaatgggaatggaagacatcctacctgcttcatcaaanangcaatgctgaaatgaccgccagatagaattcatcatcaagcagcttaaattccgaagagctaccagatggtgttctttgaatcttgntgatgatgaagatgaagatgntgaagaggaccatgacntcntggaagccgatcttggcaaaaaccaactgatnccaccccacttggaaaactctcaggaaanaagctt

SEQ ID NO: 7702 - DNA, 682 bp, Homo sapiens
  misc_feature 2, 3, 8, 135, 506, 654, 661, 663: n = A,T,C or G
tnnattcnatcaacctacttgttctttttgcaggatcccatcgattcgaattcggcacgagggtgggtggcagagggaaatccaacatgcagactgtggcagtgtcttgaacttctgtttattcaggtcattgantaaaaaactcttttcttctgcattcctgtctttctgcatgtgtgtgtgtgtgtgggctgggtagggactgtttttgagatcactggctgaaatgtattctaggggtgaaggatctaggatgtacctgctcgtcatttcctgacttcacctttaccaattcttttcttaacaaatttaaaattggtcagagcaggagctgctagctggcttttaacagtgtttctcataatggcagtactcagcaaatagtttttctcttgtctcctaaaattaagttgcaagactaatgtaacaaacagtaaaatttaagctaaagaactcagtataggctgggtgtggtggtttacgtctataattccacactttgggangctgaggtggaaggattgcttgagcccaggagtttgagaccacctgggcaacgtagggagaccctgctctacaaattaaaaccgcaacacaccaaaaacctctactggcacggagtggtgcgccctgtgtccctactccaactctcanaggcagnangacatcctgggcccaagag

SEQ ID NO: 7703 - DNA, 1356 bp, Homo sapiens
  misc_feature 2, 4, 7, 12, 13, 17, 20, 23, 41, 44, 45, 48, 50, 54, 56,58, 59, 61, 62, 63, 70, 76, 78, 79, 80, 86, 90, 92, 94,95, 96, 99, 100, 102, 103, 106, 110, 130, 135, 147, 148,156, 157, 158, 159, 160, 162, 163, 165, 166, 168, 169, 170,181: n = A,T,C or G
  misc_feature 183, 187, 189, 191, 194, 196, 199, 204, 207, 208, 211, 216,221, 225, 230, 231, 237, 241, 245, 249, 250, 255, 256, 260,264, 275, 277, 282, 285, 292, 305, 321, 325, 326, 330, 336,337, 339, 340, 343, 346, 347, 348, 351, 352, 356, 358: n = A,T,C or G
  misc_feature 359, 367, 369, 371, 372, 380, 381, 382, 383, 386, 390, 393,394, 395, 398, 403, 408, 409, 412, 414, 420, 447, 448, 449,452, 453, 458, 459, 465, 467, 474, 477, 480, 481, 484, 488,504, 509, 512, 514, 515, 521, 523, 528, 531, 535, 539: n = A,T,C or G
  misc_feature 546, 547, 549, 552, 553, 557, 559, 563, 569, 570, 573, 577,578, 581, 584, 586, 593, 594, 595, 598, 599, 602, 605, 608,612, 618, 621, 623, 624, 625, 627, 643, 658, 660, 673, 677,679, 680, 682, 683, 685, 692, 693, 697, 698, 703, 705: n = A,T,C or G
  misc_feature 706, 712, 714, 719, 723, 725, 726, 730, 734, 735, 738, 741,744, 747, 748, 752, 757, 763, 771, 773, 774, 778, 791, 810,814, 820, 824, 831, 844, 850, 851, 853, 857, 858, 860, 862,867, 873, 875, 885, 886, 892, 897, 899, 903, 909, 913: n = A,T,C or G
  misc_feature 919, 924, 927, 931, 932, 936, 940, 943, 950, 953, 956, 959,961, 964, 968, 972, 975, 980, 983, 987, 998, 1006, 1008,1014, 1015, 1016, 1018, 1021, 1027, 1038, 1056, 1057, 1059,1065, 1071, 1075, 1077, 1083, 1086, 1090, 1092, 1096: n = A,T,C or G
cncncgncgaannactntgntanatgtaagaaataatgatnctnngcntnatancnanntnnncaaaacnattagntnnntaatanagantncnnnggnnannatnagcnaggcttgtaaccttggcaanccgtnggtcagtccagnnagtcacgnnnnncnncnngnnnttactctatcncntatntncnctngnatnttttnacnngcnggaanaatcnaccncctcnnggtggngaantagngggnnaagtnnctgnaacnataaccatggngntgagngcnagaaaancgaggagagatgnggagatgcggcacctntgtnnaaancctgcnncnntgngannnccnntggngnntcgggagnancnnactcctannnngangacnggnnnatngaatngttanncgnanaaacanccgtgactaaatgtgtcgtgggaagannnggnngtcgnntaaaangnttgatancgnttnngancatntggatttgagtaatangaaangancnncgggtngnatttnagngaanggancgggcgnnanccnnccancncgantgaagnncgncaannccncancnaactggnnntcnntanaantgntgantgcctntanannntnaggggcggggaatacnatcctaaatcgtggnancatacactgaggnaatntnnannanaagaatnnctcnnacatntnnatagananaagantatntnnagtntctnnaanacncanaanntccnttgtncaaagngaaatggncnngagngtccagcacaganataaacacatggacatccntgangcttgnatcnaacacgngacgaaagcagtngccgannanattnntntnagcangaagancnatatgctgtnnatctcncttgncnaaanctgtanttancataanaccangcncgtnngcancgangangcaatanccncantgntnagntaangctnccncattnggnggangaataaaatcngatggganantgaaannnanggngctgcncttattacgcnaatcatatctaaatatannanaccatncttgtnagangntatacnctnatantntctntcagatgngnacgcttgnatgtcntctatcntnnctattcatatctgacacgtncgnacgcatgtnnattgntaacgcacgtagngtgtncacntnncnnctcccgngnntagngacagagacnggagannncatctctngtgcgcgnatannagtaaaganccnnnctgtcanancgcgntatcgatanttatgnngtncttcatncnnntaacaaaagcaacgctcntnttnttncggaanaaaaaaanaccnnncng

SEQ ID NO: 7704 - DNA, 1588 bp, Homo sapiens
  misc_feature 4, 5, 7, 8, 10, 13, 14, 16, 17, 18, 20, 22, 23, 25, 28, 37,38, 39, 40, 42, 43, 59, 65, 67, 70, 72, 73, 76, 80, 81,83, 85, 87, 94, 95, 96, 98, 99, 104, 106, 113, 119, 120,122, 125, 132, 134, 144, 146, 148, 153, 154, 159, 160, 164: n = A,T,C or G
  misc_feature 181, 183, 188, 192, 193, 194, 197, 198, 202, 203, 204, 206,222, 223, 226, 227, 228, 229, 231, 233, 235, 237, 239, 245,247, 249, 257, 258, 261, 266, 268, 270, 278, 281, 282, 290,291, 292, 295, 296, 297, 298, 299, 303, 305, 306, 308: n = A,T,C or G
  misc_feature 312, 319, 321, 322, 323, 329, 330, 332, 333, 334, 338, 339,341, 343, 348, 352, 353, 368, 375, 383, 389, 393, 395, 396,397, 398, 403, 405, 406, 408, 411, 415, 416, 418, 420, 421,423, 425, 427, 428, 430, 433, 441, 444, 447, 451, 455: n = A,T,C or G
  misc_feature 460, 463, 465, 466, 474, 479, 480, 482, 489, 490, 502, 507,514, 517, 518, 522, 526, 535, 536, 537, 541, 542, 547, 552,553, 554, 555, 558, 575, 580, 581, 587, 592, 595, 598, 604,606, 613, 617, 627, 633, 651, 655, 656, 658, 662, 663: n = A,T,C or G
  misc_feature 665, 666, 671, 675, 679, 683, 687, 692, 694, 697, 699, 702,705, 706, 707, 712, 719, 722, 724, 733, 734, 737, 740, 741,742, 747, 751, 752, 759, 760, 763, 768, 771, 772, 773, 776,785, 787, 789, 791, 794, 797, 801, 803, 814, 815, 820: n = A,T,C or G
  misc_feature 824, 826, 832, 841, 842, 847, 849, 857, 861, 866, 873, 876,886, 891, 901, 906, 911, 915, 916, 920, 929, 933, 936, 944,951, 952, 953, 954, 960, 962, 975, 976, 978, 980, 981, 987,989, 995, 998, 1001, 1004, 1005, 1008, 1013, 1015: n = A,T,C or G
cccnncnnanccnntnnnancnngncgntatatggcnnnnanncttggtatttctccangttgancngtntnnatngtcnnancncnaatttgnnngnnttacnantccgcantgtccnntntcnattaaancngtaaagaaantncngcccnnctgtnngatngtatcggcagtattgtnantgcgnaatnnnacnnacannnantatatctgggggggcnnctnnnncntnangncncatggncnanatgcgtcnntantgtgngntngccccgtntgnntctcatgnnnctnnnnnaatncnncnaccncctcgancnnnataacnntnnnctcnngncntagantacnngaaagcgctctatcnacatccntaggctanagtcancccncnnnnttctntnntnatngaanntncnncntntnntntanaaacgatnctncanatangacnctccnctngnntaaatgantattnncntcgcaannatccaccatatnacgtngctcaanagnngttncttnatactacannnaccnnattgncggtnnnnacntcacacgctgaaagtgnggacnnacacgntctanctntgngagtantntacaccntaanatgtgatctntcaacncgcatctgtacatcgcgncgannancacnnanngatcncatnaatncgtnacancttanantcnanatnatnnntcgcncacaggntcnancctggattnnatnagnnnatgtntatnntcactannatntggcnccnnnganggcgcgacnancntngantangagngntatctgtgganncatanatcntngccacnaggtacgcnnccacntnaccgcgcngatnaagangagtttnacnattacattanagtgngtacgctttncatanaactntaannatcnagtataacnagancgnataatctntttgatnnnntctacncncgcatgcaactcnncntnntatacncnctgcgntcnacntcnngantgcanancngnatgtnnnnatcnnancacgacatgtatctacgnaggnatntttatntntgactattcnntntancgnncgactgtgtnnttanntnngcaattgtgcncattgancgtaaaatatntacgactcgttcgcgtatacnncgactcgttcncngcatttactangcantttccnctcgctaaanatccnngcctnnangagtgtacntcgtctcgagtcgcgncnntacncgnactgtgngngantnananctnctntntatncgnncgcnatcgcgcncgcatatgaccnnanntctcgcaagtatcttccatagcacntaaancntgnntctntacnatnaantnnctntacttctcanttttatacaatnnantcgntnctannctnncgcatntacgaacngcgcnnncatgantntacanncgctgncgtncngcgntannccanantgtccgctnactcacantangtncanngcttagtcnngacncacgtgntaatgntcgatcgnagcctggcgacatagncattncgtgatnanntnnncttcntcncgacgcnctnnncc

SEQ ID NO: 7705 - DNA, 736 bp, Homo sapiens
  misc_feature 440, 443, 468, 508, 513, 526, 533, 544, 566, 569, 626, 627,642, 646, 659, 666, 678, 697, 711, 720, 725, 729, 733, 734: n = A,T,C or G
ttcgatacaactcttgttctttttgcaggatccctcgattcgaattcggcacgagtgattgatgagggctgtcggccaggaactgatcgagcttgttaattgcatttgtcaaatgcagggaaattgggaattagtgaaatcggagaagggggtttggaaaacaaatgactcgtgcctaaggaaattttttgcaggaaagtatctcaggagcccctgcagtcagggagctgctggtgtggactcagactacatggttgaaataggcaggagctgggcggggcacagtggctcaggcttgtaatcccagcaccacactttgggagacggaggcaggcagatcacttgatgccaggagtttgagaccagtctggccaacatggtgaaacctgtctctactaaaaatacgaaaaattagctgggtgtggtggcaggcacctgtnatnccagctacttgggaggctgaagcanaagttgcagtgagcccgagatggtgccatttgcactccancctgngcaacaaaaagcnaaacttncatctaaaaanaaaaaggaaagaaagaaatttngcngggaccccaagcttacattctttcctttttggtaaaactggttggggaaatgggttnnccttccgtgaagaanccancaaggtagggtcnatctttncttccccccttnaggacatttggttttgccngaatctttaaaaanaaaaaatanaaacnactncttnnct

SEQ ID NO: 7706 - DNA, 710 bp, Homo sapiens
  misc_feature 3, 127, 293, 576, 601, 625, 628, 646, 663, 688, 703, 705: n = A,T,C or G
canatacagctcttgttctttttgcaggatcccatcgattcgaattcggcacgagggggagtaacagaagcctggatacaattactctatcaggagatgaaaggggactttggggagactggaatgntgaaattgttttataattcttcagtagaacagatctgggatcacagttttacaggggcagagatttaagttggccctctagttatggagacactcctactggtttctataaaaggaatacttacattgcccaaaccagtgcatttcaaatcttcagcccaaggaangttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttacacacaggaaatggattactctttggatataacaccaccttcaaaaatttctgtttgccatgccagaacttgaattggggacttgttttcaagcagtaaatagcagaattcagttacaaattcttggaggcacggnacctttccaagctcatcaacacctntgaactttgagttttttcgtgaanggnggggaatgtttaacctcnggagaagttgatttatnaaaaaaaagacacgcttacttgaanggcctccatgggaanantcaaa

SEQ ID NO: 7707 - DNA, 714 bp, Homo sapiens
  misc_feature 2, 3, 7, 11, 17, 447, 569, 582, 586, 634, 657, 661, 702: n = A,T,C or G
tnnaatntcanatacanctacttgttctttttgcaggatcccatcgattcgaattcggcacgagaatggatgctcatatattgcttatggatattttggataccaaagtaggaataactggacattcagtattttaaagctggcaaacctgtacatagaaaatagatccccagacagtggtctatgaagagggcagttaagtatcaaatcttaattttcttgcctttttttcttaagtggggaaaagttctagatctcttacacctctgacacaatctgttctaaaacaggcacttgtaatgttggggcctccttgtaaacgtgtttttgccctttactctctgggattacaggcgtgagccagtgcacccggcggaatcttggaatttttatagacagcacctcagtttctgactccagccgcacaccttctgcctctaccagcangggttgccgccagaccagaccagggccaggtccctgcgtccatccccccggtaggatggacgtgagccatccttctaggggacttttttcaatgtgcgaactcgtctcttgttaggtggtangaaccagtttgtntggnctgtgccacgcctccacaatgccgtggctgggcttcttgtgtggtggnctgtggtccccttgtccctgcangaanccaacaaggcattcgtggcgtggacaacttgtgttccaaanccactggcccgg

SEQ ID NO: 7708 - DNA, 698 bp, Homo sapiens
  misc_feature 2, 5, 7, 11, 562, 592, 607, 611, 668, 670, 694: n = A,T,C or G
tncananttanctcttgttctttttgcaggatcccatcgattcgaattcggcacgaggtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaattaactaaaccaagatgctgtgattttttaagttgcaatatgtttttggtttttttcattttttaatcattgcagttaagagaaatggaaattaagttgtgttaaatcttgcagaatgtttgcaggactgactatcaaactggatgatttccatttatccctactgngtcaggttcaagcatcaaaaatcccttgcntctgagacagacttnctancatcagggacagggatctggtgtgtcattatacaaaacagtctagggggtggaactncntagtaaaaaaataaaataaatggncctt

SEQ ID NO: 7709 - DNA, 698 bp, Homo sapiens
  misc_feature 3, 4, 6, 11, 20, 609, 612, 630, 643, 649, 675, 677: n = A,T,C or G
ttnnanttcanatttgactncttgttctttttgcaggatcccatcgattcgaattcggacgagaacaacaaaaatctgaacagaaatgctctatttacgttcttttccttatctgtagtgttttaaagtcattaaacttaaaaatgatgttcaggagaagatgagtgtatttgcatagtctgtcataactctggtattattttgtacaaggagtgtgttagggttttcagttgtaaccatgcagaaaatctacaaaataaaagcagttgttaattagtcctttacaatcagaattgtctattttggaaatttatgaagtacttcagatgtaatttaagaaattgtatttgagccaagcgtggtggctcacacctgttatcccagcactttaggagcctgaggcaggtggatcacaaggtcaagagttcgagaccagcctgaccaacatggtgaaaccccatctcaactaaaaatacaaaacttaactgggccgtggtggcgcgcgcctgtaatcccactactcaggaggctgagtcaggagaattacttgaatctaggaggtggaggttgcagtgagccgagatcacgccctgcacttcacctggaaangangggaaagggaaaggaaangggaaaaggaaanggaaangggatggttttcaggctgggcacggngnttacgcctgtaatcccacact

SEQ ID NO: 7710 - DNA, 701 bp, Homo sapiens
  misc_feature 4, 428, 547, 582, 594, 662, 697: n = A,T,C or G
ttcntatcagctcttgttctttttgcaggatcccatcgattcgaattcggcacgaggcaacgaaataattttaaagtggatctgggttggtagtgcttatgggagttaggcaaggaaaaatgcagattctctttagaatatcttcacctaggtcccaaaggattctcatagatagatttccaacaaatatgaggttataataaaaaatacaaatcacatatagaagtatggcaccatgaatgagaaaggaaaaactgtcagaacaagaccctcaagactttactggaattaacaagcaatatgtaaagtaaatagaaataagctattcataataagaataatgtataagagactactaaaaataactgggcagatttgaaaataatctaagttctgggaatgaaaataataactgaaaaacagctganagagagaattaatgaactaaaagaaagttgtttagagattatccagaaattaggacaaatcatcataaagaaaatatgggtagaaaaggttaagatggaaggataaggcaagtgcttancatatgtccagaaggaaataatagaaaaaaatgtnttaattcctccncactggtaaaagacatgatggctcagattcagggaattgtacccatctcaaaaaaaaaaaaaaggaangaaaagtggccaggggaaatccttattaaaatccntgtg

SEQ ID NO: 7711 - DNA, 791 bp, Homo sapiens
  misc_feature 3, 5, 10, 14, 16, 530, 537, 548, 552, 585, 602, 606, 615,622, 624, 627, 647, 662, 672, 678, 694, 703, 707, 714, 717,729, 734, 783, 787: n = A,T,C or G
ttnanttcanattnanctcttgttctttttgcaggatcccatcgattcgaattcggcacgagatccctacctagaagagaatagatgggaagagaactgaaagaaagaattcctcaagcactgaagtcaggaaaatccccgtaggcactgtattagttgttccatttatcccagcactccacttgtggatgaaggagttgtatagaaaggagatgagaaaatggcaggagtggaagcagccaagaagagatcgatgactgaagatctccttcaccttcaggactgtctcaaggggttatttcacctctactcatgaggatggccagtttttctgtcttttatctttagacccatatataatcagttcagagcacaaatcaaaataaactggcctaaataactgaatctaggaacaaagctacatcttttttcatatgccaaagctctgtttcctcatgttgttcctacttttttaaataataaatgggcttctcaaccatcttaaggaactaagatggggtccccatctngggtagnaacccggcttntaantttttaagaaatcactcttggtaaattctttancctcactttaaaaatanttanggaaaaccnccggttnanttnggaaaaaaggaaccgggggnagaaaccttcgttcntggccagggntttttnggccaagtggaaaaantttgggtcntttncccaggnggnaaattggcctanttaantttttccaaaaatttggcccttattaggtccaaaaaaaagccttttttncccntttg

SEQ ID NO: 7712 - DNA, 741 bp, Homo sapiens
  misc_feature 2, 6, 572, 646, 705, 716, 720: n = A,T,C or G
ancccnttgaaattcacatacaagctacttgttctttttgcaggatcccatcgattcgaattcggcacgaggtaatcctttctttttcttctccctctttcctgctcttacttatacagttaggtgaatatgatgctccacttcccccacagatactcaaatagctctgactgctgaaatattggtatcttactgtcagcacataacttgttgctgtgttattgacattttcactgttttgaaatttttactgttatctgggtttgaatcccagctctcccaagcttcagttttctttcatttgtcaaatgagataaaagtatccacttcatagggttgttatgaggattaatgatgaatacaaaacacttaacatagtacgtggcatgtaatattagttgtaaagttaatgtattcattatcatcattctgtttcaaatcagcaatgaaatacagactacactaatcccatttctgcttggaattgtgagtctaaatgccatgtagcagttccctgcttgaaatacactgtaaaccttccaattgcagtcaagaattttactaccttctanggtataccagggatggtgggaacataagtaaaccttggagatttggcttttccccgtggtttgggaattctaanccctttctaccaaaaaaggtaggtaacccctaaaaatttctaattaccatgccccaccntggatggcctncctnccaattaaaaactttcagtaa

SEQ ID NO: 7713 - DNA, 738 bp, Homo sapiens
  misc_feature 3, 5, 10, 15, 478, 595, 625, 634, 667, 713: n = A,T,C or G
ttnanttcanatcanctcttgttctttttgcaggatcccatcgattcgaattcggcacgagccctatcttatgagaaaagtaactttgaaaggactaatacatcctgttcttagcttctgcttccttcaggccttctctatgaagccagcctattctgctcagcgctttggaacactgattctatttcatggaccgaagcattgcccaattgtagaattgcaataaagccaactgagatctttaaattggctataattcatcctttggcaatacagtaaaaaaaaaaaattctcacaattctgtagaagggtatgagatatacaataaaagacacccccaccctctgcaatctaccactcacagtagtttatctggtggtttccactttttaacaatgggtctgggccaggtgcagtgactcactcccgtaatcctaacactttggaaggtcgaggcgggcaggttgcctgagctcangagttcaagaccaacctgggcaacacagtgaaacccctgtctctactaaaatacagaagaaattaacccgggtgtggcggcatgcgcctgtagtcccagctactcgtttgggctgangcaaggaaaaattgcttggaacccattgangcaaaaggnttgcagtggagcccaaaatcaatgccggttggnactttcaaaccttggggtggacaaaaaccgaagaacttttgtcttntttaaaaaaaaattaaatttaaaaa

SEQ ID NO: 7714 - DNA, 722 bp, Homo sapiens
  misc_feature 2, 3, 7, 9, 10, 11, 14, 18, 20, 26, 32, 552: n = A,T,C or G
gnntttnannnccntttnantttcanatacanctacttgttctttttgcagggatcccatcgattcgaattcggcacgagatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccacattcatgagtatgaaggacatcactctgctgaacaaatcttggagttcatagangatcttatgaatccttcagtggtctcccttacacccaccaccttcaacgaactagttacacaaagaaaacacaacgaagtctggatggttgatttctattctccgtggtgtcatccttgccaagtcttaatgccaaaatggaaaagaatggcccggacattaactggact

SEQ ID NO: 7715 - DNA, 702 bp, Homo sapiens
  misc_feature 3, 5, 10, 108, 141, 163, 207, 311, 365, 520, 560, 592, 655,689: n = A,T,C or G
ttnanttcanattgactcttgttctttttgcaggatccctcgattcgaattcggcacgaggaactaatgaaaagtggttgtctctaaccttggtatgctttcagagcntcagggttaaattacctcaacttttggcaggtntactctaaagctattaagtatntaatatgggctcggcatggtggctcacacctgtgagccacctancactttggcagtccaaggcggacagatcacttcaggtcaggagtttgagaccagcctgtccgacgtggtgaaaccccatctctactaaaaatacaaaaaccgancgtggtgggtggcatgcacctgtggtcccactacttgggaggctgaggcagganaatcgcttgacccaggaggcggaggttgcagtgagccaagactgtgccactgcatttcagcctgggtgacagagggagactgtctcaaaaacaaaaaaacaaaaaacaatggctgggcacggtggctcacgcccgtaatcccagcactttgagangctgaggcgtgcgttatcaccttgaggtcaaatgttgaanaccagcctggtcaaacttggtgaaactgtctntaccaaaaatacaagaattaggtggacatggtgtcgggctctgtaatctcaacttatcaggangctgaggcaggaaaatggctttgaacccaaggangtggaagttcaat

SEQ ID NO: 7716 - DNA, 1028 bp, Homo sapiens
  misc_feature 15, 26, 64, 71, 72, 97, 100, 102, 108, 118, 131, 138, 155,168, 184, 190, 194, 200, 203, 210, 212, 219, 223, 235, 241,252, 253, 268, 270, 285, 310, 311, 319, 327, 337, 356, 362,364, 370, 374, 375, 382, 383, 397, 402, 403, 409, 417: n = A,T,C or G
  misc_feature 421, 428, 442, 443, 449, 453, 468, 498, 512, 533, 535, 538,540, 556, 574, 584, 596, 611, 618, 636, 656, 663, 666, 672,695, 704, 722, 731, 732, 738, 755, 774, 775, 778, 781, 799,801, 811, 821, 829, 832, 833, 836, 839, 845, 848, 849: n = A,T,C or G
  misc_feature 866, 870, 880, 889, 900, 902, 913, 923, 932, 934, 955, 959,973, 975, 985, 989, 993, 994, 1003, 1006, 1019, 1024, 1028: n = A,T,C or G
ttgatctttgattcnatcaactcttntctttgaggatccatcgttcaattcggcacgagccgcnactctgnncgccgtggtggacaacgtgcccccnttncnctgganggaattcgtncggcgcctagggntgaactngaccacgatatccgatnggcatggagctgnaagaacagggcgctgnccttgngccnagggcngcnaatacantnatgcttntcgnaacctgggaaangctggntgcaactcccnnatgggtttcggaagngnccaacggcttggggnaaaccttgccttggggaaacgtccnnttgtcttncccggatntaaccaattngggaacccccttggctttngggggncnttggcncctnnggggaannggaaccattttccnatatnnggaaanggcccccncttnttttggncggaagccccccanncccttncccntttcccctggttgcncggcccgacctccaaattgccttttttttnaaataattgcaaanggccttgaccccccccccttnantgngnccaggctttttaaaanggaacccggttcccttgntaaaaaatcnaccctttacccnaacccccaacttttnttttttnttggaaaaaaagggaaanggggatccctggccatgggngccaaantcnaagtanacttatccaaaatccggagcttnaccttttgnttggctttaaaccccaanttcggattnntaccantaaacttttttcctttnaaaactaaatccttgaccnncgnccntctcttaacaattaaaancntccttgtttncctcctccanaaaaaagnatnnttnccnccccanagnngccttcaaaaaaaaccnttgnggtgggggtngggattttngggaaggaaananaagggaacccnttttgccttnaaagccccntnttttggggttttaactgaacnaaanccaaggtttgtttngnaggccccctngggnccannccctttaanccntttttcaccaatnggcantaan

SEQ ID NO: 7717 - DNA, 749 bp, Homo sapiens
  misc_feature 14, 18, 22, 30, 158, 160, 182, 207, 300, 315, 374, 549, 566,628, 642, 661, 683, 689, 724: n = A,T,C or G
ttccattcaaactncttnttanctcttggnctttatgcaggatcccatcgattcgaattcggcacgaggcggctcttttccctcgtgactcggttgctcctggcgccgcgacggggcctcacggtccgcagtcccgacgaacccctgccggtggtgcncnttccaaaaaagctcccgagacntacttttttgcacagacatagcctntcggggcctggacagcactggtgtggagctggttgtcaattatgatttccccccacgcttgcaagattacatccacagagcagggagagtggnccgtgttggggagcnaggtgccaggcaccgtcatcagttttgtgacccatccctgggatgtgagcctggttcanaagattgagctggcggctcgccgaaggagaagtcttccaggactagcatcctcggtgaaagagcctttgccccaacaacctgattttgacaaatctgattaaaatgtgatgctagacagggatctttcccagtatcttgagtggggtgaccacactttgtcagtggggaggcttntgggcttgcccttgtcngcttccttgagggccgggatgaactgcttttgtgaactttggaaaaggtacccctgcttggnccagcatttgggangaaaaaaacctgcttgaancattggcttttcttgtaagtcntttaancaaagaacacaaagtgggattttggacttttggantcatggtcattgaatttcttaacaa

SEQ ID NO: 7718 - DNA, 707 bp, Homo sapiens
  misc_feature 4, 7, 9, 83, 86, 516, 539, 554, 566, 595, 605, 617, 622,691, 694: n = A,T,C or G
tttnatncntttacaactcttgttctttttgcaggatcccatcgattcgaattcggcacgagctgatcctccgcttccagaanganctgaaggagatccagtacggaatcagagcccacgagtggatgttcccggtgtgaactgcaggctgtgctccagatccaccgacccgtagcatctcgtcacgccagcactcgcctccctaccaatgactcacctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaagccctagctgagcgcaaggcccaaggtgtgctggctgtacaggcaagggcagaacaactgcgggatgaggctcgggacctgttgcaagccgctcaggacaagctgcagcggctacaggaattggaaggcacctatgaggaaaatgagcgggcactggagagtaangcagcccctcgtcgcgggttcangtccgcccattactnctttgtcgtgcngtcaaaggatacacctttgcccccgattnccggatcttnttccgttctcangccanaacccctggtgcttgccggtgaattttttttttctctggctttgcttgcaatttttgaaaataaaatgnccnaaaaacaaaaaat

SEQ ID NO: 7719 - DNA, 707 bp, Homo sapiens
  misc_feature 3, 6, 7, 10, 11, 12, 155, 506, 555, 593, 610, 636, 661, 680,683: n = A,T,C or G
ttnaannccnnnttgaattcatatacagctacttgttctttttgcaggatcccatcgattcgaattcggcacgaggagagagagagagagagagagagagagagagagagagagagagagagagagagagagagagagagagagagagagagctnacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcatgtaaagtaattctaatttctagcccctctgggtagatttttagtaggatgttctcttcaggaggttgaaggttattttttattttcaaggatactataatacanactcatgatttgctgtttttagcaattaccttgtgaatgttgtctgcanatcagtgaatttgagtgctggatctttttgtttgttgnaggggtaagaagacttnttgtttacaatggcttcccttaaaanatacctgggcttgtcaccaaagcanttaataaaacactggcctnttntttttaaaaaaaaaaaaaaaaaaa

SEQ ID NO: 7720 - DNA, 683 bp, Homo sapiens
  misc_feature 5, 644, 672, 683: n = A,T,C or G
ttganttcgttcagctcttgttctttttgcaggatcccatcgattcgctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgtttaggggctaaaggggagaactgaagtgttttactctttttctaagtgttggctttctatgnactattttcttgtgctctttttacttcntcacttggggn

SEQ ID NO: 7721 - DNA, 707 bp, Homo sapiens
  misc_feature 6, 8, 17, 96, 515, 518, 557, 570, 578, 589, 614, 630, 667,675, 682, 691, 706: n = A,T,C or G
ttgatncnttacatttnatccttttttgcaggatcccatcgattcgtttggctctactttgcagggaatctggcatcgggtggtgccgcaggggcnacatccctgtgttttgtgtaccctcttgattttgcccgtacccgtctagcagctgatgtgggtaaagctggactgaaagggaattccgaggcctcggtgactgcctggttaagatctacaaatctgatgggattaagggcctgtccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacactgttcgccgccgcatgatgatgcagtcagggcgcaaaggaactgacatcatgtacacaggcacccttgactgctggcggaagattgctcgtgatgaangangcaaacttttttcaagggtgcatggtccaatgttctcanaagcatgggtggngcttttgngcttgtcttgnattgatgaaatcaagaagttcaccntaagtttatttcctangattttttccccctgtgaaacaaggcattgttggaanttaatatnaacaaantctttgaancatttttttgaacana

SEQ ID NO: 7722 - DNA, 700 bp, Homo sapiens
  misc_feature 18, 24, 700: n = A,T,C or G
ttgacttcgtatacaatntcttgntctttttgcaggatccctcgattcgaattcggcacgagcgaagtcgggatcgaagaaagatcaaaaagccgggatcgaaagtcatataagcacagggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatctaagaatgaggtcaatgggaccagtgaagacattaaatctgaaggtgacactcagtccaattaaaactgatctgataagacctcagatcagacagaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaaccttgtggcttgctcagtgttttaattgccagtttcaatcttggactttgaaacaggattaaccgtagtn

SEQ ID NO: 7723 - DNA, 703 bp, Homo sapiens
  misc_feature 4, 190, 518, 636, 693: n = A,T,C or G
ttanatacaagctacttgttctttttgcaggatccctcgattcgaattcggcacgagcttgagtctaggagttcaagaccagccttggcaacgtggctaaaccccattgctacaaaaatatatatatacaaaaaattagctgggagcggttggcacatgcctgtagtcccaactactcaggaagcccgangtgggagaattgcttgagtctggggagcagaggttgcagtgagctaaggtcatgccactgtactccagcctgacagagcaagaccctgtcccccgacaaaaaaaagcatcatgagcaactctcccaaggctggcccctgcacatgtcttcccatccaccaatagagtcccagttcatagccattgtcacaccattgtcctgtcttcctctcaactgagggtgatgtttagaggcatgatttctatctaatattgaagccagaggctcttccaacattttccagagtcttcttgtagaaaaggagctatggatgtttccttgaaaacangccccgattcctgtgacacacccatcacatgttgctcaaagctatcccaagatattaccaaatattggacatcctgtcctgggtgagcaggtagcagtgctaaggtaagacaaagttnccagttctgggagtcttcctacttccaagaaggccaatccttgagcagtgtggattnctgtggttat

SEQ ID NO: 7724 - DNA, 715 bp, Homo sapiens
  misc_feature 20, 87, 316, 501, 518, 582, 586, 589, 590, 591, 592, 593,595, 601, 602, 603, 604, 605, 607, 609, 612, 613, 615, 616,617, 618, 619, 622, 623, 625, 626, 627, 628, 629, 630, 631,632, 633, 634, 635, 636, 637, 638, 639, 640, 644, 646: n = A,T,C or G
  misc_feature 652, 653, 654, 656, 657, 658, 660, 665, 667, 668, 669, 673,677, 683, 685, 687, 688, 695, 699, 712, 713, 714: n = A,T,C or G
tttgaatccctttacaactncttgttctttttgcaggatcccatcgattcgcccctgtttacagcaataagcacgtcctcctccccnactcccattccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccangctaggccccccacacctgggggaccccctggcccctcttttgtcttctgtgaagacaggacctatgcaacgcacagacacttttggagaccgtaaaacaacaagcgccccctcccttccagcccttgagccgggaaccatctcccaggaccttgccctgctcaccctatgtggtcccacctatnctcctgggccttttttnaagtgctttgggctgtgactttcatactctgctctttagtctaaaaaaaaataaactggagatnaaanttnnnnntnccaaannnnnananttnngnnnnncanngnnnnnnnnnnnnnnnnaaantnaatttnnntnnnanttgtntnnngctnttanaaatanantnnacccttncttntataaaattttgnnng

SEQ ID NO: 7725 - DNA, 694 bp, Homo sapiens
  misc_feature 5: n = A,T,C or G
ttcanatacaagctacttgttctttttgcaggatcccatcgattcgaattcggcacgaggcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacaagttttcccttccatattcctctcttgagtttatgcacatctctataaatcattaagttttctattttattacataaaattcttttagaaaatgcaaatagtgaactttgtgaatggatttttccatactcatctacaattcctccatttttaaatggactacttttatttttaaatt

SEQ ID NO: 7726 - DNA, 908 bp, Homo sapiens
  misc_feature 18, 22, 23, 24, 27, 34, 333, 351, 387, 399, 428, 444, 487,491, 496, 508, 529, 569, 594, 621, 626, 628, 644, 683, 686,702, 711, 764, 789, 797, 827, 841: n = A,T,C or G
gaaaacccttttgaaatncccnnnttnaattcanatacaagctacttgttctttttgcaggatcccatcgattcgaattcggcacgaggtggcaaagcttcatccagtctaggtcttcaggattttgatttgctccgggtaataggaagaggaagttatgccaaagtactgttgggttcgattaaaaaaaacagatcgtattttatgcaatgaaagttggtgaaaaaagagcttgttaatgatgatgaggatattgattggggtacagacaggaagaagcatgtgtttgagcaggcatcccaatcatccctttcctttggttggggcctgcanttctttggcttttccagnacaggaaaagccaagaattggtttcttttggtttantaaggaagttantggttaaaaatggggaagggaagaacccntaaatggtttttccantaatggccaggccggaaccaaaaaggaaaaaaaccttttcccntggnaaagnaaaaccaattgnccccaagaaatttttttaacnttcttggccaagaaaaaaattcaaagttccttaagcccanttttaaaaaatttaattccttttcnattggaagcccgaaaggggaattaaanttttnantaaggaagaattttgnaaaaccttggggaccaaatggttatttaacctggggacntcntggaaaggcccaccantttaaaacntccactggacccaccggccattgtgttaaaggaaaggatttaccggccagggnaagataccaaccagcactttctggnggtacctnctaattacatgctcctggaaattttaagangagaagattatggnttcaatgttgactggtgggctcttggagtgctcatgtttgaagatgatggcaggaaggtctcctttt

SEQ ID NO: 7727 - DNA, 710 bp, Homo sapiens
  misc_feature 4, 11, 12, 13, 14, 17, 18, 25, 27, 31, 403, 637, 639, 653,675, 679, 692: n = A,T,C or G
gaanccctttnnnnttnnaattcananacangctacttgttctttttgcaggatcccatcgattcgaattcggcacgagggaactaatgaaaaagtggttgtctctaaccttggtatgctttcagagcatcagggttaaattacctcaacttttggcaggtatactctaaagctattaagtatataatatgggctcggcatggtggctcacacctgtgagccacctagcactttggcagtccaaggcggacagatcacttcaggtcaggagtttgagaccagcctgtccgacgtggtgaaaccccatctctactaaaaatacaaaaaccgagcgtggtgggtggcatgcacctgtggtcccagctacttgggaggctgaggcaggagaatcgcttgaacccangaggcggaggttgcagtgagccaagactgtgccactgcatttcacctgggtgacagagggagactgtctcaaaaacaaaaaaacaaaaaacaatggctgggcacggtggctcacgcccgtaatcccagcactttgaaaggctgaggcgtgcctttatcacctgaggtcaagatgttgaaaaaccacctggtcaactttggtgaaactgtctctaccaaaaaatacaagaattangntggacatggtgtcnggcttctgtaatctcaacttantcangaagctgaggcangaaaaaatggctttgaat

SEQ ID NO: 7728 - DNA, 700 bp, Homo sapiens
  misc_feature 15, 16, 18, 20, 23, 28, 30: n = A,T,C or G
tttgaaaccctttgnnantncanttcananacaagctacttgttctttttgcaggatcccatcgattcgaattcggcacgagagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgtaagtttttcttgggtcttggcgctattctacgctatatgctggtaggtgcttaagctgctttcgtaactttctggcccctggttctttctgagcaggtgaggtggttatataaggctcttccatctgtaatcagtagtacctggtaatcattta

SEQ ID NO: 7729 - DNA, 670 bp, Homo sapiens
  misc_feature 2, 4, 8, 9, 12, 14, 15, 17, 21, 22, 29, 30, 32, 34, 36, 37,43, 45, 46, 47, 49, 96, 97, 114, 120, 122, 146, 152, 170,183, 203, 205, 208, 214, 222, 224, 230, 232, 233, 234, 252,253, 256, 257, 260, 261, 265, 268, 270, 271, 275, 278: n = A,T,C or G
  misc_feature 280, 282, 287, 294, 298, 302, 304, 307, 311, 312, 317, 371,386, 420, 424, 469, 473, 476, 495, 509, 539, 571, 573, 596,639, 649, 650, 670: n = A,T,C or G
gntnaccnnccngnncnaaannacgcatnngngngnntggctnannntngcatttttagtagagatggggcttcacaatgctgcccaggtttttcnngaaccgctgaccttaancgaggngnctgccttggcctccccaaggtgcnggaatnacaggcatgagccaccgngcccggatgacanccgtattcattaagtgtctntncgngacagnctaatgancnagctancnnncatggaagtgcaatgccnncanngtnngttnttnanncctnaancngntgggnccaggtntatnaacnanctnacanncctgngtagagagggactacaggcgcatgccaccacacctggctattgtggattttaanaaattttttttgtanagacagggtcttactatgttgcccaggttgttcntganctcttgggctccagagagccttccatctcagcctcccaaagtgcntganatnataggcgtgagccaccacncttagcccattgtnactttttagagctctaatacttcctttaanggcactaaaaactcaatcttaaatccagttgntnttcatttgggtgaatgaaatggnagggaccctccttaattttttttccaggtttttgggattgaanaaatttcaannatcttcaaagcgacctaaan

SEQ ID NO: 7730 - DNA, 716 bp, Homo sapiens
  misc_feature 5, 556, 601, 638, 704: n = A,T,C or G
tcccntatacaagctacttgttctttttgcaggatcccatcgattcgaattcggcacgagctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaaggganggttactgaaaagaattttagcaatatattggtttcagggaaaanggagctgtttttattaaaatggatccattccactggntccctaatgggttcctatggtatcctttccaaacccggattacccttttacttatttttaaaaagnagccggtaaaat

SEQ ID NO: 7731 - DNA, 691 bp, Homo sapiens
  misc_feature 4, 5, 21, 87, 148: n = A,T,C or G
accnnaaaccctttgcaactncttgttctttttgcaggatcccatcgattcgaattcggcacgaggttggcttccccgggagaggantttgaggattaaaaatattcagaaacaaacaaaagaacacaaaaatgcaaacacatggtanggaattactactgcttattctcaacagtaccacagaaccagtgtttgagtgctggcaccatatgcaacatggggcatccgggctggagtgatccagttttttagttggtggtggcgatgatttttctttccttttggtttataattttctgttcatttttccccctttctcccccacattcattaagaaccctactgaaaccctaggtgacaaaaggtgtgccttctgttgccacatttgacccaccacaggactcactggactggacttctatttatattgtattaagtaactgatatatatatatatatatatatatatatatttttgattgacaccaaaaaattaccttggcacaaatgccagacctgtgaaggtcagaggcccgctgcttcttccaggagggagggaactttttggttgctgtggcaattcctctgtacagattgtaacttttttaaaaatttcccttcacccccgtcacttgaatatatgttcatagtaatttgtaagaatacttctttttccttattttgggtgcaa

SEQ ID NO: 7732 - DNA, 686 bp, Homo sapiens
  misc_feature 10, 17, 86, 308, 578, 625, 675, 686: n = A,T,C or G
tttgaatccntttacanctacttgttctttttgcaggatcccatcgattcggcagagttggccttttgcccgtggtgtgctagtanctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatancataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgnagttttgccttttatcttttcccaaattttataaagagaaattaatnaatattttattacacattgtaaaaaaaaaaaaaaaaaaaactcgagcctntagaactatan

SEQ ID NO: 7733 - DNA, 710 bp, Homo sapiens
  misc_feature 273, 444, 641, 650, 657, 672, 679, 698: n = A,T,C or G
ttccgtatacagctacttgttctttttgcaggatcccatcgattcgaattcggcacgaggcaaggtgcagtagctcacgcctgtaatcccagcactttgggaggccgagacagggaggattgctttagaccaggagttcaggaccagcctggccaacacagtgaggccctgtctacaaaaaattaaaataatcacttaaaaaaatcaaatattcttgaaaaagtttagacttgtaaaatataatatggggaaaatggacatggtagaaatganaaactacaaaataaaacacagacagacagacctgtgattggtaaatatttgatagggtccagaaaaacttatggatgaatcaaatcataattgtataatttgcctacaaaagaactgatccagatcaaaataatttcaggagactaaagtgaaaatggaaacatttggaantctgttaaacaactggcttaatgaactttgctctagaaaataccctctcaatgaaaatgaactttgctatggtatatttttcttttaaatagttgtagtcatgaacatggagtcaaaatgctctctgggctatcaattttttctcttaaaacaaggcttttggcttgcattcccacaaggtctttaaataccgtaantattttccnttatttnttccagaatcaaaantattttnccaaatcccttttggggantttcttctttcc

SEQ ID NO: 7734 - DNA, 685 bp, Homo sapiens
  misc_feature 5, 570, 629: n = A,T,C or G
ttcanatcagctcttgttctttttgcaggatccctcgattcgaattcggcacgagtgaaattcagctaaccgagcagctacggtccctcatccccaacgagggatgtgagaaagttcatgtctcatgttatctggaccttgaaaatggaatgttcagaacacatgtgcaagggagctgtgccaagctcatgtcgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggatatgactataagaacaaactcatcttcgcaatatctgtgactgtcatactaataattttgattataattttttgttttatagaggtaaagacaataattaattcaggttttcaaaatacaatcctgtgtttgtgtggattcagaatccacaaactgaaaaccaacgtcactttcccacttgacattcttcttctgtcatttaaaggctgangtgtgctttgttcttttactgcaatgtatattccaggattggtaaaggatcctcgcttncaggaggtctctgtgaaataaaacccaagttaatcccaaaaaaaaaaaaaaaaaat

SEQ ID NO: 7735 - DNA, 683 bp, Homo sapiens
ttcgatcagctcttgttctttttgcaggatcccatcgattcggaaagattctcaaggaagaagtaataaggcattacatctgaagagtgatgctgaatttaaaaagatatttggccttactaaggatttgagagtgtgccttactcgaattcctgccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcctttgaattcaaatgcagcttatgaacaaagtcatttcttcaataaaaattataccgaagatattttcccagtgacaccacccggagttagaagaaaccattcgagatgaaaaaataagaagactttaagcaggtgctgagagagaaagaagcagctcttgaagaaatgccttaga

SEQ ID NO: 7736 - DNA, 689 bp, Homo sapiens
  misc_feature 5, 624, 672: n = A,T,C or G
ttcanatacaagctacttgttctttttgcaggatcccatcgattcgaattcggcacgagagaagaatttggtataatcatgaaagccctgtggacaggacagtatagatatatcagtccaaagggactttaaaatcccattggggaagatcaatgaccaagtttgcaggatacagtcagcaagattcacaagaattgcttctgttcctaatggatgggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctccactagcatccacaagtaaatgtacattacaggattgccttagattattttccaaagaagaaaactcacagataacaacagattttactgcagtcattgcagagctcgacgggattctctaaaaaagatagaaatctggaagttaccacctgtgcttttagtgcatctgaaacgtttttnctacgatggcaggtgggaaacaaaaaattacagacatctgtggacttncccgtaagaaaatcttg

SEQ ID NO: 7737 - DNA, 683 bp, Homo sapiens
  misc_feature 5, 7, 550, 585, 620, 665: n = A,T,C or G
ttcananacaagctacttgttctttttgcaggatcccatcgattcgaattcggcacgaggtttcttgtaagtactctgggagtgcataatacattttaaataagattaaaaattatgttttattcttactagcatcactgtcagataattgagccgtgagagcattcagtgctgtgtgcttggtaccgaagtagtaacatcaattcagtgttcagtacatccactttgttccagaacaatgtattcaaggtcggtgtattttggctgtgccacagagttctggaaattcccaagagaataagttttcacctgttatataatccagcacaagtgactgtgtagcagcaacctcatgtttcatgatgactttaaaatgcaattgattctaaaatttagcttttaaaaatttcgacttcagattttctctgaaggtttaaggtaggcttctcctttattaatttttttcaagaaatatttaagaacactgctctgtgctatgtaccattctaagcactttacagatactaattcatttaatcctcagccctgntaggtaagtactgctattccccccgtccagatgangaaacagcctcagaggagtaaaacaggttgctcangtacacggcagcgggttggactactcagtttcagataatcactgngaaattttactggtttga

SEQ ID NO: 7738 - DNA, 716 bp, Homo sapiens
  misc_feature 2, 6: n = A,T,C or G
tntcanatacagctcttgttctttttgcaggatcccatcgattcgaattcggcacgagggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaacattcaagttttcttttgtcttaaattcagcctctttcttaaaagcaaaaaaaaagcctcttagaactatagtgagtcgtattacgtagatccagacatgataaagatacattgatgagtttggacaaacc

SEQ ID NO: 7739 - DNA, 809 bp, Homo sapiens
  misc_feature 10, 16, 557, 579, 581, 588, 620, 699, 703, 708, 769, 798,807: n = A,T,C or G
ttgaattccnatacanctacttgttctttttgcaggatcccatcgattcgaaaaaataaaagtaaattctaggcaagctaaagagtgaaatgtatcatcacataggaggaagtgggggaaaaaagtgaaatgtaagaaatgaaatgataagaagaacttagtgggtattcgtttgattttggaggcactctaggaaaattctgccagattgtactacatttaaaaaaaattttttttaacttttgtgtgcttcagtttggtcatagacaaatgaaaaggcacatcacaaactaaaaagaaaatcagttcctatatatgataaagggttaatatgtttttatatggagagttcatataaatcaataaacaaaacactaataccctgtacaaataatagacctatcaggcatcgtttctgatgccgttctctgatgaaagggaaccagggctcctcagagaaatggctgatgcgaggactgagaaaatacaccagtatggtaggtcaaggcaccggtggctcacgcctataatcccagcactttggggaaagcccgaangtggagccgggatccactttgnanggtccangggaagtttccaaagaaaccaggcccttgggncccaaccattggggtaaaaaaaccccccatcttcttactttaaaaaaaattcccaaaggattttagcccccaggccgtnggtngggtncccattacccttgttaaatccccagccttacttcaaggaaaggcctttaaggccaaggaanggaattggttttggaacccccccaaaaanggccaaaangg

SEQ ID NO: 7740 - DNA, 1387 bp, Homo sapiens
  misc_feature 7, 11, 12, 13, 14, 21, 31, 34, 36, 39, 43, 44, 45, 47, 48,50, 51, 53, 60, 62, 64, 66, 67, 71, 72, 77, 80, 81, 95,96, 100, 102, 116, 121, 128, 130, 136, 141, 142, 159, 170,173, 181, 182, 184, 188, 196, 201, 203, 208, 209, 213, 214: n = A,T,C or G
  misc_feature 215, 217, 218, 220, 222, 223, 224, 227, 231, 238, 239, 241,242, 243, 245, 246, 250, 251, 258, 259, 260, 261, 264, 267,270, 271, 273, 277, 279, 283, 287, 289, 293, 295, 297, 299,301, 303, 311, 312, 318, 325, 326, 327, 328, 329, 332: n = A,T,C or G
  misc_feature 333, 336, 337, 338, 340, 342, 343, 345, 346, 348, 349, 354,360, 362, 363, 364, 367, 371, 372, 373, 378, 379, 380, 384,386, 389, 394, 395, 397, 398, 399, 403, 410, 416, 417, 418,421, 423, 432, 435, 437, 439, 440, 443, 444, 445, 449: n = A,T,C or G
  misc_feature 456, 458, 461, 462, 463, 465, 466, 470, 477, 479, 482, 483,487, 488, 492, 495, 498, 501, 502, 503, 504, 505, 507, 510,511, 515, 516, 517, 518, 519, 521, 527, 528, 530, 535, 536,541, 545, 546, 552, 553, 554, 555, 556, 560, 561, 565: n = A,T,C or G
  misc_feature 566, 568, 569, 576, 578, 581, 583, 586, 588, 590, 591, 592,593, 594, 595, 607, 609, 612, 615, 624, 625, 628, 633, 635,637, 638, 641, 644, 645, 646, 649, 651, 653, 655, 659, 663,665, 666, 669, 675, 679, 685, 690, 691, 692, 697, 702: n = A,T,C or G
  misc_feature 705, 706, 718, 719, 720, 722, 724, 725, 727, 733, 738, 745,747, 748, 750, 751, 756, 769, 772, 773, 775, 777, 779, 780,783, 786, 787, 793, 803, 807, 812, 822, 826, 829, 835, 836,843, 845, 851, 852, 856, 864, 866, 867, 872, 876, 879: n = A,T,C or G
ccgctcngcannnncttcctntgacgcgcgnttntntgntgtnnnanncnncngtatgtncncntnnaccnntgcgnctnntcagcgtctacganntggngntcatataggggggngattnacactgngngggtcnttagnncgttttggaaaaacccntctggcagcgnccngcgaggtnnancganctcgctantaagngngggcnntaannngnnantnnngtnaggngcagtgnntnnntnnaggnnaattggnnnntantgntgnngnaacntnatangtcnangttnantntngncngatatggnnttctgntatcgtnnnnntcnntannnantnngnngnntgtcntgatgntnnngcntgtnnnaagannncttntntcntgtgnntnnntgtncttcggntgtgtnnnttngncccctaatnccngntnncannnttcntgctggnanctnnncnntccntttttgntnatnntccnngtcngcntgnccnnnnngnctnncgcnnnnnanttccgnnantagcnnagctntggnngctctnnnnntagnngatnncnngtgctantncancngantntnnnnnnacgccgctacgncnctntcngatcgtacnncantgtgntncnncanacnnnacngntntnagcncagnanngtntacgcntctngtaccncgcannntcgangcgcngtnnagtctgggcgtnnntngnnanatgatntcggntcccacntnntnngcgcntgcaaagagtgtnatnncncntnngcncannggtgtnacatacaganacantagcnggagcgcctnattntgngtctanntacgctntntgtganngatntacatctnanntggcntgcnacntnanntnatgncgcnantnntganntnnnggagangttcagcnncaaattggcacgngcatntngnncttcagtgacgcnntcgnnantnnannacacncttgnctgtantgtcgtnatcnntaaccacnctntcttactnngnngntcnncgggnnngaagnnnatnnntncnnncgnatgcgcagatacgctnggnncganattgngcttgtncacgctcagcacngttntnacagngtnnntntcctnnctgtcgncatgncnncggncatnncgtnagtntgtacgtacngcggcaatantctnatntangctcancntnagcncnnnctgcnngagtntnngtncatgtannganagatnatancgtnanttnntgnagnngtnncgcccngnngannngtacatactctgtnntnnnngatctccncgctncgctgntctctncgngtnntatnancgacgtttnnacagnnanntcancntnactcccgntctgatnnnng

SEQ ID NO: 7741 - DNA, 1492 bp, Homo sapiens
  misc_feature 6, 7, 15, 22, 27, 28, 38, 40, 44, 49, 50, 54, 66, 67, 70,73, 75, 76, 82, 90, 91, 94, 97, 98, 100, 101, 110, 111,115, 118, 126, 136, 141, 149, 151, 152, 154, 161, 167, 184,191, 204, 209, 217, 222, 223, 224, 228, 238, 239, 247, 248: n = A,T,C or G
  misc_feature 251, 260, 264, 267, 268, 271, 276, 279, 282, 285, 290, 291,292, 293, 294, 295, 296, 302, 305, 308, 311, 313, 318, 323,328, 334, 335, 336, 345, 348, 354, 355, 359, 360, 361, 365,369, 372, 373, 377, 384, 391, 396, 397, 399, 401, 402: n = A,T,C or G
  misc_feature 405, 409, 410, 411, 412, 414, 417, 418, 424, 426, 430, 431,435, 444, 448, 453, 456, 461, 463, 467, 470, 477, 478, 481,483, 489, 490, 491, 493, 495, 496, 497, 498, 499, 504, 505,508, 509, 510, 513, 515, 516, 517, 521, 523, 524, 528: n = A,T,C or G
  misc_feature 529, 537, 540, 545, 551, 554, 555, 559, 561, 562, 567, 568,573, 574, 575, 577, 578, 579, 581, 585, 590, 593, 594, 596,597, 599, 601, 606, 610, 614, 624, 634, 640, 641, 645, 646,649, 650, 654, 656, 659, 662, 665, 669, 674, 676, 678: n = A,T,C or G
  misc_feature 682, 684, 689, 690, 694, 701, 710, 712, 715, 718, 722, 724,726, 731, 734, 743, 744, 745, 749, 757, 760, 761, 767, 769,771, 772, 773, 784, 790, 794, 796, 797, 799, 806, 811, 814,823, 824, 825, 831, 836, 837, 838, 848, 853, 857, 869: n = A,T,C or G
  misc_feature 872, 873, 877, 878, 881, 893, 896, 901, 906, 908, 911, 916,917, 918, 926, 930, 936, 937, 938, 944, 945, 957, 958, 959,966, 967, 975, 986, 987, 993, 998, 1004, 1009, 1010, 1022,1025, 1031, 1032, 1044, 1046, 1050, 1052, 1054, 1055: n = A,T,C or G
acgtcnntctgtccncattacnctatnnacacacgtgnancctngacgnncacnctgtgtctatcnnctnganannataacnttgttgcnntgncgnnannacgagttcnnctantgntgcattancacgagaggnctctncatttatntnngngggcacnccgcgncgttttggtaaatcccntattgtnatggaacgagtcngctancaacatcntgatnnntagntcccgatcannatgaagcnntangcatcctcngaanctnnatnggtanatnttnatntagcnnnnnnnttgcgnacnctngananatagnggacnctagntagtannntagtccatnacntatctnntgtnnnaaancctncannaccntctggcntgaaaanatacnntnannttnggannnncncgnncgtgtnancagnngggntggattgtnttgntgtgngcnctatncnctgnggnctaaatnntantntactgnnntnannnnntaagnntcnnnctnannncaancnnggcnnttgagatntgnacganttaggngtnnatcngnntaggnntatcnnntnnnantganataangcnntnntntnctcantggntcgngcgctgcttntcttggcagngtagtnntgcnnacnnatgngngcnctnacncacngcacncncntcancngatgnnctantcacagnaccaacatncncantancttnanantactnacnactgacgcnnntgtntctcgccntcnngagganancnnngacatgtctcngaacantccncnncntcacatntctcngcncgttcactnnntatgcnaagcnnntgaccgaccnttctntctntacatatcgttngtnntgtnnatnacacgcattctntcnccaanctatncnccntcacnnngtagaganaacncgattnnntacttnncgatagcgcgcnnntatactnnttacatanatcactacttnngcgatnatctnaatacnatacnntgcggtcagccnatntgaacnnctcgaacactcngngacntntnnatntntcanncatgnatnnnanatacttgtgtgntnagcacacttannctgagcgtancngctntatcgtnacagcnttcgntntacacagancatacnttgntntancgtatnnacnctatantgcaccntancnactgatntngtatnngnaggtgangntnaagnggancnntnnaanntgncntancttctcctncngnggnncgnacncancnncntgagagtcnngtnntgncancttntatcnaannaancncnactntacgccntgatcnnnngtctcgcngtntnnntgtatattgncgatctaaatanncnntgttgcgnntntataagacnnctgctctnnatgctctgnntcactagnncagtctcnttcnntgnacaganngactgctntanncntacgctctcgtgtntgnccctcnnatccg

SEQ ID NO: 7742 - DNA, 710 bp, Homo sapiens
  misc_feature 5, 11: n = A,T,C or G
ttcanatacanctcttgttctttttgcaggatcccatcgattcgaattcggcacgagggataccgtatcgacgtggggcctccggttgctgctaaatgggaaaaacttagcttagtactgatagatgactttattgaaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaaagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattcttccttataaactgtttcctcaaaaatctaaaatcaggaagtgagaatttcctaattgataatatggcatttactttggagaaggactagtcacc

SEQ ID NO: 7743 - DNA, 721 bp, Homo sapiens
  misc_feature 4, 617, 629, 660, 670, 675, 683, 695, 721: n = A,T,C or G
ttcnatcagctcttgttctttttgcaggatcccatcgattcgacctcaaaaaaaatgctgatatcctaaaatattcctagtatcctaaaatattccataaatcagatatcctacaaagccaaactggtccttcttgttaaaattaataagattctataagctgttaaccaaaaaagtttccactaacactgcatacttaactctcctaaataaatttaaatatgcaaaatgttaattcaaatcaaaataataataaacacaaccataaagctagcaattaagattaaaaggtttatgagtgtctattaaaggataaatggataaagaaaatgtgatatctgtatacaatggaatactattcagctataaaaatgaatgaaatcatgtctttttgtggcaacgtggatggaactggaagccattatcttaagtgaaacagctcagaaacagaaagtcaaatatgctggaagatcttctctgattactttaattttctaagccaggtcattggcttagtaagaaaggaagctattaggagtttgaaaagagaggagagcatataattgtctagaaagtgggaaagtgaatggactagagaaatacagtatgatcaccangccagtgttaangggctcatttgaggctaaagggtctgagttnaaaagtgganggccnggtcagcnttgggttttggngcttttttttcttccagccccctttn

SEQ ID NO: 7744 - DNA, 712 bp, Homo sapiens
  misc_feature 5, 456, 526, 589, 635, 644, 645, 646, 647, 648, 652, 653,654, 655, 656, 657, 658, 659, 660, 661, 662, 663, 664, 665,666, 667, 668, 669, 670, 671, 672, 673, 674, 675, 676, 677,678, 679, 680, 681, 682, 683, 684, 685, 686, 687, 688: n = A,T,C or G
  misc_feature 689, 690, 691, 692, 693, 694, 695, 696, 697, 698, 699, 700,701, 703, 704, 705, 707, 708, 709, 710, 711, 712: n = A,T,C or G
tacanctcttgttctttttgcaggatcccatcgattcgaattcggcacgagcgcgacgcacattgatggagcgtatgtccaggcgccggtgcaccgcaaggagcaaaacagacacagttcttggtcctagggctcacgtcccggggcgaagaggatcctccataaacgatcagccatagcagctgtgattggacaagagactgatttcagtgactttctcctgataagagaccaccgaccagctgaccatgccgaccagctgacccgttaatagagagagatgatgcacctgcatgcctttgtgtcctgaaaagacgttttgccataaaggccctaattgtaagatgtgtaaatgttaagtctccaccccaaagtgaacatgggtcatatattacatgctttgctcaataagagggcatgtgtcaggaccaccttcatgaatattcatagctcctnctgttacctgttgaatatgtatgtttagccaatcccttcagcatagcgctccttgccccaacccctcctncttggacgtgcctgtctctggccttggctggagacagattcccagcctcagacagatggccgncacctttgcaggctacgaaccgtttacaaaaaaataaagccttctnttttttccnnnnnaaannnnnnnnnnnnnnnnnnnnnnnnnnnnnnnnnnnnnnnnnnnnnnnnnntnnntnnnnnn

SEQ ID NO: 7745 - DNA, 678 bp, Homo sapiens
  misc_feature 4, 11, 472, 483, 591, 611, 638, 648, 663, 668, 672, 673: n = A,T,C or G
ttgnaattcanatcagctcttgttctttttgcaggatccctcgattcgaattcggcacgagggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaactcctaaaacaccaaaaaggcctagttcttgtagaagacattaagcanaaatgccagcnagtatagaaaaagcgcattgacagtcctgggcctcatgtaaattaagcccaaagatggggagaaggaaaaggagagacaaatatagtccatctgagtgtatcaccatncagctgagtttcttttattnatccctttctgttgcaccatcctttcngtggaacatnttggtcctaaccttntttgntgtnngttca

SEQ ID NO: 7746 - DNA, 817 bp, Homo sapiens
  misc_feature 4, 12, 18, 397, 601, 614, 618, 653, 664, 669, 688, 694, 707,720, 751, 755, 756, 806, 816: n = A,T,C or G
ttgnaatttcanatacanctacttgttctttttgcaggatcccatcgattcgcctgatcctgccaacagcagttcaggccagccccacatggagcaagtacctgaggcccagccccttggggacttgcccatcctggaagtggaggagatggagcccccgccggttatggagtcctcccagcccgcccaggccaccgccccgcttgactctgggtgtgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcanagaggctgagtcacttacctgaggacacccagccaggcagagctgggattgaaggacccctatagagaagggcttggcccccatggggaagacacggatggaaggtggagcaaaggaaaatacatgaaattgaagagtggcaacttgccttgcaaaatctgtttccgttgtaacaagaacttgaattttgggacccccaagccncaattggggcttnacgnccttggtaaattccccaaacaacttttttggccangggccccaaangggtnggggaaaggggaatcaacntttaanaaggccttttggngaagttttttggnaaaaaaccaagccccttggggggccaaattntttnncccaagggaaacccccttttaaattttccaaaaaaaatttaaaaaacccnttttcaaaana

SEQ ID NO: 7747 - DNA, 718 bp, Homo sapiens
  misc_feature 9, 15, 673, 688, 704: n = A,T,C or G
gaaattcanatacanctattgttctttttgcaggatcccatcgattcgaattcggcacgaggtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccacacaccgttccggaaggcaaaagccttgtatgcctgcaaagcttgaacatgactcaaaactttcgttcacagcaggcacggtcttcgataatgcagaagtggtccttcagcttncaacagccatttttnactggcacaccggaancttccggggcacct

SEQ ID NO: 7748 - DNA, 709 bp, Homo sapiens
  misc_feature 3, 78, 226, 589, 610, 614, 654: n = A,T,C or G
canatacagctcttgttctttttgcaggatccctcgattcgaattcggcacgagtcaggctgggagggacttcagttngcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattnaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttantgactggtagatagctattangtanggtaggataaaataaatgatgctagaggcaacaggtctanggttaaggattaaggccttggaaattgggaatctcaccatggctccccttccttg

SEQ ID NO: 7749 - DNA, 1595 bp, Homo sapiens
  misc_feature 2, 18, 25, 26, 31, 37, 39, 41, 46, 50, 52, 53, 54, 56, 60,62, 72, 78, 79, 84, 87, 88, 89, 91, 93, 98, 105, 106, 107,108, 110, 118, 122, 127, 141, 145, 150, 154, 155, 156, 168,169, 174, 176, 178, 181, 196, 206, 212, 214, 222, 224: n = A,T,C or G
  misc_feature 225, 226, 233, 238, 254, 258, 260, 264, 268, 270, 275, 276,281, 288, 289, 290, 293, 295, 301, 303, 306, 308, 310, 311,312, 316, 317, 322, 327, 328, 330, 333, 339, 342, 344, 345,347, 352, 354, 355, 361, 363, 364, 366, 368, 369, 370: n = A,T,C or G
  misc_feature 371, 372, 377, 381, 382, 384, 389, 390, 392, 395, 402, 404,405, 410, 412, 414, 415, 416, 422, 429, 432, 434, 436, 438,440, 442, 445, 450, 455, 458, 462, 467, 473, 475, 480, 481,482, 483, 485, 489, 491, 493, 494, 495, 498, 499, 500: n = A,T,C or G
  misc_feature 501, 503, 506, 509, 511, 513, 515, 516, 524, 527, 529, 532,539, 541, 542, 544, 545, 548, 549, 551, 553, 554, 556, 557,558, 560, 563, 564, 567, 571, 572, 581, 582, 583, 584, 589,591, 592, 594, 595, 596, 597, 599, 601, 603, 604, 605: n = A,T,C or G
  misc_feature 609, 612, 613, 615, 621, 624, 633, 637, 639, 640, 643, 645,646, 647, 648, 650, 652, 654, 662, 664, 667, 669, 674, 681,687, 696, 699, 707, 708, 709, 710, 717, 718, 720, 721, 728,732, 735, 742, 754, 765, 769, 771, 773, 778, 784, 791: n = A,T,C or G
  misc_feature 795, 796, 799, 801, 802, 803, 806, 807, 814, 819, 820, 830,845, 851, 854, 856, 859, 861, 867, 869, 870, 877, 878, 881,886, 894, 897, 898, 900, 903, 907, 912, 913, 914, 915, 918,919, 920, 926, 928, 929, 930, 931, 933, 939, 952, 960: n = A,T,C or G
gntttaaaaaggaaaaanggatgannagganggttantntncgatnggangnnntnacgnanaattcggacnttgtcnngatancgnnncntntcgtntgtcacnnnntnatatgatntctngcgcntgtgaggggtctcnagcntgcgnaccnnntgttactgaganngagancncncantagaagagtacgccnatatctgggngacggntnccagctgncnnnttttggnaaaangcccttcagtgccaanagcntnttcnatcntnatatnnctacnctcagannnatngncctgananagngnannncatnntgganatgcnntnggncatatntgntnntnagagnanncagttngnngncnnnnntggangatnngnttganntnatnatcagcntnnacctntntnnnccgtgngaatatnctngntncngngnttnagggnttgcngtncggnttgcncaggantnttgannnntncgtncncnnntcnnnnangtnctngncngnntagtgacngantnaangaggtcntnngnntcnntntnngnnngnttnnagnatanngcgcacgannnnctgtngnngnnnncncntnnntcanctnncnaaaccntanactggatangtantnncgnannnntncntntgtatatntntcncngtatnttcgccncacatntgagctatnatnatagatcnnnnatcgcanngnncatatgnacgnatnggagtcngcagctgcacanggaggacacgngtgntnanagtgntatatnagagcanatgnnacncnnngannctcacgnaatannatgtggcacngtagattcatgctanagagcncgngngcngnacagcntnnatgatannagnttgtnagcgatcnatnnanttngatncacannnnctnnntcgttntnnnncncagttncacgcgtgagcanagtagagnacnttgnannncgaatgnntnctgtatcgcacgnncttgcgtacacantntnnanacgngcnattatntgcgnnccncgctgcncgcgctnacnnctnanatcgcntttgacgcnnagtatgattgnatggcgntgcncgtgnnanncgnatnntggacgnatntgtgncgttntncgcncannnncgntctntggnnttagaganacgtgtntcactgnntagnagaggncgnttgnnacggtnacagtntctgngatagantgaangagtagatgcancnganaagggtgtcnctagtncacgcgnntnacntcnnttgtngaatgacntcatctngatatggcncggngccgatatgactnactcgctacangtgtctngatttncgnntgacgagnntcgcgngagcntactcantgnctntatggngcgnncgnatatnnctatnnnttgntagtcngtccatcantntncaancgattagtcgncacgntnnccgcattacgatgatgaccnnacgataggnatngctctnngtctnatcncacantnanganctattnnatnagaancatgnnaannnttggtactatcgnatangtctnnanctatnaaggttatcgaacacnagcg

SEQ ID NO: 7750 - DNA, 776 bp, Homo sapiens
  misc_feature 6, 12, 395, 432, 437, 439, 442, 454, 463, 502, 524, 541,560, 566, 586, 659, 677, 693, 720, 726, 746, 752: n = A,T,C or G
tttcanatacanctcttgttctttttgcaggatcccatcgattcgaattcggcacgaggtcaccaacttgaaaccagcaaccatcaaggtctatgactactacctaccagatgaacaggcaacaattcagtattctgatccctgtgaatgaggataggagctggaaactcaattagtcctctgtgacattactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatggacagggtcattagggggaagaaaggngggttaactggtttatttaaccattcagggggctctncaaananganaccgtggtaganggtgactanaaaagataagaatgtctttcttagggccggttgccggtngctcacccctggtaattcccancacttttgggaattgcnaagggtgggccggaatcantttganggtcaagggagtttcaaaanaaccaagccttgcccaaacaattgggaaaaaacccccgtcttttttcttaacccaatttccaaaaaaattttnccccttggtggttgggtnggcaaccggggccctnttaattcccaacccccctttgggaaangggccnaaggcaagggaaaaaatccncctttnaacacttggaagggtggaagggtt

SEQ ID NO: 7751 - DNA, 762 bp, Homo sapiens
  misc_feature 2, 3, 4, 5, 8, 9, 18, 22, 36, 697, 713, 735, 743, 750: n = A,T,C or G
gnnnnttnntttgattgntctngctcttgttctttntgcaggatcccatcgattcgaattcggcacgaggtcaccaacttgaaaccagcaaccatcaaggtctatgactactacctaccagatgaacaggcaacaattcagtattctgatccctgtgaatgaggataggagctggaaactcaattagtcctctgtgacattactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatggacagggtcatagggggaagaaaggtggtttagctgttttatttagccattcagggggctctccagagaggagacggtggtagagggtgaactagagaagataagaatgtcttcctaggccggatgcggtggctcacgcctgtaatcccagcactttgggattgcgaggtgggcggatcacttgaggtcaggagttcaagaccagcctggccaacatggtaaaacccgtctctactaacaatacaaaaattagcctggtgtggtggcacgggcctgtaatcgcaaccccttggaaggccaaggcaggagaatcgcctnaacactggaggtggangttgcagtgaacctgagaatgngccactgnacttcancctgggcaatgg

SEQ ID NO: 7752 - DNA, 703 bp, Homo sapiens
  misc_feature 5, 11, 562, 656: n = A,T,C or G
ttcanatacanctacttgttctttttgcaggatcccatcgattcgaattcggcacgaggttggcttccccgggagaggagtatgaggattaaaaatattcagaaacaaacaaaagaacacaaaaatgcaaacacatggtagggaattactactgcttattctcaacagtaccacagaaccagtgtttgagtgctggcaccatatgcaacatggggcatccgggctggagtgatccagttttttagttggtggtggcgatgatttttctttccttttggtttataattttctgttcatttttccccctttctcccccacattcattaagaaccctactgaaaccctaggtgacaaaaggtgtgccttctgttgccacatttgacccaccacaggactcactggactggacttctatttatattgtattaagtaactgatatatatatatatatatatatatatatatttttgattgacaccaaaaaattaccttggcacaaatgccagacctgtgaaggtcagaggcccgctgcttctcccaggagggagggaactttttggntgtctgtggcaattcctctgtacagattgtaactttttaaaaatttcccttcaccccgtcacttgaatatatgttcatagtaaatttgtaaganacttcttttccttattttggtgcaagaaccttccgacacattctgtt

SEQ ID NO: 7753 - DNA, 858 bp, Homo sapiens
  misc_feature 3, 6, 33, 420, 427, 428, 452, 457, 491, 503, 522, 541, 553,571, 580, 590, 597, 621, 631, 639, 660, 663, 671, 692, 705,711, 712, 717, 736, 748, 754, 766, 774, 776, 779, 789, 806,827, 831, 844, 854: n = A,T,C or G
atncanatacaactacttgttctttttgcaggnatcccatcgattcggctcagtgctggcatgttgacctggtgttgtcagtgagtctgtggatccagggtcagtgctggtatgtttagctgacattggcagtgagtccatggatccaggctcagtgctggtatgttgacctggtgttgtcagtgagtctgtggatccaggctcagtgctggtatgttgacctagcattggcactgagtctgtggattcaggctcagttgctggtatgttgacctgacattagcagtgagtctgtggatccaggctcagtttcacagaggtttgtataaacatggtctcaggtgggttcttgacacctgggtttcaagcacaaaagtactggctgggcttgttaggtgaagtggggtggggtctaccacnatgaatnncataattctgaaggctttgccaanccctnggggaaaggtggggttcaaaacacaaggttgaanaaccctttccgntgggttaggggtccaagancaccaaattaagggtgaanttaagtggttgnggccttctttattattcnaaagggggnaaaaggcccngtaattncaatttgggtaaagggtgggtttnggtcaacccntggggggnttcttggcccttggggttggnatngtctcttnaagggggaaaaccccccttanaaaggaattccangccttnnggggnaccaaggggtaaatccttngttccctcaagncaaccnccttgggttccnagggtctntngantaagaaccangaaacttccaggggttnaaataacaaaaagggggcttntaanggaatcttggttnaaccccaagnccct

SEQ ID NO: 7754 - DNA, 704 bp, Homo sapiens
  misc_feature 10, 11, 585, 658, 692, 700: n = A,T,C or G
ttgaatcccnnatacaagctcttgttctttttgcaggatccctcgattcgcaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagagggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctggtactgtatatatgctagagcctcactcctgtcaatatattcttggggttgaatctccagtgatctgtaaaatcttagatcnagccagattgaaaatgggctttctttctcttccccaactaaaaggatattaaagttagggggaaagaaaaaancatttgaagtcatgattaatttctgtcccactgngtctcatnataa

SEQ ID NO: 7755 - DNA, 700 bp, Homo sapiens
  misc_feature 4, 6, 11, 597, 628: n = A,T,C or G
ttgnantcccnatacaagctacttgttctttttgcaggatcccatcgattcgcagaaatcagcatgcatgaattaatcgaaatacaatgcatattaaacaatgcaattactatagtctaaatcaccaaactgataacccatacaaaagtagctcttacaactttttttgagaatatttcccctaaaaaattccagtgatcatcccaacctacaaaactagattattttactagtatcatcttctctttacccctcttctccccaccaacactccctccaacacacacacacttctccttaagagaaacggcttcctcaagaaattatctgatggttcagtagcagttggagttttacacaaactatgttgtgattgggcaaggcagactaccagatctgggattcagtagaccattccttactgtcagattatcttctaagtgactgctcttagagaaacaacacagatttgcctcaagagattacaaatgtggtaggcctaccttaacagcaactagttttttttaagaaacacggtcgcactgtcgcccaggcaggaacacaatggcatgattatgctcactgcacctcaaactnctaagttcaagtgatccttctgcctcagctnctggaatagctcaaactataggcatatgccaccatacccaagctaggtttttcggttttttggttttttaaa

SEQ ID NO: 7756 - DNA, 697 bp, Homo sapiens
  misc_feature 8, 577, 649: n = A,T,C or G
gaattcanatacaagctacttgttctttttgcaggatcccatcgattcgaattcggcacgagaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatattccagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaccaacaagcaaaacaagtgagaacaggaaaaaggaagangacactggaatcaattcttgagagttgcactacttggtttttcttccattccaagtttcgtgggacccaganccttttttcttttaaaagctaaaaaaacaagtgtttaattcctctttt

SEQ ID NO: 7757 - DNA, 698 bp, Homo sapiens
  misc_feature 5, 7: n = A,T,C or G
ttgantncatatacaagctacttgttctttttgcaggatcccatcgattcgaattcggcacgaggcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgaggaaaccgaggcttgggggttaatggcttgcctagattcacactgctagccaaggaatgaactgggaatttacaccctgaccctgactgcttttcacattttctacacagccttttcaagatcctgccaattctaaaaat

SEQ ID NO: 7758 - DNA, 705 bp, Homo sapiens
  misc_feature 5, 615, 658: n = A,T,C or G
ttcanatacaagctacttgttctttttgcagggatcccatcgattcgaattcggcacgagccgactagtaacataaatcatagcttccaaagtatttgtttacagaataccacagtgactaattaccagacttttcttattctctctgagcaaaggaacctcatgggagaaaaaaaatataggtcatttttaatgtaagggagttgctaggattggaggttaagacaactatttaaacttcataaaaggaaaaacaaaagacctcaaaaagtattttctaaaatagagaaaggtgcaaatcttcttatcagaaacgcattataaatagaaaagaaactcttaaaagagattcttcaaatgtgacaaaaagctcttggtttcctgaaaatgtcaaaaacaaaaacaaatattgacaatactaaatatccaacagacagggtaagaacttcacttagaagcaaatttccatttaggtaatttatggtgcttctgtgcaaaaagttgctttacactgtgtagtcgctgaagacactccagaattgctagaccttcacaggaaaaattttaaaggtcaggggtttttttttctttcccttagttagcacagccactcanggggcagccagttctctaacgtctgagtaaaacccctacacangggcttcatttccagtgcccacgtcattggcttttgcagactatctt

SEQ ID NO: 7759 - DNA, 698 bp, Homo sapiens
  misc_feature 6, 539, 633, 690, 698: n = A,T,C or G
attcanatacaagctacttgttctttttgcaggatcccatcgattcgaattcggcacgagatttccctttgccctgccactttcaccatagggccttcttacctggcagaggagtgccttagataccagaagattggcagggaagaagggcagccacttcctggttaccatggagaagcttgtcatgctccaagcctgtgcttacttgtccagtagcaacaatgggaaactgtattatttggggtaggggtagaaccctgagggcataaagctaagaattccaggctgcatctggcagaatcggtttggcaggggttcagctgctccctgggaggccttggcatagccaggctgctccagcactgtgagctgggagtctcctcttgcagaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcngctggtgtcaccatcagctctgtggaagaagaagcttgatggcattccagccagcccccaaagtgattcgcttgcattgaccaacacacctgtnggtagtgcaaggaaggcgcttcagtgtaccccacgggcacccatgccctggtgggangatgggcn

SEQ ID NO: 7760 - DNA, 760 bp, Homo sapiens
  misc_feature 8, 11, 13, 503, 524, 556, 579, 584, 591, 606, 626, 663, 687,697, 703, 753: n = A,T,C or G
ttgaaatncananacaagctacttgttctttttgcagggatcccatcgattcgaattcggcacgagcttgtgttttcttaactcccccagtaatagacctaactgattttgttttgagaagttcggtattagcttaagtttttgttcgtttatagaatatcaaaatggtatcaaaactgtttaaaaggtcaatgtacatctgtagcagagctttttactcttttccttgtcttctttctctttgtgtatatacattgtttatagttgtattcagtatacatgaaattttgtgtcttttttactcctctctgtataaactttctgtgctgcaacaatgtaaattacattcaggttgtttccagttttttttttactctgctgtagcgaacaaaaaaacaaaaattagccaggcgttatgccatgtgcctgttaatcccaggtacttgggaggctgaggcgggtggatcatgaggtcaggagacaagaccattctggctaacacnggtgaaaccccgtctctactnaaaaatacaaaaaccaaaattttagcccgggntatgggtggggggggccaccttnttagncccccancttacctcaaggaanggcttgaagggccggggaanaaatggggcattgaaacccccggggaccgttgggaanccttggccaaatggaagcccgaanaaatccgcgncccacntggcaccttcccaagccctggaaccgaacaggaaatggaaaacctggcantctttca

SEQ ID NO: 7761 - DNA, 689 bp, Homo sapiens
  misc_feature 6: n = A,T,C or G
attcanatacagctacttgttctttttgcaggatccctcgattcgaattcggcacgagctgttcactggcacacaatcacagtgtcttgatagtttttctggttttgaatttctggaagggaaatcctccttctgaggagacttcactttccgtcagtaatggggaaaactgtttccctcgggatagcagaggtcattttaaaagagaacactcagcagaaatgaaaatccaaacaactgatttttaattcgtgtctctttgttcagtgatgttggtcctgattctgcctatgagacgggaataaagagagatttcgggaaaagtgtgaagccaaacatgggtgctatttaaataccaccctcataatttgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttggacttttgttccagtgtttaaactttgacaaaaatggttttgaatagatctttataacctggatgccataaataccaagattctc

SEQ ID NO: 7762 - DNA, 686 bp, Homo sapiens
  misc_feature 4, 10, 635: n = A,T,C or G
tacnatacanctacttgttctttttgcaggatcccatcgattcgaattcggcacgagtataagattactttcatgttggatagtgctgctatgataacagtacatactccaaggagaggattaatagacgtaaagcctcttggtgttatatggggaaagttttcggagttttacagcaagaaaaacaccattatgtttgatgacatagggagaaattttctaatgaacccacagaatggactaaagataaggccttttatgaaagcgcacctaaatcgtgataaagacaaagaacttttaaaattaactcagtacctcaaggagatagcaaaattagatgactttttggatctaaatcacaaatattgggaaagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttggaaaaatattttctncagcgttgggttactgaccaccccaccttccaccacacacacacacacact

SEQ ID NO: 7763 - DNA, 684 bp, Homo sapiens
  misc_feature 3: n = A,T,C or G
canatacaactacttgttctttttgcaggatcccatcgattcgaattcggcacgaggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaaaggagggaccccgccaccccagcagctgaggaggggattctggaactgaatggcgcttcgggattctgagtagcagggggcagcatgcccatgggcctggggtccccgggagggattccggaattgaggggcacgcaggaatctgg

SEQ ID NO: 7764 - DNA, 696 bp, Homo sapiens
  misc_feature 3, 645, 652, 689, 693, 695: n = A,T,C or G
canatacaagctacttgttctttttgcaggatcccatcgattcgaattcggcacgagcagcaactcaggaggctgaggaaggagaatcacttgaacccgggaggtggaggttgcagtgagccgagatcgccccactgtactccagcctgggtgacagagcaagactctgtctcaaaaaaaaaaaaaatgccactggagagctttgaggagaggatcagtctggctactgggttgggaattaatcatagcaggcaaaggcaaaagaagtgaggttagttaggaggctttacaacaacccagatgagagatgggaggttttagccagggagatggagatgttgagagagtagctggactcaggattgtgacagtggactgaaggaaaagcaggttttgggggaagattgcatttctcccttcaacttcagttacgtagatcacccatatgccacacaactgcaactctgtaacagccaatttttagcttcttccttatctaagccatcctgtaggccataggaattaaaactaggttggatcaaggaaaagtgaatgctagatccatacaaaactatttggatatttgcctttgtattttattggttttgaaattattttttaatgggttcaataaaactcttactngaacttncaaaaaaaaaaaaaaaaaaaaaaaaacttcgagcctnttananc

SEQ ID NO: 7765 - DNA, 856 bp, Homo sapiens
  misc_feature 2, 6, 7, 8, 9, 10, 15, 211, 213, 218, 220, 221, 222, 223,224, 225, 226, 227, 228, 229, 230, 231, 232, 233, 234, 235,236, 237, 238, 239, 240, 241, 242, 243, 244, 245, 246, 247,248, 249, 250, 251, 252, 253, 254, 255, 256, 257, 258: n = A,T,C or G
  misc_feature 259, 260, 261, 262, 263, 264, 265, 266, 267, 268, 269, 270,292, 298, 300, 324, 327, 365, 386, 413, 426, 457, 502, 509,519, 539, 550, 576, 588, 598, 617, 629, 640, 657, 664, 682,697, 711, 726, 731, 735, 742, 772, 780, 794, 796, 798: n = A,T,C or G
  misc_feature 800, 820, 824, 831, 838, 839, 842, 847, 848, 856: n = A,T,C or G
tnattnnnnnaactnttgttctttttgcaggaccctcgattcgcgagccacaagctgcactgtgaacctgggcactccgcgccgatgccaccggcctgtgggtctctgaagggaccccccccaatcggactgccaaattctccggtttgccccgggatattatagaaaattatttgtatgaataatgaaaataaaacacacctcgtggcananaaaanannnnnnnnnnnnnnnnnnnnnnnnnnnnnnnnnnnnnnnnnnnnnnnnnnncctcgccctttaaaactatagngagtcntnttacgtaaatccaaacatgataanatncattgatgagtttggacaaaccacaactagaatgcagngaaaaaaatgctttatttggnaaatttgggagctattgctttatttgnaaccattataagntgcaataaacaagttaacaacaacaattgcnttcattttatgtttcaggttcagggggaggtgtggaaggtttttnaattcgnggccgcggcnccaatgcattgggcccggtncccactttttnttccctttaatgagggttaatttgcnccccttgggcgnaatcatgggncataactgtttcctggggngaaaatttgttnttccccttcanaatttcccccaaaaaanaataccnaaacccggggaaaccttnaaaagtggtaaaaanccctgggggggggncccttaaatggaggnggaancctnaacctcnacaatttaaatttgggggtttgggcccttnaaattggnccccgttttttccnanancnggggaaaaaacccttttttngggnccccaantttggannttnaaaannaaatccgn

SEQ ID NO: 7766 - DNA, 802 bp, Homo sapiens
  misc_feature 3, 11, 51, 109, 464, 496, 572, 606, 649, 651, 655, 661, 687,703, 706, 710, 716, 717, 749, 752, 753, 772, 776, 780, 781,782, 784, 788, 794, 796: n = A,T,C or G
gcntttgaatncatatacaagctacttgttctttttgcaggatcccattcngattcgtcttggcccatgtgggtgaaacttctgcttttactaaaattgcaaaaattanccggtgttggtggcacatgactgtatcccactactcaggagactgagcaggagaatcactcaacctgggaggtggaggttgtagtgagctgagatcgggccattgcactccagcctagctacagagcgaaagtgtctcaaaaaataaatacataaatagagacggggtcttactgtgttgcccagactggtctcaaatttctggactcaaagtagtcctctaacctcgtcctcccaaagtactgggattacagtcatgggccactgcacccggcctatattcactgtagttatttaaaaatataagccgggcatggtgtctcacgcctgtaatcccagcactttgggaggccaangcgggcaaatcacctgaggtcgggagtttganaccagcctggccaacatggtgcaaccccgtcttttaccaaaaaatacaaaaaattacccagccgtggtggcgtgcncctgtaattccaagcttccccaagaaggcttgangcaggaaaaatcgcttggaaccccggtgggcaaaaagcttgcnanttancccaanaattacgccccacttgcacttccaanccttaaggtggacaanaancaangaactnnttttcaaaaaaaaaaaaaaaaaaaaaaaactncgnngcccttttaaaaattattngggnaggnnngnattnaccttnanatcccg

SEQ ID NO: 7767 - DNA, 988 bp, Homo sapiens
  misc_feature 5, 7, 8, 9, 10, 11, 12, 17, 41, 42, 44, 50, 51, 56, 60, 62,77, 84, 90, 93, 95, 109, 116, 120, 133, 141, 144, 146, 147,150, 151, 154, 156, 158, 167, 171, 172, 173, 175, 179, 187,188, 191, 196, 213, 215, 216, 224, 225, 226, 228, 235: n = A,T,C or G
  misc_feature 240, 242, 246, 252, 258, 261, 265, 266, 269, 271, 272, 273,274, 276, 284, 286, 288, 290, 298, 299, 312, 314, 318, 319,320, 323, 324, 325, 332, 333, 335, 338, 341, 347, 348, 353,364, 365, 397, 399, 400, 401, 402, 403, 411, 417, 419: n = A,T,C or G
  misc_feature 420, 440, 444, 451, 454, 473, 487, 490, 491, 497, 505, 507,521, 522, 523, 524, 535, 537, 539, 542, 546, 548, 549, 552,557, 559, 566, 568, 571, 582, 587, 594, 610, 613, 617, 620,621, 623, 638, 654, 656, 658, 659, 673, 674, 682, 683: n = A,T,C or G
  misc_feature 700, 701, 704, 708, 711, 716, 718, 723, 725, 732, 737, 744,745, 750, 751, 756, 758, 759, 761, 769, 772, 776, 781, 784,787, 795, 796, 800, 802, 803, 813, 817, 822, 823, 824, 825,833, 834, 845, 846, 848, 853, 855, 869, 870, 873, 876: n = A,T,C or G
  misc_feature 880, 884, 894, 896, 903, 906, 912, 913, 914, 922, 931, 932,935, 936, 937, 939, 946, 949, 951, 955, 960, 966, 969, 975,981, 982, 985, 987, 988: n = A,T,C or G
tttgnannnnnnagggnttggatcccttgcaggacccatcnntncggccnnattancctncntggtgctttctgtgngctttcnggttcncgnancctcgcttttttgnatgtccngggntgggcctgccccngagggccnacngnnatnnggncncnatttatttnttgnnnanccantatcttgnnccnacagntgcttttacagtctatntnnttcgcgcnnngngcgtatnagccncncttnttaccngggganttnctcnnccncnnnntnttgtttcntntntnttcccccnnttggggggaaganangggnnngcnnncaaaggnntngtnacnacaagnncttgnactcccgtacnnacggggaccgcccccgttgggaagaccttttncnnnnncgcataanaggctncnnctggatcggttactctcctngtcncacttgncgnctcaaaccgtcattgggcntgttggatcacctnctnnaacganccataaananaaacccccgggggnnnnaatacctgctngngnatngtangnntcncagcncntttaacntnccntctgaaggaangattnaagggancgggcaatccttgttnagngggnttnntngccttggggggcaanccaagggccaccttgntntnnttccttcaccgccnntggggccnntttccgaatggccgggnngtngggntcnggatncntcccnangcttggnctagncattaanncccanncccancnngntgcccctnttntaancatantcnccnttcttganngggnanntttgccttanctangcctnnnnccccgtannagtttcaaacnntnatgangnaaacctcggtagtnnaanctngtgngttnctcttccttngngtgccantcnggggannntccatcangtcgctgtnntcnnnantacttgnaanangggnatggnttcaanttnagggangccaanngtnann

SEQ ID NO: 7768 - DNA, 801 bp, Homo sapiens
  misc_feature 6, 153, 158, 643, 705, 737, 746, 797: n = A,T,C or G
gttgantacaaatacaagctacttgttctttttgcaggatcccatcgattcgaattcggcacgaggtgacttccaagccccccgtcctggcagcgaggagggccctggacgctctttccacaccggtcaagtcaacaagagaaaacagggaancaaanggaacaggcatcatcaaactccagtttggaaatctgtcttcatcaaaatccaaacaggcatccttaattccagcagcaagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaaagccttgtattgcctgcaaaagctgaacatgacttaanaactttcgttcacaagcaggcaccggtcttcgataatgcaagaagtggtccttcaagctttncaaaaggccattctttaactggccacaaccgnaagctttcngggcacctttcaacctttttaaacttggggcacttttccactggggccggnctgg

SEQ ID NO: 7769 - DNA, 1207 bp, Homo sapiens
  misc_feature 6, 8, 10, 12, 99, 101, 134, 135, 136, 137, 144, 148, 151,154, 158, 159, 160, 172, 173, 182, 197, 200, 207, 208, 209,210, 216, 227, 229, 231, 235, 237, 239, 240, 241, 243, 252,263, 281, 289, 331, 333, 335, 342, 351, 353, 363, 366: n = A,T,C or G
  misc_feature 374, 378, 380, 405, 420, 434, 435, 447, 486, 487, 496, 512,523, 547, 562, 578, 583, 590, 594, 601, 606, 612, 643, 659,667, 672, 679, 691, 697, 704, 714, 715, 771, 777, 786, 796,799, 803, 814, 819, 824, 829, 866, 880, 894, 898, 902: n = A,T,C or G
  misc_feature 905, 908, 913, 929, 935, 948, 986, 1012, 1039, 1056, 1068,1091, 1096, 1103, 1131, 1136, 1157, 1176, 1188, 1193, 1195: n = A,T,C or G
ttgaancntnanctcttgttctttttgcaggaccctcgattcgaattcggcacgagtcaggctgggaggggcttcttttttttggtgggggagaaccantnccacatacccagtaggtaataaggtgtcctgcnnnnggtgaangtcngcnagntaannnggggccgtctcnngggcccggngacgaacacgggggnccntttgttnnnngggggnggggggggggngnantttnancnnncnggggggttngggaattttanaaaaaatattacttggtnttttcaanaacacttccagcctttcttggatcctggaagttattaagggntngnaaatttnggattgggnanggggggccantangcccttanggtngnaagaaacaaggaagccttcggcccntttcccttacccaangggggaaggggaannaaaatgggtttngcccaaaaaacccccggtttttttttccccccctttttnnccccaaaanccccttgggggggaanccttaatttanttggaaatttttttcctttttaanccccccccccccaanggggggaaattttaanttggnaatttangganaaaaaanttaanttgggnaaaaggcccccccaaccccccaaaaaggttncctttaaagaaaaccnttttgggnaattngggggtngggttttttccnaaaagngaaaaantttaaaaaannttcaaattttaccccttgggaaattttgggccccctttccccccctttaaaggttncccccntttggggtncccccaaagnccntttnaaacccttccnaaagnccttngggtnttttaaattaaaaaattttgggaaaaagggggggaanttttccaaaacccnaaaaaaaattttanttcnttcnttnaancccanttccaaggggtggccnttaagnaaccaattggggnttaaggaaaatccttccaccccattgggtttttaaatnggacttgggttaagaataagccttantttaaggtgagggtagggaataaaatnaaaatggaatgcctaanaaggccaaccanggtctaagggtttaaagggattnaaggnctggggnaattggaatctcaccatggcttcccttnctttncttggggcctggaccactgangacaatgcggctatacaanaaggccatggcngtcantngccacaaaaaag

SEQ ID NO: 7770 - DNA, 1006 bp, Homo sapiens
  misc_feature 9, 346, 353, 360, 374, 377, 393, 397, 402, 414, 418, 419,428, 430, 432, 434, 435, 439, 441, 442, 444, 450, 454, 457,458, 460, 468, 470, 474, 475, 477, 478, 479, 486, 487, 494,497, 499, 501, 503, 512, 513, 518, 519, 522, 525, 526: n = A,T,C or G
  misc_feature 527, 534, 535, 536, 551, 558, 560, 562, 563, 565, 566, 569,570, 572, 577, 578, 579, 581, 583, 587, 589, 590, 593, 596,597, 598, 599, 609, 611, 613, 614, 616, 619, 620, 621, 626,629, 631, 632, 634, 637, 638, 640, 643, 644, 645, 651: n = A,T,C or G
  misc_feature 653, 655, 656, 657, 658, 659, 660, 664, 667, 668, 670, 671,673, 675, 678, 680, 691, 694, 695, 696, 698, 699, 703, 705,716, 717, 719, 721, 726, 729, 736, 737, 741, 745, 747, 756,760, 762, 763, 767, 768, 770, 789, 797, 810, 811, 813: n = A,T,C or G
  misc_feature 815, 820, 836, 840, 851, 854, 857, 858, 860, 871, 876, 877,881, 882, 895, 910, 914, 917, 922, 925, 952, 961, 974, 979,997, 1003: n = A,T,C or G
gtttgactnccgtatacaagctacttgttctttttgcaggatcccatcgattcgattgtgcacctctaacccctcttctagcacccttaattgataccattcaagtgccaataattcttccaaaccagggttgagggacttttgaatttgctgagaaatgaaattctgcatatctttgcttgtcactaatgcctgtctgctctctgcctcaccttcttgtccattggtatatgtttggcactctgagagtatcagcatcaattcattcatatctccaatactctttcattaagtctcaggttgcttgccagcacagacaaggtactgcccaaagaagttctttggnaaacagncaagatntttactataccacnaanaaccttaacattcttntttntgaancttattaacaantttnnaaaatttananancnntttntnntnttcttncccnagnngncctttttntntatnntnnntttttcnnttttatnttntntntncatcttccnnttttnntcntannntatctannnttcattctcctttcnccttttntntnntnnttnntnatctnnntncnattncnnttntannnntctctttacnantnntnttnnncctcntcntnnantanncnccnnntatctncnannnnnncccnttnntnntntnttntnttctctctatnacnnnannatcntnctcttctcccnntngntacanttnccccctnnaccncctntntcttttacncccnannaaannanaaacctctaccttgcgggngggatggnccactatccctcnngngnttttnttttaataaccaacancctnttttggtcccnctnttnnanaaagggggacncaagnnaatnncctttccaaaaancctcaaatttggggnaatnggnctttntcncatttcctttttttaaaaaaaaaccanaaaaacccnttttggggtctcnttttntgtaaaaaaaacccccanccccangcc

SEQ ID NO: 7771 - DNA, 1078 bp, Homo sapiens
  misc_feature 2, 3, 4, 5, 6, 7, 9, 10, 11, 12, 14, 15, 16, 17, 18, 19,20, 22, 23, 24, 28, 29, 30, 31, 33, 34, 35, 36, 37, 38,40, 41, 42, 43, 44, 45, 46, 50, 51, 53, 54, 55, 56, 57,58, 63, 65, 70, 71, 78, 79, 82, 83, 92, 97, 103, 104, 110,113: n = A,T,C or G
  misc_feature 118, 119, 122, 131, 135, 154, 155, 171, 185, 217, 223, 236,244, 246, 266, 274, 276, 279, 282, 286, 290, 301, 302, 310,312, 313, 317, 321, 326, 328, 338, 343, 346, 349, 372, 382,392, 399, 407, 414, 418, 424, 425, 427, 428, 434, 452: n = A,T,C or G
  misc_feature 453, 480, 485, 492, 497, 499, 504, 510, 522, 531, 548, 558,574, 583, 610, 619, 625, 631, 635, 646, 654, 660, 665, 673,681, 690, 711, 736, 739, 747, 751, 760, 773, 775, 778, 786,788, 789, 795, 808, 816, 819, 826, 834, 855, 861, 863: n = A,T,C or G
  misc_feature 872, 878, 889, 901, 914, 917, 923, 929, 936, 937, 938, 944,950, 955, 956, 957, 964, 981, 985, 987, 993, 1007, 1011,1016, 1019, 1025, 1030, 1038, 1039, 1041, 1043, 1050, 1053,1057, 1060, 1074, 1075, 1076, 1077, 1078: n = A,T,C or G
tnnnnnncnnnntnnnnnnntnnnatcnnnntnnnnnnannnnnnncacnnannnnnnagggngnggccnntttgganntgnnaccttttgnactcntgcagnncccagnaancgaanntgngacgaggcncttntcatcaccagcgcgggagnntgctgtgaactttttnaaccgggtgactgncatgcatgaagagcccctgcccacacatttcnccttcntttatggatgccngccagggntnggagcatggctggggaaggngctggccncnccngcntgtncagntactacagtcnnggatcagnannaacntggntgtgntnggagcagcantacanaanaancctggacctgcacactaatgccnctgcacaacnttcttggaanaaaaacnctgcttgngggaagncaanaggacnntnngctctntcttacttttgcagcctnncttgccgggggcacagaatttggcctnttatncatcaangagcnantaggntagtcntggatttcccangacacgggntaacccaggggaaaaanggtttggggnttgggcccatatcccntgggaaagngaatttcttttgctcccctaaagcaanatatatacncggggngttttngggnatatttccaantaagtaanccccantccangttcacgnaaggggcnctttggggntaaaggccaataaaagggggnaccctctaaaccattggtcacttgnggnatgggggncaantccccctangggctttatcttnanggngcccacgnannccttgnaaacaaagggaanggaggggnaangacgcantgaagggntttgaaagttgtccccggaanttggcnanccaggtatngaaccnttgcactaggnagcctatgggcnaaattggccaggnttnttccanacgaanggaggcnnnaaaacntttganccaannnaaatttnttctttgggtgaagaangaanangatgancatgacggccttgnttgnggggncanaagcangaaanaactttanntntncccaaanaancagngcnttgggggcggaaannnnn

SEQ ID NO: 7772 - DNA, 758 bp, Homo sapiens
  misc_feature 7, 8, 10, 71, 115, 692, 694, 726, 734, 735, 757: n = A,T,C or G
gttgatnngntcaagctcttgttctttttgcaggatccctcgattcgaatcggcacgagctgcaaagaaanggaagattttcttttttacaacctagattttagttttagagganggaaatagcttgaaaaactaaattgctttggtgaaatgtcctgtacagaacagtaccttggcattcagcagctgtaattggggaacattaaaacagtaactgacatccagttaaagccacgatcgtcagcaattctccttttttaatttctgatatttaaagtttttttccagtctacaccaggcctctccaaggagacagttcattatttaggagtgaatgtgttcctcttgcaatattatcagtacctgcatgacttggtaaattcattttataaaaatagtgtttttttttttaatttcagttcattgactctataactgcagaaattagataatgttttataaaataaatttgccacataatatgggatgcaataaccaacaaagctgctaagtgccaaactgttattttactatatataaatattaaaatattgtgttgaagtatagggatgtatttaattttactatgctcccaacattaatcatggactcttttgtaaattacagttatttcagtattgtaaaataaatgttggactcatttcaaaaaaaaaaaaaaaaaaaaaaaaccncngcctctaaaaacttttgggagtcgtttttacntagaatcnnacatggataagaaacatttggng

SEQ ID NO: 7773 - DNA, 779 bp, Homo sapiens
  misc_feature 23, 150, 161, 162, 185, 210, 234, 248, 344, 510, 530, 600,628, 658, 675, 683, 713, 714, 727, 754, 770, 779: n = A,T,C or G
ttaccgcttttgttctttttgcngatccctctttcgattagggctgctgtgatattgtcagcttgcattaacaattagaagatagagaacccgccatcagggtgtctacctaacttctcagggactacacttggtagttttccccctttnaagaactggtnnattgaaacatttgtggggttccngaattgcctttacagggtttttttncttttactggtttgctctggggtnttataatatattgnttgactggctggtattatcgaactagtagcaataattatatgtaaaaatggccaagcatataaggtaaacttatataagtaccctaccttatctgnatttcaatttttttaaactgcttttccaaatatgagactatgttaaagacactaaaaaaaaaaaaaaaaaactcgagcctctagaactataggagtcgtattacgtagatccagacatgataagatacattgatgagtttggacaaaccacaactagaatgcaggngaaaaaaatgctttatttgnggaaatttgggatgctattgctttatttggaacccattataagcctgcaataaacaaggtttaccaccancaattgcctttcatttttatggtttcanggttcaaggggggaaggtggttgggaaggntttttttaaatttcggngggccggngggggcccaatggcatttggggccccgggnnccccaaccttttnggttccccttttaaggggagggggttnaattggcgcccccttngggggtaan

SEQ ID NO: 7774 - DNA, 1079 bp, Homo sapiens
  misc_feature 2, 3, 4, 5, 6, 7, 8, 9, 10, 12, 13, 14, 16, 18, 19, 20, 21,22, 23, 24, 25, 26, 28, 31, 32, 33, 35, 36, 37, 38, 39,40, 41, 42, 43, 44, 46, 47, 49, 50, 51, 52, 53, 54, 55,56, 57, 58, 60, 61, 62, 64, 65, 68, 69, 70, 74, 76, 77,78: n = A,T,C or G
  misc_feature 81, 82, 84, 86, 87, 88, 89, 91, 94, 95, 96, 97, 98, 99, 100,102, 103, 108, 110, 111, 114, 115, 116, 121, 123, 124, 125,126, 130, 131, 132, 133, 141, 155, 156, 157, 158, 159, 160,161, 162, 164, 167, 170, 174, 180, 193, 200, 204: n = A,T,C or G
  misc_feature 224, 229, 233, 238, 242, 243, 248, 284, 286, 288, 291, 309,313, 321, 325, 329, 336, 359, 377, 387, 392, 400, 403, 405,414, 417, 418, 428, 431, 438, 443, 446, 452, 458, 464, 473,476, 484, 486, 489, 490, 495, 496, 504, 508, 518, 519: n = A,T,C or G
  misc_feature 535, 537, 539, 540, 544, 552, 596, 603, 611, 619, 643, 653,655, 657, 682, 683, 688, 691, 710, 726, 729, 749, 755, 764,773, 774, 795, 797, 801, 804, 806, 810, 812, 821, 832, 839,850, 861, 862, 871, 904, 906, 907, 910, 915, 925, 926: n = A,T,C or G
  misc_feature 930, 941, 948, 949, 961, 964, 965, 968, 970, 981, 983, 992,1000, 1003, 1006, 1009, 1012, 1017, 1018, 1025, 1027, 1032,1033, 1060, 1061, 1063, 1064, 1076, 1077, 1078, 1079: n = A,T,C or G
gnnnnnnnnnannnanannnnnnnnngnaannnannnnnnnnnngnnannnnnnnnnnannngnnaannnaaanannncgnngncnnnnantannnnnnncnncccgngnnaannnaaggngnnnncccnnnntttttttngggaaaaacccctnnnnnnnngnccnatntttntcgggngaacagcctcctntgggcangggnaaaccccccataccgttggngtaanaaanaaacncccnncgggnccaaccggcaaagggccaaccaaccaaccaaccggncnanccnaccatgttaccccgcaanattntggtaacnaggnaacntcaaacnatttactaccaccaggaaccatnggatgggaacaaacctanaaaaagcctnggggnacttcttnccncntcctgtatnggnnggaattattngtnggggggngtcanaanaaaaangtgctnggggcncaagaggcnagnggtttganangtnntaccnnccagaatnggantgggaaatgnnggccccctccaaaaanananncagngcatggcnagagacagccattaatgcacgagaatactacctaggagctctgnctcacangaagcggnggggctgnaaacagcccttgcaggaggcttgncctgcacgcnantngatcggccttgacattggtcaacanngcccnccncttgtggttcccaggcctnccaacatcttctcaangcnctcataaggcactatgtgangagctntgagagganatacaattnncttaggggcgggagcccttananccanaantnccangngatggtaancccccatttangtaatgncctctatgtgnagccccaggcnntggggatgnaaaaaaaccatctaccagggggccaacccactngnntcntaaanccaaaccccnncttngggaaaataangggaaannccttccggttanccnnggnantaggtgaaaananacccaaccnggggcctncanggnacncgncaacnnaaggggngnggaanngaaaacacgggcgaacgggggggtcgnngnngggccccatccnnnn

SEQ ID NO: 7775 - DNA, 1035 bp, Homo sapiens
  misc_feature 3, 7, 8, 12, 13, 14, 15, 16, 17, 18, 19, 20, 21, 22, 28,54, 77, 82, 84, 95, 104, 106, 117, 144, 155, 192, 263, 285,322, 327, 332, 351, 359, 380, 385, 393, 403, 412, 419, 429,435, 441, 444, 447, 449, 451, 456, 459, 471, 473, 491: n = A,T,C or G
  misc_feature 740, 742, 745, 746, 747, 748, 750, 752, 753, 754, 755, 756,757, 758, 759, 760, 761, 762, 763, 764, 765, 766, 767, 768,769, 770, 771, 772, 773, 774, 775, 776, 777, 778, 779, 780,784, 788, 797, 801, 803, 811, 815, 826, 830, 841, 844: n = A,T,C or G
  misc_feature 860, 861, 869, 890, 908, 917, 932, 940, 949, 961, 962, 981,990, 1000, 1004, 1009, 1016, 1023, 1035: n = A,T,C or G
ttntttnncccnnnnnnnnnnnacgganccctttaaccctttttggggtttttnccttttttttttttgggcccaanggggnantaccccccccntttcccggnantttttcccggnaaaatttttcccggggcccaacccggnaagtttaaaanggggggggaatttttttgggttggggggcccatttancccccatttccaaaaaggccccccaaaaccccccattttatttacccacccatttttattgggggaaaaanggttttccaccaaaagggaaanggaaaagaaggaaggaaaaagggggaaattggggggncccgnaaaangtttttactttaaaatttnggttgggncccccccaaacttttcccccnatatnggggaaangaaaatgggnctttcccgnttttccnggaagatttnaggggncccccnttnggntnanctttnacnccccccccgacncntttttttaaaattgtccnctctcaaagacagtagagaattttgaaacaagaaaaaagtgcttgcgtgtctagggaccacatcagactatcacatattctcacagaaacctgtaggcagaagggagtggagggatatatcaaaggccaattaactgatctttgcaagattgcaggaatcacacagaaaaaggtagtcttcaataactgtgttggaaaaactggatatcacatgcaaaagaatgatatgggacccttatcttatccatncncannnnanannnnnnnnnnnnnnnnnnnnnnnnnnnnncccncctnttaaaactntagngnggtccgtntttncgttagatccngccntgataagaatnccnttggatggagtttggnnccaacccncaccttaggaatgcccgtggnaaaaaaaatggccttttnttttggggnaaaattttggggaangccttttnggcttttantttggtaaaccnnttttttaagctggccaatnaaacaaggntttaacccanccanccaanttggccntttccantttttattggtn

SEQ ID NO: 7776 - DNA, 781 bp, Homo sapiens
  misc_feature 3, 10, 12, 59, 118, 621, 635, 700, 706, 714, 728, 746, 767,781: n = A,T,C or G
agnttgactncntatacaagctacttgttctttttgcaggatccctcgattcgaattcngcacgagggacattatatgtctggaattttcacagtaccctttaattaaagagatatcnttaattaaagtagctctggtgaacagcaaggaagtgggatgaggaaacagaaattggcagagtccatgatttggtccagattaaactgccatgagtgactgtaacaaaaattcagaacttatgtaactcaaataggtatatttgagaaataggtcggcacaggtcaagatgtgaaagcccaataaagctaggcagagacttggtaagataaaaaaaaagtgcctcaaaatgttcagtgacagtagtgccctgatacaggcagtacttaaggaaaaatcagtatttaagggaagagctgtaaagggtctccaggagtgggcaaagtatgtttttaattaaacattttattttgagatgattgtatattgatctgcagttgtaaagaaataatagagttccagtgtcccctttcctgttttcttccaatggtagcattgtgcaaaactatggccaatatcacaccaggacattaatgttgatgtagtcaatatgtagaacatttncattcccccaaggntcccccagtgctgctcttttttattccacaggtcaccttaccccaccctcatttctttaaccctnttggcnacccattnaatctggcctcccntttcttaccaattttggnattgggaaataatgggtattntcaattgggaatcn

SEQ ID NO: 7777 - DNA, 756 bp, Homo sapiens
  misc_feature 3, 6, 13, 19, 688, 702, 721, 726, 754: n = A,T,C or G
agnttnactacanatacanctacttgttctttttgcaggatcccatcgattcgaattccgcccgagaagaatgggggtaatctggatggtatagtttttagggggtgaaatttagctgtttaaatcataggctgttgacatttgtgattacttcattgctaagttttacatataagagtcttcatactttgtttcagggacagaatgatgctgctgaaattggaacaagaaattttagatttcattggtaataatgagtaagtcctgacattcaacaagaaaagaaattgtcatcaccattctccttgacttactaagttggtttttcttgtgcttctaggtctccacgtaaaaaattccccccaatgacatcttaccataggatgctattacacagagtagccgcttactttggattagaccacaatgttgatcagagtgggaagtctgtcatagtaaacaaaactagcaatacaagaatgtaagtgtcaagagatgtaactacatattatatatctaaataataatactttatctttctatattacctttcatctgagggtttcccatgttttaacagtctaattaaagttttatgataaccttatgtgataggactgaaaaacacatttagtttactgggaaccaaaatgcaacagcctggactcaaatttggcatatgaatgangactggggcatatngtaaaaaaaataaaaaatnccgangacatagtatcagtggtggtttggacancc

SEQ ID NO: 7778 - DNA, 841 bp, Homo sapiens
  misc_feature 7, 8, 9, 10, 54, 59, 63, 65, 69, 79, 80, 81, 92, 97, 100,102, 107, 109, 115, 117, 120, 126, 131, 132, 142, 155, 158,169, 181, 187, 188, 191, 194, 197, 199, 212, 225, 227, 250,254, 258, 262, 265, 276, 285, 304, 311, 330, 352, 353: n = A,T,C or G
  misc_feature 359, 361, 370, 378, 384, 408, 416, 419, 423, 436, 442, 446,448, 451, 462, 471, 476, 501, 509, 515, 524, 527, 543, 556,560, 561, 570, 575, 579, 587, 591, 595, 600, 601, 604, 606,623, 639, 648, 651, 676, 681, 684, 696, 720, 725, 735: n = A,T,C or G
  misc_feature 740, 750, 752, 755, 757, 758, 760, 767, 776, 786, 792, 800,803, 804, 807, 815, 820, 831, 840, 841: n = A,T,C or G
ttctatnnnnctacttgttctttttgcaggatcccatcgattcgaattcggcangaggnactntncatnaccaggcgcnnnagttggctgcnaactngcngnaccgngngtttgncntcnatgaantgccnncgcccagatncttcaccttcctnatngatgcctgccnaggactggaacntgctcnnaangtnctngnctacccctgcgtntacagtttttacngncatgacccaaagtacattgatgnggtngagnactnganagagaacctgnactgcacancaatgccctgcagatcctnctggagnaaaccctgctgcggtgcanagacctgctctcctgcctgcgnntcctgnangccgactgncttacacnggcttngatctggtcctggggatacaaganagctgctngcnatcnttgctttattatncccaanattncnggntttggttttcncagtccatnaaatntatgcctgggaggctaaatgacccnacatgctntggcanttagccccnggncttcctcagggccatnagctgaagaaggnaggnnggaataccnttacngatnatgtgccncgantggntagcnntgntnatttttgattgaaggancttggaccaatttacngctttttcnttncggatgaaggatttgaaaaactttngtacnaanaataacttttcntttttttgccgaatgaagggaaanaatgnttcaaattanttaanggccttatantntgnanngngggcttnttgccccgnaacatccctntaaacnaggccccnaannttntcgggggntttanggggggttggnaacctgccnn

SEQ ID NO: 7779 - DNA, 739 bp, Homo sapiens
  misc_feature 3, 71, 685, 688, 704, 719: n = A,T,C or G
gtnacacaataaagctcttgtcttttgaggatccatcgatcgaattcgcacaagaactgtccccgttattntgtccatacagcaccagccccaatgggccctgaccacctccttccccagcagaaacgccccttcgtgggtgttgaaaatactttctattctgggtcaagcaccaagaatgcctttttcccttctgcaggtcctccagtgattccccttaagaatgcccctttcaaagccacccccccatcgcagcggcacagctccctctagagttccttcacactcacatcctctcccgcctcaggtagaaatatccgcctgcttagctccaggctcccatgacatactcccgtacctcctctcaccccaccctcatcgcggtcagcccgtcttcattacttctgccacagaacagtgtcccgcagtgaggcggtgaagccttccttcccagaatgtgcctcatcctcttcctatggcgtgaacaactgttgccctgacctgcagcttctcacccagctctcaggctatcgtcctggactccctagggaagaccctggacttcactagggtgtgacttcttttctcgtaggcattccttctgcgttgaacgcatattcactattctagctgaagggtataatatacagccacgaagggggtcgatacacacagtgtctcctgngcngggtctcacagtctanttgatcagacaccantcgacaaagatcacggggtt

SEQ ID NO: 7780 - DNA, 1201 bp, Homo sapiens
  misc_feature 3, 20, 28, 30, 34, 38, 46, 56, 58, 100, 119, 133, 135, 145,146, 153, 156, 167, 170, 191, 194, 195, 196, 199, 200, 207,219, 223, 254, 281, 295, 320, 335, 339, 342, 355, 360, 368,378, 395, 398, 424, 428, 430, 438, 445, 447, 474, 482: n = A,T,C or G
  misc_feature 505, 508, 513, 518, 520, 523, 535, 547, 549, 561, 565, 570,579, 584, 611, 616, 623, 627, 634, 636, 642, 651, 669, 678,685, 697, 713, 722, 730, 735, 750, 764, 772, 782, 788, 804,808, 813, 838, 850, 862, 891, 917, 932, 937, 951, 959: n = A,T,C or G
  misc_feature 965, 970, 978, 1000, 1006, 1023, 1041, 1043, 1073, 1113,1147, 1158, 1173, 1176, 1183: n = A,T,C or G
ttnctcccgctttggtctcntcatcgcngnaatnccgnctgtcttngggcccggcngntgctcccgcgcccttgttatctgggtctcctgaatcttctgnttttggccccagtttaaangattcatccccggncngggggttttnnttttttnccnttggggggggnttncccccttccccggggggtggnttnnnggnnctttccngggccctccccnggcnacccaggaagaatcccccttcctttgggggnggttttttcaaagttaccccaccaatnggggggaagaaatnaaaaagggggggttttttgggaaanccattggaaaaaatngganccnaaaaaaacccaancccangcccaaangggaaaaggnaaaaaaaaaagttcccnttngggtcccccctttttttttttccaantttnancctttaanttccaangnaacccttccaaaaaaattaaaaaaatngggttccntttgggggggcctttcctttttnaanccaanttttnanccnaattttcccaanttttcccttttncnaaaacccccaantttnggggngggggggtnccctngggggccctttttcccccaaccttttnccccntttttcnaccntttttcnancccccnaaaaccaanttggggggcctttccttngggcccccnaaaaaangggggaaaaagncccccccggggggggnaatcccctncttttaanggggncccccattccaaccnttttttaaaaattnggggaaanccttccttcntttaanccaaaaccaatttttnaatnccccnggggggtttggggttttaaaaaagnccccccttcccntttaaccaaaanccaaatttgcctttccctccttccttttnggggttttttttaaataaagggcctncccaattctttcttnccctnggcttttccttttnaaaccttnggaatnaaatnggccaatnacctttgggaatttttttcctnaatttngggttaaattttcaatnaaaaccccaatttttaantnccccccgggattaaaaaatggacctgggtntttatccaaaaccattggttttggtatttagaaaaaaaangggatttttggggaaggccctcttcaatatggtnaaattaaggtnctatttaaaccatanttnaaatggngaaaaaaaaaaaaaaaaa

SEQ ID NO: 7781 - DNA, 752 bp, Homo sapiens
  misc_feature 1, 3, 8, 49, 64, 72, 431, 577, 657, 695, 716, 719, 723, 727,729: n = A,T,C or G
ngnttganttcgatacagctcttttctttttgcaggaccctcgattccnattccggcccgaggncggaatcncattgggatccagccttttcctcttatgaatgggtctaccgccaggtgacgctcaattgcacgaagcttaaccttattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaaggtttggacatcacatttcacagtcagaaggacagcgaactaaagaagaaatggtcaacacaaaagctgttgaccaaggtatcagcaacacaagccttctaaactcaaggatttaaactcaacttaaggntgagctttaaacttccaaaacttcttcctggatgataaattattcttagaaactgatttggactgttaaaggctaaaagtagatgtatttaaagactcttcttgacacattttgcctacacttgctatgtaaatatgtatgcctgncatttttggttcctttggtcctttttacgtttatactctggtcttctgtcatagagcttaaaataaacattcttttttgnacttggaaaaaaaaaaaaaaaaaaaaaactcgagcctnttaaactatagtggggccgtnttncgtngaancngacctggataagatccttggtga

SEQ ID NO: 7782 - DNA, 733 bp, Homo sapiens
  misc_feature 1, 8, 15, 559, 584, 602, 605, 610, 627, 641, 672, 700, 710,720, 731, 733: n = A,T,C or G
ntttgatncgttctnctcttgttctttttgcaggatcccatcgattccgggaaatatcctcaccttaaatccttatctggccgttactcagggatatactaggaattattgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaacttgaggaaattaccataaaatgtctactgaatcaatttttcctgcatttagtcttaatgtcaattctgtcatttcctctttcattaagaaaaatagcagtggccaggcatggtggctcacgcctgtaatcctagcactttgggaggccaaggcaggtggattgcttgacccaagagtttgagactagcctggnccacatgggaaaccctgtctttatnaaaaatataaaaattggncangtgtngtggcaccacctgtggnccacttcttgggangctgagcaggaagatcgcttgagttcaaaanttcagctgcaatgagccgaatcctgccntgcactccancttggacaantgagacttgcncn

SEQ ID NO: 7783 - DNA, 740 bp, Homo sapiens
  misc_feature 5, 13, 599, 649, 706, 724: n = A,T,C or G
agtgnttgatctnctcttgtcttttgcggatccctcgttcgtctattgattacatgagtctactttataaactggtataggctatgtaattagcccgtaagttacttaaaggaccaggggacctaatttttgtcagttttccagtcacattggtgccattcaggactccagctgtttacaggaaatatgtacttagcagaatagtatttttccttgaaaaaaatttgaattcagcctaaatacagaatgaatatgaatagtttgtgaaaagggttagagaacaacaatattcctatagtttctgtattaatgcagtagagacagaggttcctaacgcaaaaagaaaaccacaagtaaagaccgtcaaattagagctttagaatatgacttgaaaaagtagggatgggcaaaacagcataagaaaatattttttcttaatgcagatggacagtgttttcttgttttaaaaatgttttgcctatttgccagcattttttgaagtaatacactgctgctcctggaagatgtctaacttcattttctacaactcttatgtgattttgccattgtcattaagatgcattgattttatttatgangtgtatgactttaaatatctaaatgctgtattaagtgacttgtttcaaanggaattaaatgaagtgaaaaccgtaaaaaaaaaaaaaaaaaaactcgagccctttanaactatagtgaggtcgtnttacgtaaaatccaga

SEQ ID NO: 7784 - DNA, 787 bp, Homo sapiens
  misc_feature 3, 61, 510, 519, 530, 588, 601, 611, 643, 646, 659, 684,694, 713, 721, 732, 739, 748, 753: n = A,T,C or G
gtnattaataaactattgtctttttgcaggatccatcgattcgaattcgggacgaggccangctgtctgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgaaccttctgagtgacagaaagggcctgacccggaaggancggcggganctgcggcgccngaccatcctgctgctctactacttgctgcgctctcctttctacgaccgcttcttcgangccaaggatcctntttcttgttncaattgcttggccgaccaaccttccttggcgnttnggccttggtcacnaagggccgcttcattgggatttacnttggcccaancttggccaaaaaaaaattntaactttnttacaagtttngggggcnttgaacaanaaacnttccccggaaaaaggaaagggttttttgggggaa

SEQ ID NO: 7785 - DNA, 744 bp, Homo sapiens
  misc_feature 6, 14, 619, 621, 624, 626, 743, 744: n = A,T,C or G
agtttnatatagantacaactacttgttctttttgcaggatcccatcgattcgtccagtcgcaacggcccagaccttgaccttgccacttccgggcgtggggtgaaatctcttgattcctagtctctcgatatggcacctccgtcagtctttgccgaggttccgcagcccacctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaacgggtaggaggtgtgcaatctttggggggaacaggtgcacttcgaattggagctgatttcttaacgcgttggtacaatggaacaaacaacaagaacacacctgtctatgtgtcctcaccaacctgggagaatcacaatgctgtgttttccgctgctggttttaaagacattcggtcctatcgctctgggatcananaananaagattggactccaggctttctgaatgatctggaaaatgcttctgagttcttcattggtgtccttcaccctgtgcacacaaccaactgggattgaccaacttcggacaatggaaacnn

SEQ ID NO: 7786 - DNA, 754 bp, Homo sapiens
  misc_feature 1, 679, 683, 701, 706, 725, 742, 754: n = A,T,C or G
ngttatcgttcactcttgtctttgcagatccctcgattcgaattcgccgacagcaactcaggaggctgaggaatgagaatcacttgaacccgggaggtggaggttgcagtgagcccgagatcgccccactgtactccagcctgggtgacagagcaagactctgtctcaaaaaaaaaaaaaatgccactggagagctttgaggagaggatcagtctggctactgggttgggaattaatcatagcaggcaaaggcaaaagaagtgaggttagttaggaggctttacaacaacccagatgagagatgggaggttttagccagggagatggagatgttgagagagtagctggactcaggattgtgacagtggactgaaggaaaagcaggttttgggggaagattgcatttctcccttcaacttcagttacgtagatcacccatatgccacacaactgcaactctgtaacagccaatttttagcttcttccttatctaagccatcctgtaggccataggaattaaaactaggttggatcaaaggaaaagtgaatgctagatccatacaaaactattttggatatttgcctttgtattttattggtttgaaattatttttaatggttcaataaactcttactaagaacttcccaaaaaaaaaaaaaaaaaaaaacctcgagcccnttanaacttttagtgagtcctnttacnttaaatcccaaccttgatnagaatccatttgatgantttttggacaan

SEQ ID NO: 7787 - DNA, 830 bp, Homo sapiens
  misc_feature 5, 8, 9, 11, 96, 102, 107, 109, 111, 120, 122, 125, 127,128, 132, 147, 171, 177, 185, 186, 189, 191, 200, 201, 205,210, 212, 217, 218, 222, 227, 228, 231, 246, 254, 263, 273,276, 277, 280, 288, 289, 296, 300, 308, 310, 316, 319: n = A,T,C or G
  misc_feature 323, 327, 339, 340, 343, 351, 354, 365, 376, 382, 389, 396,427, 429, 432, 433, 434, 440, 446, 449, 467, 470, 473, 482,484, 494, 496, 502, 516, 539, 542, 552, 558, 564, 571, 573,579, 588, 600, 604, 605, 610, 611, 613, 614, 615, 619: n = A,T,C or G
  misc_feature 621, 630, 631, 635, 639, 642, 643, 644, 660, 668, 669, 671,674, 675, 683, 685, 687, 689, 701, 704, 709, 724, 725, 728,729, 736, 739, 742, 744, 749, 754, 768, 770, 775, 784, 791,792, 797, 815, 818, 822, 826, 828, 829, 830: n = A,T,C or G
attcnttnnanctattgttctttttgcagatcccatcgattcgattcggcacgaggctgagagaccccttgctgatgcagctctgatgtccccggntctggnagagnangncttttgtgngntgncnngttncgagtaccagtgacntggtggatttggaactgtatgccnaatggngttatccnnggnangtttgtctnntgtnggtanangcctnnaacncttanntgntgggtggaggaactnttttattnatttgtacntccgaggggncannganccctttanngaggtgntcangccacacncnaaaagntgngccnaganaaccgcgactgnntgnctttgctnctnatctgctgaanaaaaaccaccncttctnattgganttactcngagcttccaggataaagtgacatcggcaganancannntgctgntagatnganacatcagtggaggacttncantgngactttttnancctgtggaancnaaaacnaaagcttattaagntccttggccgaggcctttataanatnttaactttgnctctantgtatnttgggancntccttnaagctttcnagggggggccangatnnaactnntnnnttcntntaaattttnnaaangctngannnccttaatttagatggnaaaaaccnngnaannttggcccnantngnctttgcttccantcnggttngttaaaggctaatgnnccnnctaaagnccntananggttntatancttccctggtaccntntttgnaacccatangcctttnnttatnaaaaaagcttggtattanggnctcnttanannn

SEQ ID NO: 7788 - DNA, 1436 bp, Homo sapiens
  misc_feature 2, 3, 6, 11, 14, 16, 17, 19, 22, 24, 27, 29, 33, 36, 37,38, 42, 45, 48, 49, 51, 52, 53, 54, 55, 56, 58, 59, 60,63, 65, 68, 69, 70, 71, 72, 73, 74, 75, 94, 95, 98, 105,110, 111, 113, 120, 122, 126, 127, 128, 129, 140, 141, 145,147: n = A,T,C or G
  misc_feature 148, 150, 151, 153, 160, 162, 166, 170, 171, 181, 184, 187,191, 194, 197, 199, 200, 203, 206, 207, 210, 216, 217, 221,224, 226, 227, 231, 233, 234, 236, 237, 238, 241, 242, 244,245, 250, 253, 261, 264, 266, 268, 271, 274, 275, 279: n = A,T,C or G
  misc_feature 280, 281, 286, 288, 290, 294, 300, 304, 308, 309, 311, 314,320, 332, 333, 340, 342, 350, 352, 353, 355, 356, 367, 369,373, 380, 383, 384, 389, 393, 394, 409, 411, 416, 417, 418,419, 422, 423, 425, 427, 432, 440, 443, 444, 446, 455: n = A,T,C or G
  misc_feature 456, 460, 475, 476, 480, 482, 489, 490, 491, 492, 493, 494,496, 498, 499, 500, 510, 512, 514, 515, 520, 526, 530, 538,540, 551, 561, 573, 576, 593, 597, 598, 613, 615, 617, 620,626, 629, 631, 632, 637, 652, 653, 654, 660, 663, 666: n = A,T,C or G
  misc_feature 670, 671, 673, 682, 691, 692, 695, 696, 703, 710, 712, 729,732, 739, 742, 747, 751, 753, 754, 757, 761, 769, 772, 777,781, 794, 795, 796, 797, 804, 813, 815, 820, 822, 823, 824,828, 830, 831, 839, 840, 848, 851, 853, 855, 859, 865: n = A,T,C or G
  misc_feature 866, 868, 869, 875, 876, 886, 896, 908, 917, 924, 929, 931,932, 948, 950, 954, 960, 965, 969, 970, 971, 974, 976, 978,985, 986, 993, 995, 997, 999, 1006, 1011, 1015, 1022, 1029,1040, 1042, 1044, 1045, 1050, 1059, 1060, 1066, 1067: n = A,T,C or G
gnngantgagnagngnngnaananaananaggnggnnncggngangannannnnnnannnggngncgnnnnnnnnttttgggaaacccttaaannagntcccaangagcnngntgagtanangacnnnngaacacaaganngagngnntnngnagtgaangngggngganngaagtgaaanttnttngggnagnccngnntgnccnnggngagtannggancgntnnggananngnnnaanntnngtaanaanggactaanaangngntgnaannggannncggangngngagnagagantgantaanngnggnggaacnggatgcggagtnnccaacanantattaacngnntnngggcgcgggangngggncagaagnganntggtnctannagagggcgtaatgangnggagnnnntgnnananagcgnggaggggnaannangtgggaatnngagnataggggactggganngggncngacaaannnnnnanannngggcgggcgngnanntgggnggaatntggngtaatgancnaaggtacagangaaaagaccngagtcgtaagcngangtggccgggtgatgtanaacnnatgaggtgggaccangnangtncgatgnggngnncggtnataacagaaggagcnnnatgggncangangatnnangataaagtngggagtatnnttnnagggggngacatantnttgaaggcacgaataanggngtagaangantgtcngcgnannagnatanggagggangcnggggngagncctgaaaggggtnnnngacgagngacgtggcngnagganannntaangnnacggtggnngcgcgagncgngncntganaagaanngnngcgacnngagagtgggnatagtgtagnaggaaagagagnggtagcgtnaacaganacgcngnnggatatgggggcgtcngngtcnagatancgacnatcnnngangnangagtggnnatcagtnantngnaacgatngagancganatagagngggcganactggaggggnanannggggnacgtgaagnntgacgnnggcatnnngctacacgnngcgcgggagaaggtgaaggggangannatgatgacgngnagagangnnaagagantangacagaacnagncagtagnagaagnagagacgtgacantgangtganngcgcantnngaacgcanactaatggacgantncataancnagatngcgtgncgggagnaaagaaggtgcngggaganggaangangaaatgggacgtaataagaagantagaaggggccannggaagagacatgngngngggaggnngnggatanaggncggggggcgngatggccgtngngaagnngnaatnactggggnggnaaananaggacncgcgncncggggaggggaaacaanagnga

SEQ ID NO: 7789 - DNA, 767 bp, Homo sapiens
  misc_feature 2, 7, 20, 86, 672, 678, 703, 728, 751, 767: n = A,T,C or G
tntgaancctttggaactcntgttctttttgcaggatcccatcgattcgaattcggcacgagggtggctcatgcctgtagtcccanttattcaggaggctgaggcatgagaatcgcttgaacctgggagtagaggttgcagtgagctgaaattgcaccactgaactctagcctgggcaacagagtgagacttggtctcaaaaaaaattaaaaataaaaaataaattgggggctgagtgtggtggctcatgccttcaatctcagcctcccaagtagctgggattataagcatgcgccaccacgcctcgctaattttgtacttttagtagaggtggggtttcaccatgttggtcaggctggtttccaactcctgacctcaggtgatccgcctgcctcagcctcccaaagtgccagtattacagacgtgagcccgctgtgcctggccgagtaatttttttttaaaaaaaaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaccattataagctgcaataaacaagttaacaacaacaattgcattcattttatgttcaagttcanggggangtgtgggaggtttttaattcgcggncgcggcgccatgctttgggcccgtnccaacttttgttccttttatganggttaattgccccctn

SEQ ID NO: 7790 - DNA, 779 bp, Homo sapiens
  misc_feature 1, 2, 3, 4, 8, 9, 10, 16, 711, 730, 753: n = A,T,C or G
nnnntttnnnatcctntacaactacttgttctttttgcaggatcccatcgattcgggagaattcccttattgctcacttctctgagcttcaaggttctgaagcatccagataagaagttccgggttggccaggccctgagggccaccgttgttggcccagattcctccaagaccctcttatgtctgtccctcacaggtcctcacaagcttgaggaaggggaatggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccaacacagcccgtccaagaaagccctttataacaaacacctccttgaagggaactgctcacagccagggtcctacgccttaccaccagaagaacctggtagaactggctttncttcccggagacactgggnaagccagacgtgctttctgcttncttgggaagggcaacttacaaagcaa

SEQ ID NO: 7791 - DNA, 691 bp, Homo sapiens
  misc_feature 3, 6, 23, 71, 108, 426, 528, 654, 662, 689: n = A,T,C or G
ctnatngatcactcttgtctttnagatccatcatcgaatcgcacagatgacatgaaatggtggccacaccntgtgctgctatcaagtgatggctgccagatctgggcngcccagacctatggatggctgcctcaggtgcagcatcactgcctggtttgatctgcctgtaaatcatccttagctgattgctgaacttgcattgtgattgcctgtagagttgctgagaggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatgggatcacaagatggaatttagcaaaccctanccttgcttggtaaaattttttttttttttttaaaaatatctgtaatgggtactgactttgcttgctttgaagtagctctttttttttttttgcagtaactgntttttaagtctctcgtagtggtaaagtatagtgaatctgctacacaatttctaattttaaaaattgagtatggtgtagaacactaataatcataatcactctaattaatggaatctgaataaaggnacaattgngtaccttttgtataaaataacaaatanaa

SEQ ID NO: 7792 - DNA, 774 bp, Homo sapiens
  misc_feature 2, 91, 92, 153, 192, 198, 202, 208, 214, 225, 237, 616, 624,734, 751, 766, 773: n = A,T,C or G
cnctttacaaactcttgttctttttgcaggatcccttcgattcgaatttcggcacgagctgcattgtccactggacgttttagtcatattnngacaccagttgtttcctccactcccagacttaccacatctgagagaaactggcttgtgggngtcctccctggtccttatagaatggcccccgtgcttccnagtgtnctgnagctgnccgtcngatctctaacntacttcagtgcnggaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtccaatgaatatgtnaacatacnagtgacaacattaaacttagaaaagttttaaaacttaaaaaaaaaaaaaaaaaactcggcctctagactatagtgagtcgtattacgtagatccagacatgataagaatncattgatgagtttgggncaaaccacacctagnaatgcang

SEQ ID NO: 7793 - DNA, 1199 bp, Homo sapiens
  misc_feature 16, 17, 21, 27, 32, 34, 35, 36, 37, 38, 39, 48, 49, 53, 56,57, 61, 62, 63, 66, 67, 69, 72, 79, 80, 81, 82, 83, 84,86, 87, 91, 100, 101, 105, 114, 115, 118, 122, 129, 130,135, 147, 152, 153, 157, 158, 161, 162, 165, 170, 180, 190: n = A,T,C or G
  misc_feature 196, 201, 207, 221, 222, 223, 228, 232, 234, 237, 238, 256,262, 265, 269, 282, 286, 288, 289, 291, 293, 294, 296, 307,311, 314, 316, 324, 335, 337, 338, 344, 345, 349, 355, 363,365, 369, 372, 375, 378, 384, 388, 390, 394, 395, 405: n = A,T,C or G
  misc_feature 406, 409, 411, 423, 424, 428, 429, 436, 448, 457, 458, 462,463, 465, 467, 476, 480, 482, 486, 498, 502, 511, 512, 513,521, 523, 527, 528, 531, 540, 543, 548, 551, 554, 555, 564,570, 573, 574, 596, 599, 609, 613, 615, 616, 627, 636: n = A,T,C or G
  misc_feature 652, 653, 658, 661, 671, 677, 682, 687, 689, 693, 696, 700,707, 708, 718, 720, 725, 727, 728, 736, 740, 748, 754, 756,766, 774, 775, 778, 782, 793, 798, 807, 814, 821, 831, 837,854, 859, 863, 867, 868, 869, 872, 884, 885, 889, 897: n = A,T,C or G
  misc_feature 899, 907, 913, 916, 923, 924, 929, 932, 936, 949, 962, 963,965, 967, 974, 978, 983, 984, 986, 997, 1001, 1002, 1008,1010, 1016, 1029, 1032, 1034, 1035, 1049, 1053, 1062, 1065,1068, 1069, 1071, 1075, 1080, 1083, 1084, 1096, 1105: n = A,T,C or G
  misc_feature 1111, 1116, 1119, 1122, 1129, 1138, 1140, 1141, 1146, 1155,1162, 1171, 1173, 1174, 1175, 1181, 1186, 1188, 1198, 1199: n = A,T,C or G
tttttttagagagggnntttnttttgnttccntnnnnnnagagggggnnaatngtnnaagnnncgnnangtntgcgggnnnnnntnnctangtaccccgnnttcnccttatttnnttntganctgcgtnntttancttactttagtnaattnnttgnnggnngcnctttngtttttgggnatatttttgnaatatngcttntttttnatatctggtacgannntttgntttntntanntaattttttgctgttgantgtagnagnttcnctgtgtatatctnttcngnntnanncnttgcttcggcnttangtngnatttggtngtttgcatgtntnnagatanntatntttctngtcagggnanttgntgntgntgnttctgntctntntctnntgggggtttnnatntnagtcttgtattnntatnnctacacnttgggtgtatgnacatatatnnatgnntnanggtggtatnttantngatntcgtctctcggngtgnatatatagnnnagtgggtngncganntgngaaacgtanggntagcntangtnntcttttatncgtggnaanngtgttattgtttggcttactcnatntgtcctagangtgngnncatatggcccnatagtgggnagacctcaattcttanntactnggngataagtatngaatanggtgnggtanantgtnggnacantttgtgnntattttcaantnggtgngnnggtgtaangccncctttganttgtantnttcaatgcgngtgtatannctnggtncttctgatatnggggnattgggtanagctccnctgctgntgtgtatatngatggnggggggtcaccgtaatnttatngctntgtnnngcnccatgatggagnntggngtaattgnancgattttnttttgnatnttggatnngttgnganctcntggggtaggcacnttcatggctgcanntncnggggtanggangtgcnnangctctggggtntggnncgtgancncctagngtgggtaattggntcntnntttgattaccattnaatnaatagcatnggnttnngntatnattantgnnagaatggtgttnccttgatcntatatnttaantcnttnatttatnttgattgtntnnggganttatgcttntggtggnattgtcttntnnnagactnatatntntattgtattnn

SEQ ID NO: 7794 - DNA, 783 bp, Homo sapiens
  misc_feature 3, 7, 17, 46, 105, 112, 127, 130, 137, 150, 184, 212, 216,538, 622, 637, 712, 758, 765: n = A,T,C or G
agntttnaaaatatcanatacaagctacttgttctttttgccaggnatcccattccgattcgaatttcggcaccgaaggaaacccgcccactttctttgggatcnttggganggtgggtggttaaanggnaacctcnaagtttttcaaanctttccaaattgctcacagcttgatcctaagggnttgaagccatcccttgtcaatatatttnggtnggtatcggtcaactggtgccatcattgccaatggggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccgtaaaaagggatggttcatcattgtgaaagaaatggttatctcattggggaagaaaaggggagggggaangcaagaatcacttgaaaaatcttaaatctgtgttttctggaataaagatatctagacagcctaaatctgattttggtctttatnaaaataatatcttgnggtctcatacttttctgtcactgtaagcctgccaataggcagtgttttgcaaacttttggggagtggtctatgtngcccaatatttgtgtgtatagacagaatttgaaatcaatctgttcnttacaanaatttggtgggcattaat

SEQ ID NO: 7795 - DNA, 792 bp, Homo sapiens
  misc_feature 2, 4, 5, 10, 85, 112, 139, 152, 182, 218, 234, 263, 267,297, 331, 394, 406, 407, 430, 463, 501, 532, 543, 544, 565,582, 588, 639, 676, 705, 712, 721, 757, 765, 771, 779, 781,783, 789: n = A,T,C or G
tnannccttnaactcttgtctttttgcaggatcccatcgattcgaattcggcacgaggcactttccatcaccaggcgcgggagtntgctgtgaacttgcggaaccgggtgtntgccatccatgaagtgcccccgcccanatccttcaccttnctcaatgatgcctgccatggactggagcangctctgaaggtgctggcctacgcctgcgtgtacagnttctacagccaggacncagagtacatggatgtggtggagcagcanacanagaacctggagctgcacaccaatgccctgnagatcctcctggaggaaaccctgctgcggtgcanagacctggcctcctccctgcgcctctgcgggccgactgccttagcacgggcatggagctgctncggcggatccannagaggctgcttgccatcctgaancattctgcccaggatttccgggttggtcttcanagtccatcagtagaggcctgggaggcaaaaggacccancatgcctggcagtcagccccagccttctcanggccagaggcnnaataggaggaggaagacgatnacgatgatgtgcccgantggcancaggatgagtttgatgaggaactggacaatgacagcttcttctacgatgantctgaaaacctgtaccaaaaaactttcttcttttggnggatgaaggaaaaaaggatgaaaaatganggccttntgacttganggggcaacatgcaaggaaaacaacctaaaagcaagnccccaaanttcacnggggcttnangngggcgngaa

SEQ ID NO: 7796 - DNA, 769 bp, Homo sapiens
  misc_feature 3, 58, 72, 82, 140, 170, 208, 229, 322, 383, 449, 569, 600,647, 653, 657, 682, 723, 735: n = A,T,C or G
agntttacttcgatactcctacttgttctttttgcaggatcccatcgattcgatttcngcacgagacatggngagttatgcntatctgaaattgaaagaaggcttgtttttaaagaggcttggagcaaactgcagcagtnctttccaaaggctcctgagtttccaagttncaaagagtggctggttcacagtgcaggattttagaaangagaaggggaagaaaatgaanccttacataagatgattgcaaacgaaccaaaagacttctctcccaaatttgttccaggataaaaacagaccgtgtctcagtaactggccagangatacggatgtcctctacatcgtgtctcagttcttttgtagaagagtggcgggaaatttgntagaaagcctacaagatgcagccctgtgtcatcagttggggaacagtgctcttttgtgtccccacnggggcctcatgtttacatttgcttccatgaccaaagaagattctaaactttatagctctcatatggcccaatgagtgggcaaatgatacaaaaagctctttggtgtggatcatgtaattnaaaatcacgagaattggaagtgggagatgtnaacccttcagaaacacagtatatttcttgagccccaactctgtccanaatgcnaaanaaggcttattgtgtcagcagcaganggacctgcttgaatcactcaagcccccatctattgtccatnaagttgtggatnattaaaaaggtgatgaaaggattccgcttccgaa

SEQ ID NO: 7797 - DNA, 762 bp, Homo sapiens
  misc_feature 1, 9, 12, 21, 25, 33, 110, 112, 460, 462, 463, 475, 477,478, 479, 481, 483, 484, 485, 488, 489, 491, 492, 493, 494,497, 498, 499, 502, 503, 514, 526, 552, 555, 599, 601, 697,720, 727, 730, 737, 755: n = A,T,C or G
ngttgactncgnatactcacncttngttgtttntgcaggatcccatcgattcgaattcggcacgaggttcagtgctccccgggattactctggctattcaacgggatggntntcagcagaattcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagttctagttttcaagacagtttataataaactcttaagagaacattntnnaaaaaaaaaaanannnanannnaannannnnaannnaanncctcgaccctntaaaactatagngagtccgttttccgtagatccagacntgntaagatacattgatgagtttggacaaacccccaactagaatgcngnggaaaaaaatgctttttttgggaaatttgggaagctattgctttatttggaccctttttaagctggcaataaacaagttaacaacaccaattgccnttcattttatgttttcaggttcngggggangtntgggaanggttttttaattcccggnccggggc

SEQ ID NO: 7798 - DNA, 729 bp, Homo sapiens
  misc_feature 1, 4, 7, 25, 82, 84, 107, 587, 615, 627, 634, 717, 725: n = A,T,C or G
nttnatncgttctccgcttgctgcntggcggaccctcgattcgaatcgcccagataagaaatgtcttgcctaagattaaatntntatggatatttttcctaagaaangttttagaaaagactgatgagtgtatttctatgtaattggaatatatttaagttcatgccatgtgtcttgtggtttccttattaccaaaacggtgactgaagaaacgcttgctttagaaatacattgaattggccaggtgtgctggctcacacctgaaatcacaacacattgggaggccaaggcagaaggatcacttgagcccaggagttcgagcctgggcaacatagtgagaccctgtctctacaaaaaattaaaaaattagttggccatggtagtgggcgcctgtagtcccagctgcttggctaaggtgagaggtttgcttgagcctgggaggttgaggctgcggtgagctatgatagcaccattgtattccacctgagtaacagagaaagaccctgtctcagaaaaaaaaaatacattgaattggttcctgatgggaaagtaaatactctcatgcccagttaggagtgagtcagggnttttaatatgccactttttctttctcangcaactcatgcngcaattncagaaccccgactttccaccgagtagaggacaggatgccacacctgcctgtgtcttgtgcctgggagagtgggatgaaacccncagacaanctgt

SEQ ID NO: 7799 - DNA, 745 bp, Homo sapiens
  misc_feature 2, 4, 5, 6, 7, 9, 11, 12, 22, 24, 27, 28, 29, 35, 37, 39,40, 41, 42, 45, 47, 49, 51, 66, 67, 69, 70, 71, 78, 87,89, 104, 118, 130, 132, 148, 175, 176, 197, 201, 218, 225,228, 234, 240, 241, 258, 287, 300, 301, 305, 306, 311, 312: n = A,T,C or G
  misc_feature 326, 330, 350, 354, 363, 367, 370, 375, 380, 384, 426, 434,441, 444, 462, 463, 467, 483, 484, 490, 496, 499, 506, 510,519, 520, 530, 535, 547, 552, 562, 575, 579, 580, 582, 584,590, 591, 592, 597, 612, 616, 625, 628, 640, 647, 653: n = A,T,C or G
  misc_feature 655, 657, 671, 672, 676, 679, 680, 690, 694, 697, 701, 703,718, 720, 721, 735, 745: n = A,T,C or G
antnnnnantnntaagtggggntntannnttttanancnnnnatnanantnagggggagataaatnnannnccttccngaatgggtncngagctaggaaaaagntccatgctatgtgnagaacgaggtgngngatgcagaagcctggnttaatgggaccaacctagctgggcagnnttttgtggaatgagcagttgnagantgaatatagctttgatnttacttntcnacctgngttgtnnagcacgctacagttgtngagatcaacagtcatgtggtgcacaggtnggatggtaaattnnaganntttgnntatagagggaaagnttcngtggttgagagttacagacntgcnaagggagtnctgnagncaaanacctngtanattgataagccattgcatcattaccaaaaatatggaccgcanggaaagcnataacanaanttggtggaggaactgaannggantacttgaggaaaaggnntggganttgtantanaactgtncacnattcttttnntttaagagcnttaanaagaggatggtntaaancacaatgttnttttaagggaganttgnnanantaaagnnnaaacnggaaagaagtggtanagantcattttgnccnaagaaccggaanacaaaanataaangntngatttggtcttacnnaccnaanntgagtgaganaaantcntggnanaaagaaagaatgatngnngaaaagcaaaaaanacaatggacn

SEQ ID NO: 7800 - DNA, 670 bp, Homo sapiens
  misc_feature 16, 17, 18, 582, 639, 669, 670: n = A,T,C or G
cgactggtcagggttnnnctcaggaagctgagttccagcttgtttccttggcagcactgccaaagagttagaccaagctgcagcttttgaggtgaaaggggatggaagaaagtactgttacttttccacttagaatttttggactttgttcttaatgaataggttcattttcaatttcaaagcaaagtgttaacatttttgaaatttgtctcaattctaaaggccaaacttaaatatgtctcctcctactggggcatggagcaagttattcatcaaatacagattctcgcatggaaaagaaagctaggatagtgtgtcgctgctgctctgtggcaaagaacagctcctttctaagcaacagcctcactctactagaataggtctgagcgcgcccattcatggctgattgcaacttccactgggtgggatttcagatctagaatctgttttcagatgccttaaagagaagacatagaaacacattcttaacagtttcaggggagatagttgggatagtttgtagttttgcttaggttatatgtgtctgttttctgcttttggtgttaacggactaacccttanttttggtggttagagaagtgatggggaagaacataaagaaagctcagatgacattgnctttgctttaaatgtgtagtttttctctcnn

SEQ ID NO: 7801 - DNA, 1228 bp, Homo sapiens
  misc_feature 2, 4, 9, 12, 20, 26, 29, 31, 32, 40, 43, 44, 47, 50, 51,53, 54, 56, 58, 62, 71, 72, 75, 78, 81, 82, 83, 85, 89,90, 93, 97, 101, 108, 115, 121, 128, 130, 136, 138, 142,144, 145, 149, 151, 156, 157, 159, 160, 163, 165, 168, 171,177: n = A,T,C or G
  misc_feature 178, 180, 187, 188, 194, 196, 212, 219, 226, 227, 230, 232,238, 240, 242, 245, 249, 258, 260, 261, 267, 270, 274, 275,277, 284, 287, 288, 292, 296, 298, 301, 306, 309, 312, 314,315, 319, 327, 328, 329, 340, 347, 348, 357, 360, 361: n = A,T,C or G
  misc_feature 362, 364, 365, 374, 376, 382, 385, 387, 388, 389, 390, 393,398, 399, 401, 402, 405, 406, 407, 408, 410, 411, 413, 418,420, 424, 431, 435, 437, 440, 441, 446, 451, 452, 453, 454,455, 457, 462, 464, 467, 474, 480, 481, 485, 488, 489: n = A,T,C or G
  misc_feature 493, 496, 498, 501, 502, 504, 512, 513, 517, 520, 523, 528,535, 540, 542, 549, 550, 552, 555, 556, 565, 568, 571, 572,576, 581, 582, 587, 588, 589, 595, 600, 606, 610, 611, 613,617, 621, 622, 625, 637, 639, 647, 649, 656, 658, 660: n = A,T,C or G
  misc_feature 663, 664, 669, 670, 678, 680, 687, 690, 694, 699, 702, 703,705, 710, 711, 712, 716, 722, 725, 729, 732, 735, 740, 741,742, 750, 764, 768, 771, 775, 777, 780, 783, 785, 786, 793,797, 799, 800, 804, 810, 811, 816, 830, 835, 839, 851: n = A,T,C or G
  misc_feature 858, 864, 868, 869, 871, 873, 875, 881, 888, 894, 895, 900,913, 920, 923, 927, 929, 931, 933, 944, 947, 948, 953, 955,956, 957, 959, 967, 970, 979, 982, 984, 986, 988, 996, 1011,1015, 1024, 1037, 1041, 1049, 1055, 1073, 1076, 1077: n = A,T,C or G
gntngacanttnaataaganggggtnatnanngcatttgnaannccnatnncnnanantagnggggtatcnntantgntgnnnanacgnncgngaanttgntgggagntattctntattanttttccncnttttantnatcntnncctngntggcnntnntantngangantaagtnnantcatccnnctaccncncatggcgttttctctnttcatanttatctnngtntnactttnangntantaantacataatncnnttactnttncaanncntgttttnaannattnctgnantcntgttnagntcncnngtcntaaatgtnnncaatatgctantagattnntcgtataanagnnntnntttttgatntnattatngangnnnntanattanntnntannnntnnangtacnanaatntttagtnattncnacnnttctnataannnnntnattantnaanttaaagntactcnnatcnacnngagntcntnacnntnaacaagtnnctcntgnatnacctnattcttnttctncnattcttnnanatnngtaatcaanacnctnntctntctgnntatannncgaatnaatanatactnatgnncngctntacnntcngtattctcatananggagtatntntactatntntncanngtganntgcacatncntcatgcnctnatangtcanatnnanatatnnntacnacttgnacnattntcnttnacgannntctctctnacacatagtatcantatnganatcncntgntanannataaaantcgntnnattnaggtcnnagaangcaatgttacatgntcacnaatncaatctttctcnatatgtnaatctngttnntnanantcttgntcaatantaactnnatatnaatattctgcgtnttatcgnatnactnancngncatcgattagnggnnactcngnnnangacacganacnatgaatgangtntntntntagtgtantactatattacgtantttntataaagtntaatgtcagacantatngactaaangctgangctctttggattccatanganncacnatanctgagtatattagcnctcatcgcganttctgaaaatgaagntgtatnacgaaatncgattgnaanttctctgatnntggattaaattcatatntaatggacgtntnttanaatancatcantntntaccatgntacagatgcg

SEQ ID NO: 7802 - DNA, 780 bp, Homo sapiens
  misc_feature 13, 137, 605, 616, 674, 698, 712, 717: n = A,T,C or G
gtttgaatatcanatacaagctacttgttctttttgcaggatcccatcgattcgcttttagccaaggtcacctccgaaggtcctgggaccatggtttttggaaagaaaataatatccagttcatggaaatcctggtncctggttctttggccctggaaggggggtaaagtggacatcagcagcatggttcattccttttcttggtcttctacctgttctccacaaaagtataaaaagccagaattgctttttgggttttgagatggcattgtcttccatttgcaaaaaacagtttataagacaaataataaagaaattgaaatgtttctgatggtttcaaaaatgtaaacataagccagagtagttatgtctcaacatcatctcttgccagccggcagctccttttcttccttgatcttctaaatgtacaggggaagacagctggcagcctgtcatgtttcaaaccttcattaaagttctggattttggcctcttcgttttcccctagatgtcattaaagctgtcagcaccattgctgtgcatgagaaagaggagagtctctggcctagggtggccgcttctccacattggcacccggagtcctncatggggcgangctccgcagtctgcaggtccgttgatctggagtcccggaagaccacgtacacctcaanatgtcagtgacagtgaggactgantaaccctgcagggnctaanatgccaaacccttttgccttctgctgtgcttcgggccggcttggggctttggtggacaccccg

SEQ ID NO: 7803 - DNA, 780 bp, Homo sapiens
  misc_feature 11, 507, 596, 636, 687, 701, 713, 715, 745, 749, 765, 780: n = A,T,C or G
gtttaatacanatacaagctacttgttctttttgcaggatcccatcgattcgaggccagtgtgggacagggttgtgtaggtgtgccttttcaaacacatttattattcagaagtgggtgcagataacgcttaagattacaccgaagaatttagggagggtgggggatgaaggtctgttagtaaccagaaacacattagttgggcatcagtaaggggcaacataaaggaatggttcccctcaaaaacgaacaaaccaaattttatacaaaaaaatgaaatgcagcagggcgcgatggctcacgcctataatcccagcactttgggaggacaagacagcggatcatttgaggtcaggagttcgagaccagtctggccaacatggtgaaacctcatctctactaaaaatacaaaaaattaagccaggcatggtggtgggcacctgtaatcccagctacttgggaggctgaggcaggaaaatcgcttgaatctgggaggcggaggttgtantgagcccgagatggtgccactgcgctcaagcctgggcaacataatgagactcttgtctcaaaaaaaaaaaaaaagattccactaacccntgtaagctaaaaggaaggggctcttaaaaagacacagatnttagtgacttaattttaaatacttgggtttacctttaaccaaaaagttcantttccccaaacctntttctgcttcangnaatgaaaaacattggcaaaccccaaaacantggnaatagaaaccctggcnttaaagtcttccccn

SEQ ID NO: 7804 - DNA, 922 bp, Homo sapiens
  misc_feature 2, 4, 5, 11, 12, 27, 33, 40, 46, 72, 84, 98, 124, 130, 138,188, 209, 275, 283, 287, 293, 318, 328, 359, 382, 825, 826,827, 828, 829, 835, 836, 837, 838, 839, 840, 841, 842, 843,844, 845, 846, 847, 848, 849, 850, 851, 852, 853, 854: n = A,T,C or G
  misc_feature 855, 856, 857, 858, 859, 860, 861, 862, 863, 864, 865, 866,867, 868, 869, 870, 871, 872, 873, 874, 875, 876, 877, 878,879, 880, 881, 882, 883, 884, 885, 886, 887, 888, 889, 890,891, 892, 893, 894, 895, 896, 897, 898, 899, 900, 901: n = A,T,C or G
  misc_feature 902, 903, 904, 906, 910, 915, 919, 920, 921, 922: n = A,T,C or G
angnntttttnnaaaaatttatccaanaaaatnaccaaangccttnacttttgggttttctttttttttggncaaagggaaatnccccccaatccggnaatttccggaaaaatttcccggggcnaccggnaaggggtncaaccttttcccggcgggttcaaaaccccaaagcctttccttgggttggncccttgggccccaagttcccnggggggggccccccctttcccccgggttttcccaagccccattggccttttttccgggcccctttnggcccccngggncttggnccaagcggcttggcttctttccggnccggcaagcntttcaagcaaccctcgggccccaagcggttnccatttggcttttgacgtagctnaatctcctttgcagcatccgtgtgaagttgtgcgtgaataaaagaaatcgtatacttcctaattccatagtatggacaaaccgaggctagagaactgggccagggttacagtcatttggccagaggattagaattcagcgcttctgacctgaagacggcttcctcttaacctttttggaggatctctcctgctgtgggcggactgagcctgccgccaggtgtcttaacagtgcttgacttggcccgcgaccacttaagcctaggagcctaggctattttagccatcttctagaatggtggttcttaaactctgcagtgtgtcagaatcaccagaaagctaataaaaaacagacgtctgggttcattgaagaagcttaagactgcgggggggggtccgcatttttaccaagtgaatctaattaaacctaattttgagaaccccnnnnnaaaaannnnnnnnnnnnnnnnnnnnnnnnnnnnnnnnnnnnnnnnnnnnnnnnnnnnnnnnnnnnnnnnnnnnnncntttnaaaantttnnnn

SEQ ID NO: 7805 - DNA, 900 bp, Homo sapiens
  misc_feature 19, 35, 130, 134, 148, 152, 183, 186, 190, 193, 199, 213,218, 222, 228, 234, 239, 284, 303, 316, 318, 327, 330, 341,346, 350, 360, 365, 369, 374, 388, 399, 400, 405, 407, 410,411, 412, 414, 431, 432, 439, 440, 441, 448, 460, 461: n = A,T,C or G
  misc_feature 463, 469, 470, 474, 478, 484, 485, 488, 491, 494, 495, 496,499, 510, 512, 516, 522, 532, 533, 538, 539, 540, 542, 545,548, 553, 560, 562, 563, 564, 575, 579, 582, 584, 596, 598,600, 602, 625, 630, 634, 635, 642, 643, 644, 646, 648: n = A,T,C or G
  misc_feature 649, 651, 652, 655, 656, 666, 672, 677, 700, 709, 712, 715,716, 718, 723, 728, 739, 746, 749, 751, 754, 761, 772, 778,782, 784, 790, 793, 795, 803, 804, 808, 823, 825, 827, 840,843, 853, 859, 862, 865, 866, 869, 883, 888, 892: n = A,T,C or G
ttgaaagactttacaaccncttgctctttttgcangatcccatcgattcggatagcaaaacctgatttttcaaccatgacctgcatgagagaacatcctaagaagtcttagatcatactttcgagttttnaatnttaatttatataantgcntctttatgtcttaatattcttgtgaactggngtntatngtnaatgcntataagcttgtgtnattgntgtnaaatanttttgngattntatttcttgccccatatgtaaatatttagagtctcatttcttgcnaacttatttgaagctgagncgtgggtttgggntntgtttgctnctntggctgcaggntgggntggngggtggcatngggangganggaanggatctatagtccntggacatggtnnatttntntgnnnanaaaaggctacttgtccnnctgcaannnattctcntaacattcacanntntttccnnggtnagancataanntcnttnccnnngantgcctataatnanctcnaccacnttttggcctnnatccnnngngcncanccaangatgtgncnnntggctctaacnactnaantntggactcacttntnanancccttataattccccctgatttnttggncctnntaccatnnntntnnannganntatcttttanaccctntcacngctttcggcgacttcagagcatncttctcctnacntcnncnacccnacttntactttcatgnccacttnctngnaantgaaatntaacttctccnaacgtnctcngnccctcntgnantttgaacnnggcnatcattggctccaantncntccttttactctnttntcctccatantatacnctnggnnaanttcggctggattantccanactntccctccg

SEQ ID NO: 7806 - DNA, 673 bp, Homo sapiens
  misc_feature 3, 22, 23, 638, 668, 673: n = A,T,C or G
tcngcacgaccaagctgattcnncattctgaaagctgagctggaaagaaccaaagaggaaaagcaagagttaaaagagaaactgaaggaaacagagacacacctggaaatgctgcagaaggctcagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagacaatcagcagatattgggtccngtataccaggtattattttggggtaagctnacaan

SEQ ID NO: 7807 - DNA, 667 bp, Homo sapiens
  misc_feature 14, 15, 16, 17, 18, 19, 25, 399, 554, 635: n = A,T,C or G
ccgagaggacagannnnnncccccntggagggaattttggaaagtaaagtgtatgggttagggactactggacatactgggagtacagtttggttaatgagcctgaagtcctggactaagtggtaagttccatctggctttttaacaggtagaattggtgtgtttaaaagggagtttgttgggcggaggaggtgactggcgaggaggcgagaaatgataagctataggcctacaagagctgcttaggggattggatactgcttctgtgataggaactgggtggggattttaagggtaatgcagaagggggtgtggtgttttgcaactgagggtgtggaagtatctcaaaacagcggggttaaccatggatgggggataaggaaaggttgcatgttttanggtgggaggttgcaggagtagaagaaagttagaagccctggaggggtctgggtggatgcgttgggtctaggggaacgtgggagtggagagtggtgtggagttttgaaagcatggctctgcctaagagtggagttgggcatgaggccaggactaanaatgagtgaaaggaagccgggcgcggtgctcaagcctgtaatccccaccctttgggaagcccgagttgggtggatcatgangtcaagagatcgagaccatcctggataccccg

SEQ ID NO: 7808 - DNA, 786 bp, Homo sapiens
  misc_feature 4, 6, 7, 8, 9, 10, 11, 12, 13, 16, 175, 211, 601, 678, 706,710, 757: n = A,T,C or G
ttgnannnnnnnnccnttacaactcttgttctttttgcaggatcccttcgattcgaattcggcacgaggggaaaataacccagttttgatcttttttagtctgggtgcttactggatgtcaaggtagaaagtgtccaacaaggtgctttaactataggttggagttctcaaaaangttaaagagggtagagttatagtgacatcttcagcntatatagtagttgaggccagtggaaaatttcccattgagagctctgagaggaaagtttttagaagccaagggaaaaaggagtattgagaaagcgttagatatcacagaaaaattagattggtgatttctaagacaaggatataaccgttaggatgtcattgacctttgtgggagtaataatggggacagaagtcaggttttgctataggttgagggtgtccaatcttttggcttccctggtctactttggaagaattgtcttgggccacctataaaatacactaacactaaaggtagccggatgcgctaaaaaaaacgaatcacaaaaaaaatctcataatgttataaagaaagtgtacaaatttgggttgggctgcattcaaagccgtnctgccacatgcaacccatgggccgcgggttggatgagcttgctgtagattaaagagaaaataagaagtgctgaagcnagaaaagtcatagagtagatgctagccnttanggccgaagtagtagttgaagttatttgttggctcatgtcatagtggngaagaagagaaagaagaactttagggatg

SEQ ID NO: 7809 - DNA, 769 bp, Homo sapiens
  misc_feature 157, 626, 693, 733: n = A,T,C or G
agttacttagataaagctacttgttctttttgcaggatcccatcgattcgctggtgtccatcagcacctccgtgatcctcatgcagcaacctggctgcctgccagctactgtggacctggctgcacaaggccgccgcccatctgggctgttggcaanaaggtggacccagcgctgtgctccaaacgtggctgcagcacccgtgggactgaagaatgcatgtgggccgcagggcgtgctggtgaagcacaagcaagaacgtctacaaagcccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacaagcgtccaagcttcagccaagggcttcctggcaangggcttgttgggtagaaagtggtggtggggggggacaaaaagacaaaaaaatccaccaaaactttgnattttttggtacgtactggttcttttgataaatggatggngataaaggaaaaaagtctaatttttatactcccaaa

SEQ ID NO: 7810 - DNA, 748 bp, Homo sapiens
  misc_feature 3, 4, 6, 7, 8, 9, 10, 11, 12, 71, 81, 86, 87, 88, 91, 102,107, 108, 110, 114, 122, 136, 170, 174, 181, 185, 198, 206,214, 216, 218, 222, 223, 224, 226, 229, 235, 236, 247, 248,250, 252, 258, 264, 265, 270, 274, 277, 282, 292, 302: n = A,T,C or G
  misc_feature 304, 307, 314, 325, 357, 358, 360, 369, 370, 381, 384, 392,395, 430, 438, 486, 513, 528, 531, 534, 539, 594, 598, 600,616, 617, 622, 626, 629, 630, 659, 660, 664, 674, 679, 699,710, 715, 729, 733, 740, 748: n = A,T,C or G
ttnnannnnnnntcatttacaacccttgttctttttgcaggaccctcgattcgaattcggcacgagagganccaatactgnctttnnntantataccaaaanactanntntatnaatgttgntaaggtggactggnacaacttttgcctgttttggctttttctctgctntttngtggatntgangggcagaggcgcnctttttgntcgtgttntncntggnnnanatnttttannttgtttggtgnntnanaaagtnattggnntcgcncggnatngaganggaggactgntctgattatntngcnatggganattgagtttantaggaaaattgagaggataaaaattatgatgnnanacctcaaanncccgtgaaggntanaacttctnatncatctagagcaggagactggcatgttgaaagactnataacagntggtctggtgatacttgatatcactagggctcctctttcgctcatgcncttgagagacactttatcaagacctgnggtgggccatgcatngtnagntctgntgagagtgatctgaaatgagatacgaagacaggtcatgtactggcctccacgccncatngnagtttggattttatgnnagtgnacangannacattggcagctgtagctggtgatggcannattnatttgtgctnacaangataagctggtgcagcgctnatgccgtatgncaccncttgggagaccatnacgnggacacncaattgan

SEQ ID NO: 7811 - DNA, 773 bp, Homo sapiens
  misc_feature 1, 4, 9, 92, 93, 140, 144, 146, 148, 151, 192, 198, 212,219, 228, 239, 240, 242, 609, 621, 650, 698, 703, 715, 728,756: n = A,T,C or G
ntcnttttncaaactattgttctttttgcaggatcccatcgattcgctcgcgcaatgggctgcctgtggacatcaccaagtgccgcctgccnntgtcaacaaggacgactttgccctggtccagcggcctggcccgggtntgtntncnggnggcgccccgcgctctggtgaactcaccaagctcatacggcngcagcncgagatgtggctgnccactcnaaccaattnacccgctgggnnanattactggaacaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcaccaccgtggcttncgaagggccatncagaccaagggcatcaagttcgaagtggntcacaaggggtgagctagaaagagccatggccgctgggtgggctccangggangggaagctcttntgaaccaaccatnctgtcccactatacacacatgcccacanggggcttgttcaaaaat

SEQ ID NO: 7812 - DNA, 766 bp, Homo sapiens
  misc_feature 3, 12, 136, 138, 159, 175, 181, 183, 184, 186, 187, 191,196, 197, 213, 214, 217, 223, 233, 239, 243, 245, 555, 585,631, 707, 719, 742, 765: n = A,T,C or G
aancccatacanctcttgttcttttgcaggaccctcgattcgaattcggcacgagatacatggaagtctcaaatctgaatttttatccatctcaatatgaccatttctctctgttgtgagctgaacagattaagtntntttttggccgttgggggatantttggtctatcttttnctgtcntnngnncttnatttnnaaaaattattaaaggnnggntgtggntcttccgtcngttggntttntnaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaangtaacatgtctttatttgatcatctattgnacaccagatcctggctaagggcttccttttttctcatgtagtcttncaaatgtctttgataattgtcactatattatagatgacaaagtgaagacttacgagaaattacctttgcccaaggntacaccacttanatggctgtccaaggccggggaanaacccctgcaaatctggtcttgna

SEQ ID NO: 7813 - DNA, 1040 bp, Homo sapiens
  misc_feature 2, 3, 8, 9, 25, 29, 62, 63, 68, 77, 78, 80, 84, 88, 91, 93,97, 98, 99, 104, 105, 112, 113, 115, 116, 119, 122, 130,137, 146, 148, 161, 163, 168, 191, 194, 195, 197, 198, 202,204, 208, 222, 223, 232, 234, 238, 239, 243, 245, 246: n = A,T,C or G
  misc_feature 247, 248, 255, 256, 259, 262, 266, 269, 272, 275, 277, 279,283, 307, 382, 391, 400, 412, 431, 437, 443, 445, 454, 487,489, 491, 500, 504, 508, 510, 517, 521, 526, 527, 542, 560,583, 588, 606, 610, 613, 628, 631, 643, 644, 652, 663: n = A,T,C or G
  misc_feature 693, 708, 715, 725, 740, 741, 767, 774, 793, 804, 819, 825,828, 830, 832, 876, 878, 887, 895, 898, 949, 984, 987, 993,1007, 1017, 1022, 1027: n = A,T,C or G
gnnttgannctattgaacccttgtntttngcaggaccctcgattcgaattcggcacgaggannctctnatgcactgnntngganaacnggntntttnnncctcnnagcacanngnnacnggnaccaaccnagatgcntccagctgntnctttgtgtaaagntnttgtnggggtttggttgtcttttgtttnatnnanncctntncttngcccttccccctgnnctttaattntnttgnnttantnnnntcccctnnggnggngganggnttnaantntnaaancccccccaccatgttgtcgatggnccctaggattcgaataatcggctcgagacacaccatgggggcatagggaattctctgggtgggccaatggtcaangctttaccnaatcccccnagggtcttcatnggcttggcgcaatccccanataaanggcctngnactccaaanataatccataaaataataaatggcccctggggncncnttttactgngtanaatnanatggggntatngtggnnggtagcactggtacntaactaagggaaaccgantaacaccacaaataccccccccnaaaantggccttgtacctatccnaatncancaaaaccagtggtgnaanaaaccatgactnnggcgacgnctcatgggttncacaaatcaataccgccaaggtcgtattangaacttttgccacanaggttgngaacagtccngcttagggaaatgannaaagaacttgacagggccatcagttncattggnaaaaatggcatggggaatnccagtacccangtttctttgaacccnattttnccncncntttttcaggggggaagtaattggcgtggttttttgggcctcaananaaaactttntttaaaanagntaaagggctaccaagggaaaaagggaaaaaaaattggtttaaggggcaacnaaaaaaaaggcctttaaacttccttgggaaaatgnggnacctanaatttcaatcaagnccaaaaaaanggaanttttntttaaaaaaaaaa

SEQ ID NO: 7814 - DNA, 919 bp, Homo sapiens
  misc_feature 8, 10, 90, 93, 105, 112, 124, 133, 153, 165, 198, 277, 318,382, 410, 452, 454, 472, 496, 514, 543, 555, 566, 572, 603,630, 634, 642, 663, 667, 674, 683, 686, 689, 720, 723, 730,733, 761, 826, 833, 853, 866, 869, 900: n = A,T,C or G
ggtttgantncctttacaagctacttgttctttttgcaggatcccatcgattcgctcaaagaaatccaagacagacaactcttctcttanttnaccattaattcntaagttntggggtcccgtncacttgaanagtctttgaggggttcgccnttcaaggggaanacttcaaagattccaattttcctgaagaacttntagaagaatgattgaagatgatgtcgcccattaagctgccccttacctttactttcctaaaaaaggcccacctgccagnaacccaagggaagcacagtgacaagccttttgaaggcaaangggcagaagccaaaggcattcttgaatgggacaagaaattccacaggggaatttccaaatcttnccaaaaaaaggactggaagactttcttnaaaaaccaaaaatggaaagcagatgacttttgtttgggatantnggccaaaaggcacgcagnaaagatgacaccgaagcccccacnggaatttcttggggggtncaccttaaggacccttttagttaaaaccntcattaaaacanttttggccttnctggcnagccccttaccaccctttaatttggcatttncttaccaaaaggaaaaaacccaaaggnaccnggggggangggaacaaaggaaagggaagnccgnccccctnggtcccctnggnggnttaattccttccccaaaaaaccaggccttcnggncctttcntcnttcttaagggggaaagaatttggaggcnttcgttctttccccaaaaaaaaaaattggccgaaagttctttggtttcaaaaaaccgccttttgnaactttnttagaggccccaaaaaggangggggggctttcntantggcctggaaaaaacaaacgggaaggaaatnttttgaaaaaaaaaaaaaa

SEQ ID NO: 7815 - DNA, 1188 bp, Homo sapiens
  misc_feature 13, 14, 23, 26, 28, 33, 37, 54, 62, 76, 81, 94, 100, 107,108, 109, 111, 113, 115, 118, 130, 137, 145, 151, 152, 160,169, 173, 184, 198, 205, 207, 209, 211, 217, 223, 226, 227,229, 231, 238, 243, 247, 254, 257, 258, 263, 287, 303: n = A,T,C or G
  misc_feature 304, 305, 309, 310, 311, 318, 319, 321, 325, 331, 336, 343,347, 349, 351, 359, 366, 367, 369, 377, 388, 389, 392, 394,397, 400, 402, 409, 420, 421, 422, 423, 429, 434, 435, 437,444, 448, 449, 454, 466, 468, 469, 471, 477, 480, 483: n = A,T,C or G
  misc_feature 485, 491, 506, 519, 521, 523, 524, 528, 531, 536, 537, 538,544, 548, 550, 551, 555, 556, 558, 561, 564, 566, 569, 572,574, 579, 587, 593, 594, 599, 601, 603, 604, 609, 614, 619,622, 624, 625, 640, 641, 646, 648, 652, 653, 655, 658: n = A,T,C or G
  misc_feature 661, 665, 670, 674, 675, 676, 690, 694, 696, 698, 700, 702,708, 710, 712, 713, 716, 720, 730, 732, 738, 741, 742, 743,744, 754, 758, 763, 767, 769, 770, 771, 775, 782, 792, 793,795, 800, 803, 809, 816, 829, 830, 832, 840, 841, 842: n = A,T,C or G
  misc_feature 843, 846, 852, 855, 856, 865, 867, 871, 872, 873, 874, 876,877, 888, 894, 896, 913, 914, 928, 932, 935, 938, 941, 942,949, 952, 956, 968, 972, 974, 983, 990, 992, 996, 998, 999,1007, 1008, 1025, 1026, 1027, 1035, 1039, 1051, 1062: n = A,T,C or G
  misc_feature 1077, 1081, 1093, 1095, 1099, 1106, 1110, 1113, 1116, 1120,1132, 1135, 1136, 1138, 1141, 1142, 1144, 1146, 1153, 1158,1160, 1172, 1174, 1181, 1184, 1186, 1188: n = A,T,C or G
ctttttgggcccnntttaagtgnaananccctnaagntgggaaaaaaacccccntttgggcnaaaaaaatccgcgnagagngaacacagagaangggacnaggagannnancncncgngagacagacggnaaagggnggaatganacatanngaaaaganggggtaaanaaanggagaagagcntttttttttttggnacatatntntntnagagangagcgncgnngnanagacagngaagnaagnggggggncannacatntggggggggggggggggggggggncaacaatatgccacannnaatnnnttacgannanagangaatcncaganagccagnaaangngngacgagtnagcgaanncntgagacanatagagagaannaananagngcnanacgaagnaggagggagcnnnnagtaanaatgnnanaagatgntagnngagangggaggacacgngnnangagaantancgngnaaaaanaatacgaaagagagngggaaggagaggnanannggangangagannnaaaaanatangnntaannanaangancnggncgngnagacngggagaantagaanngggangnanngaagngcganacaancgngnnaacagaatgaggagnngaagnanatgnncnaanaangtgngtganagannnagagggaagagaanaggnantntnangacganangnncancggngagatggaangnggcganacnnnncagagagaanggancgganaagnannnaagnaaggacngacgacgaannancaatnagnagaacncaacgtnagcagaaggtagnngnacacggcnnnntanaggaanagnngtacaggtntnttannnngnntagaggaaaangaggancntgcgggacgagcgtagnnagaaagagagagtncagnatnggngannaaggagnaangagntgatgtacggangagngnggggacganggggaananacangnnagaaatanngaaagagagagaagcgnnnataagatnaagnagctacagaagngaatgtcatgngatgcacgggatagngagntgtaaacgacanangaancagacgntagnagntgnatantcagaaaagggnggnngngannancnggacggnggagngnaaatgatgaagngngaggganaangngn

SEQ ID NO: 7816 - DNA, 788 bp, Homo sapiens
  misc_feature 3, 4, 5, 6, 7, 8, 10, 22, 39, 45, 626, 651, 667, 771, 773,776, 782, 785, 788: n = A,T,C or G
aannnnnnancttttttgttcntttgcaggatccctctnttcganttcggcacgaggctaaacatcaaaaacagatctggtaggggcggggaaaatgagggggaagaaacaaaaacgtgatggtgcctcatgctgcttaaaatcttcagtacattgatgttttgatggcggactacataagcgttaaaaattgtgtttttcagatctttaaaatataagacagtgcttctagtgaataaaaaaattagtttgaaagatatctggagaaatcgcattcataaaacaattggaagtgaaactattaaaacaatagggctttttaaaattaaaaatatttaaaattcaaaagtaattaatagtgttggaagatgtaggtgagaaaatattcctgaaagtagaactgaaagagacaaagagaaaagatgaaagccacagaagataaatacaggggtcaaaaccagactaacagttttagaaagtgaaaaaagttaaaaaagaaatgggggcagtgggttattagaaataacataaatggctggtatggtttgtctgtgtcctccccaaatttcatctcgaattgtaatccccataatccccatgtgtctagggagagacctggtggggangtgattggatcatgggggtggtttncccttacgatgttctnctgataggtgggtggagttctcacaagatctgatggtttttttaaagggctcttgcccctttaactcctcactcttttcttccttgaaacccttgtgaaaaaangngcntttgcnttnccn

SEQ ID NO: 7817 - DNA, 750 bp, Homo sapiens
  misc_feature 6, 9, 11, 669, 675, 681, 704, 711, 735, 749, 750: n = A,T,C or G
ggtttnatncnttacaactcttgttctttttgcaggatcccatcgattcgaattcggcacgagggtggctcatgcctgtagtcccagctattcaggaggctgaggcatgagaatcgcttgaacctgggagtagaggttgcagtgagctgaaattgcaccactgaactctagcctgggcaacagagtgagacttggtctcaaaaaaaattaaaaataaaaaataaattgggggctgagtgtggtggctcatgccttcaatctcagcctcccaagtagctgggattataagcatgcgccaccacgcctcgctaattttgtacttttagtagaggtggggtttcaccatgttggtcaggctggtttccaactcctgacctcaggtgatccgcctgcctcagcctccaaagtgccagtattacagacgtgagccgctgtgcctggccgagtaatttttttttaaaaaaaaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattattagcttgcaataaacaagttaacaaccaacaattgcattcattttatgtttcangttcanggggangtgtgggaaggttttttaattcncggccgngcgccaatgcatttgggcccggtncccaactttttgtnn

SEQ ID NO: 7818 - DNA, 735 bp, Homo sapiens
  misc_feature 600, 649, 658, 696, 698, 705, 720, 733: n = A,T,C or G
gttgactacaaatacaagctacttgttctttttgcaggatcccatcgattcgaattcggcacgagatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctaccttgcttgttaaaattttttttttttttttaaaaatatctgtaatggtctgactttgcttgctttgaaagtaactctttttttttttttgcagtaactgtttttaagtctctcgtagtgttaagttatagngaatctgctacagcaatttctaatttttaagaattgagtaatggtgtanacactaatnatcataatcactctaattaattggaatctgaataaagngnacaattngtacccttttttatnaaataacaaatanaa

SEQ ID NO: 7819 - DNA, 757 bp, Homo sapiens
  misc_feature 4, 5, 6, 7, 8, 10, 51, 61, 68, 92, 98, 106, 107, 116, 123,131, 134, 137, 139, 160, 174, 178, 179, 185, 188, 193, 196,197, 200, 203, 207, 209, 217, 220, 229, 241, 308, 330, 338,340, 348, 361, 363, 365, 376, 396, 398, 403, 414, 418: n = A,T,C or G
  misc_feature 421, 423, 424, 452, 461, 464, 495, 499, 513, 521, 524, 525,534, 546, 548, 552, 553, 561, 594, 629, 649, 667, 674, 682,712, 718, 721, 738, 754, 757: n = A,T,C or G
attnnnnnanctcttgttcttttgcaggaccctcgattcgaattcggcacnagcggagtgntggcttncattttttcttgggcaagatgganaattcncttcctgnncctccatcntggccanaatctaanttntcntntatgccggttttgcttggtgnttgttatttttatntgcnnctgctngcnatgtnttnntgntgncttncngaaatgtntgnacttttggnattcttgttggngagaaatctacttatttatttaaatagcttcgacataccctgccctcactcataattgcggggtggngagcacacccaagtttattagnaaaagttntnctatttanacatatctagaantntntgtgttaaatncgtaaggaccaaaaggaagnantcttntataactgctntttntangnnaatgtgagctaactttgaggctatatancatatgcancanagcttgtgaactgaacacttgtggtcccatnaggngtgcaagcatgttntacttggntcnncactatctnggttcctgcgangntctnnaacgatgnaaatgttcgctgttaatgagaagtctggaactnccatattctcttaagacattttgcggcttccaganatactcttaaatgactgctncaaagctcaaagacttgnagccccntggtggantcctccattagatggacatgcattctccanctaccntgncccatactcagggaacncaaccaacactttcancan

SEQ ID NO: 7820 - DNA, 830 bp, Homo sapiens
  misc_feature 4, 5, 6, 7, 8, 10, 49, 50, 53, 57, 64, 66, 75, 82, 90, 99,100, 108, 115, 124, 132, 138, 145, 165, 167, 171, 172, 183,185, 208, 212, 215, 218, 226, 232, 251, 277, 290, 291, 294,300, 301, 304, 316, 318, 326, 328, 331, 336, 343, 345: n = A,T,C or G
  misc_feature 365, 367, 369, 379, 389, 392, 397, 399, 408, 414, 416, 419,430, 447, 474, 484, 485, 486, 487, 508, 509, 514, 529, 557,584, 588, 591, 595, 597, 609, 611, 623, 639, 648, 675, 676,683, 701, 711, 714, 719, 744, 751, 755, 759, 778, 783: n = A,T,C or G
  misc_feature 815, 822, 830: n = A,T,C or G
attnnnnnanctacttgttctttttgcaggatcccatctattcgacttnngcncgangaagccngncaacttctnggatctnggaggtgntgtaaaggnngctcaggnctatcancccttcagntcgctcanagctgnttctcanggtgaagccttccttgttgntntatnnggaggatcgananctgtgccgtgcttgtctttgggntggnctnccnctgccggnagctanaactaatggtgcccctggnggtccggcttgaaggaaccaacgtcncaaccgcccatannatnctcacnnacngcggactccccntnacttcacncnttnacctngacgatncntgcaaaaagctgtggccagngngnccaaaaatgntgtctttgtnctnatccnanggtgaacgntgccgntnttncgtaaaaaggnatggttcatcattgtgnaagaaaatggatatctcattggcgaanaaaaggggannnnggaaggcaagaatcacttgannaatcntaaatctgtggtgantggaataagatatctctaacaggctaantctgattttaggcctttataaaaaatnatanctngggngngctccatacttnanttgtcacttgtnatgcctggcccaaaangccaatgtnttgccatacttttgggggagcgggacnntgtgggnccaaaaaattgcggggcntttgaccccnaantttgnaaatcaaagttccttgctttcaatntaccaanaaantttnggggggggcaatcttaatnccttnccttaaatggaaaggggctaaaaaccccttcnttttccnaaaacctn

SEQ ID NO: 7821 - DNA, 1089 bp, Homo sapiens
  misc_feature 3, 30, 32, 59, 75, 78, 92, 101, 134, 248, 266, 279, 322,467, 495, 507, 513, 516, 532, 544, 555, 567, 578, 613, 651,654, 718, 748, 777, 779, 800, 805, 825, 833, 846, 860, 867,882, 894, 924, 936, 939, 947, 953, 977, 992, 1001, 1009: n = A,T,C or G
  misc_feature 1029, 1035, 1049, 1052, 1058, 1065, 1079, 1084: n = A,T,C or G
agnaaagtgaaaatcttctttttactacangncttgggcatgggccctgggcaggggtncggaacttcttagganggnatccccgggggttnacccggagncttcggaaatttcgcccttatagtgggagtttnttttaattaacaaatttccaacttgggccccgtccggttttttaacaaacggttccgttggaacttgggggaaaaaaaacccttgggccggtttaacccaaactttaaatcggnctttggcaagcaacaatncccctttttcggnccaagcttgggcggtaaataaccgaaagaaaggccccggcaanccggaatcggccctttcccaaacaagtttggcgccaagccttggaaatgggcggaaatgggaacgccgccccttgtaagccgggcgcaatttaaagccgccgggcgggggtggtgggtggggttaacgccgccaagcggtggaanccggcttaacaactttggcccaagcggnccttaagccggnccccgnttnccttttcggcttttcntttccctttccnttttcttcggncaacggttcggnccgggcttttnccccggtcaaagcttcttaaaatcgggggggcttnccttttaagggggttccgaatttaagtggcttttaacnggnaaccttcggacccccaaaaaaaaactttggattaaggggtgggaatggggttcaacggtaagtnggggcccattcggcccttggaataagaacngggtttttttcggcccctttttggacggntngggaagttcccaacggtttcnttttnaaataaagtggggaacttcntttggttnccaaaacttgggnaacaaacaactttnaaacccntatcttcgggggctnaattcctttttnggaatttaaataaaaggggaattttttggnccggaattttcnggncctaattngggttnaaaaaaaatggaagctggaatttnaacaaaaaaaatttnaaacggcgnaatttttnaacaaaaaataattaacgcnttaacnaaatttccttggangcnggggantttcttnccttaacgccaatntgggngccgg

SEQ ID NO: 7822 - DNA, 754 bp, Homo sapiens
  misc_feature 7, 9, 11, 539, 681, 730, 754: n = A,T,C or G
agtttantncnatacaagctacttgttctttttgcaggatcccatcgattcgaattcggcacgaggaaacatggggaaaagttcgtaaactcctggttgatgcaattcataatcaactaactgacatgggaaaaatgtattttgaaatatatgaaaggaacatctattgtggtccctgaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcanggatacacagagaggtccattccaacacacagagaaattcagcaggctctaatcgatgccggggacaaaccagcaacatttgtcggatcgcggcaatggattggatctattgaggtgcagctggtactaaaccaattgatcngtataaccgtcaaaaatcctgtttgtcacccaaggtcaaaaattgcctnttcaaggccgggaacctggctaan

SEQ ID NO: 7823 - DNA, 800 bp, Homo sapiens
  misc_feature 2, 3, 4, 5, 7, 8, 9, 10, 11, 12, 13, 14, 15, 16, 17, 328,352, 376, 515, 518, 520, 546, 551, 567, 653, 656, 668, 705,759, 769, 796: n = A,T,C or G
gnnnntnnnnnnnnnnncaactacttgttctttttgcaggatcccatccgattcgaattcggcacgaggtacagcaggccttgatttcaacaataaaatcccgacctcccttgctgcgctgcactgcccccgggagctgatgggttggagactggaaatcagaaaacacacaatccagaaacatggtttatctggaacctaggtatataagatgccaagataagtcaaattcacagagacacattgtagaatggtgattgccaggggccacagaggagggcagaaataagttattcttgaatgagtacagagtttcagggttttttgnttttggttttttttttttctttanacagagtcttgctctgtcacccangctggagtgcagtggcgtgatcttggttcactgcaacctctgcttcccaggttcaaaagggtcttctgcctcaacctccgagtagctgggattacatgcatacaccaccacgctcagctaattttttttgtagttttantananatggggtttcgctggtaccccatccngccangctggtttaattattnattttttaatttttttgagctaaaagtctttgccctgtcacccaagcttgggggttcaagtggcatgaatcttaagcttaactggnaanccttcaaccttnctgggggttcaaagtgaatcggtccccaaccttaaancctttcccaaagtaagcttggaaaactaccggggtggggccacccaaccattgnccccaacctnaaattttttggggatttttgggaaggngggg

SEQ ID NO: 7824 - DNA, 753 bp, Homo sapiens
  misc_feature 3, 6, 17, 614, 657, 707, 710: n = A,T,C or G
agnttnaatgcgatacnagctacttgttctttttgcaggatcccatcgattcgaattcggcacgaggtggcgcagtctgagttcactacagcctccacctcccaggttcaagagattctcctgcctcaacctcccgagtagctgggactacagttgaaaaagatcatctagcaaagcctttttcccagctacatataaggaatttgaaagtcacataaaatggttaagaaaatgtgccaagattacctcagtaattctggtctgtgttctcaggagaccctggaaataaacaatgtgtcttctgtggcttcagcgtcacctagtgcaggctgccattcaacaaacgcattgtcaacagtcaaccaaaagaaacccattggccaccataccctgaggactaaccctgacacagatgcccttccagatgccctcaatagtctaactgattccatcgccccagccttgggggagaagcactgctgcctatgcactccatttacagaaaaacgttgacctcttggcgagaatgcaaagaagggaacgcttgcttatacactgttggtgaactgtcacccctacaactcagcttgcaaccagccctggccaccagtttncccacactgagctgaatatcggacatgcccatcttagacattncagcccattctgaaattccacatcgattcacctgacaaagtctgaagttncanggcaatttatcttggaaaagcttacctgggaatacgtgtcatt

SEQ ID NO: 7825 - DNA, 747 bp, Homo sapiens
  misc_feature 6, 12, 13, 537, 708, 732: n = A,T,C or G
agtttnacttcnnatacagctacttgttctttttgcaggatcccatcgattcgaattcggcacgagagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgnattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagatcngatgatacagtatttccaagaaancgctccatctgtgtt

SEQ ID NO: 7826 - DNA, 749 bp, Homo sapiens
  misc_feature 2, 5, 10, 12, 575, 578, 580, 627, 726, 732, 739, 745, 749: n = A,T,C or G
gnttnactananatacaactcttgttctttttgcaggatcccatcgattcgccaaagcacacaaatggcctaccatcttttattcttccttctagcttctggagagagaaatgattgttccagtttagaatgccaggagtttactgggtgtttgtattttttatctgtgccttaaaaaaattagattataatgaacaagacatctttatgttttacagggaaggaaaaagcagtgaaagtatgcattttcgaaagaaaagtgtgttgggaaaagagagagagggtggaaacccaaaggagaaataaaaattttaagtccttgttgcagtagctggaggaagtgagcttggaaatctctccagcgcaatggttgctggctgggaagaaagatctgacttagacacagaataagctgcttgtgctgggtgtgtttgtgagctgggtgaggttttctgtgtcgctgggcacgtgagggaagttacgtggctggggggtggggtggggggcattagaagggagtatgggtgtctgtgggcgctcgcgtgtgcgtgtatgtgtgtgtgtgtgtgtgaaanaananagagaaggtaaaattaactttgtcctatatgttggtttctctgctanagtcttaaaggaacttgcagctgcatttttattggttcaattccacattctctctaggattgttggtgttatttgggtgatgataaagccaggattaanaaccanactgggncaattnaaan

SEQ ID NO: 7827 - DNA, 1116 bp, Homo sapiens
  misc_feature 1, 3, 5, 6, 8, 10, 19, 21, 22, 23, 24, 30, 31, 33, 34, 35,36, 37, 38, 41, 42, 57, 58, 59, 60, 63, 64, 65, 68, 70,76, 79, 85, 92, 98, 106, 134, 149, 150, 151, 152, 157, 174,178, 182, 185, 187, 197, 199, 203, 205, 207, 209, 216, 217: n = A,T,C or G
  misc_feature 222, 227, 229, 230, 233, 234, 235, 236, 238, 242, 243, 247,248, 249, 254, 255, 265, 266, 270, 279, 282, 285, 287, 288,290, 292, 297, 298, 302, 307, 308, 313, 322, 324, 325, 326,327, 331, 332, 343, 345, 357, 358, 363, 367, 374, 384: n = A,T,C or G
  misc_feature 386, 387, 388, 392, 396, 408, 413, 416, 421, 422, 427, 431,438, 443, 448, 449, 453, 454, 460, 461, 470, 476, 477, 485,490, 494, 507, 509, 511, 523, 526, 528, 537, 553, 558, 572,578, 586, 606, 609, 612, 616, 619, 639, 640, 649, 652: n = A,T,C or G
  misc_feature 653, 655, 659, 661, 664, 667, 671, 672, 689, 692, 695, 702,717, 725, 728, 729, 732, 736, 741, 743, 744, 745, 756, 760,762, 769, 773, 774, 775, 781, 786, 790, 796, 797, 800, 802,806, 808, 809, 812, 813, 816, 823, 847, 849, 850, 852: n = A,T,C or G
  misc_feature 858, 859, 860, 866, 867, 870, 871, 872, 873, 878, 880, 881,886, 888, 898, 905, 906, 908, 911, 913, 915, 920, 921, 923,924, 925, 927, 931, 933, 934, 939, 941, 943, 944, 945, 949,950, 951, 955, 956, 957, 961, 962, 965, 966, 971, 976: n = A,T,C or G
  misc_feature 978, 980, 983, 985, 992, 1002, 1022, 1023, 1024, 1025, 1026,1032, 1034, 1036, 1042, 1051, 1052, 1053, 1054, 1057, 1059,1062, 1066, 1071, 1077, 1081, 1089, 1092, 1095, 1096, 1099,1100, 1102, 1106, 1111, 1115: n = A,T,C or G
ntnannananagagggggntnnnnttcttnncnnnnnngtnnagagggggggaatannnntgnnnatntngcttcnttngtgtgntgtaatnttgaantgtgtggncgggggggggggggggtgtgactaattnatcttatttaaatcnnnntattnttaataatatactattncttnttcnganangagatttttntncaantngntnctttatnnatagnaggtntnntcnnnnanattnntgtnnntaggnntgattattanntgtnaatctgtanttngtncnngnantttannattnactgnntagtncattggttntnnnntcanntgttagtacgngnattcgcgtacgnnaaatnttantatagtnatatagtganannngatntctntatgtacagtanatgtnagntctanncgtgngacntatgagngtgantactnnaganncgatanntaaggtgtntactgnngataactnctcangaantcagtgtgacgangntnagcggataatangangnaatggatangtatatatatggtacngtttncgtacgatgtgtgncagttngaattagnagttagtgtcgatagatagnttngtntganatntgagatagtgagctattatnntatagctcnttnnanatgngnagngantttnnatatgttatattattcnttnacngtcatantgtgtagacattagngactagtnctnntangtgngttgntnnngtagaacgatnttgntngttgagntttnnnataccntaganttancattgnntgntntgtntnntannatntatgatngtatgatgcagtattagtaaatgntnnangggaannnagaatnntannnncgttnanncttantnatctttgaanatcaagnnangtntngnagttnntnnngnttcntnnaaaantnannnaatnnnattnnngatnnttnnttatnttgtngnanaantngtgattngatatgtatncgtaatgaaattaactgttnnnnntttagnananaattantggtaatcnnnntgntnacncacnatctngtgatncggntggacatnatntgnntgnngngacntctcnagtng

SEQ ID NO: 7828 - DNA, 748 bp, Homo sapiens
  misc_feature 6, 13, 14, 18, 21, 25, 536, 682: n = A,T,C or G
ttgatncgttacnnctantgntgcntgtgcaggatcccatcgattcgaattcggcacgagcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaaaatatttgggtaccttttaagctttttttctttccttctataatgggnggtacaagttctatattcattcagtttaatctcatttgaaattgtttaaatcagagtcatgtaaatatttgtgggtttttttttggtttatagactcgagcttttcttttacacagttttttttagggaaaaactaaagctattanggaaattctaaatcttgttgatgaaaaaattgggcttttctttggatataattaataaaaagggat

SEQ ID NO: 7829 - DNA, 753 bp, Homo sapiens
  misc_feature 5, 6, 87, 90, 666, 719, 740, 741, 748: n = A,T,C or G
agaannatctctttgcaactccttgttctttttgcaggatcccatcgattcgggctgccccagcgttagcagcctgtaccaggtctnttncccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaaatatggtgactagattttaattcataaccgtaaagttttttaaagttttgggttagtaatttgttttactagaatgacaaagaagatgtaaaccattttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagttttaaccgcaggttctaaagtgtcccgcggagtacagataatattctggaaggtaactgtttactacgacagagacgtggcattttggaaacgaaacttaagatgtttcatggagcttattttgagaactttcccatttcaggtttctgcattcangctttacatggtcaagttaactcagagaatcccccactggttatcatcaactnctctgaaatgtgaaccctttnnaacttgngctca

SEQ ID NO: 7830 - DNA, 690 bp, Homo sapiens
  misc_feature 2, 3, 4, 7, 13, 30, 31, 32, 33, 34, 37, 38, 578, 585, 611,651: n = A,T,C or G
tnnntcnaattcngccgagattcgaccctnnnnnccnngcctataagaccctcctggcccccctgagcagaggactgtaccttgtaagctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaattagccgggcatggtggcgcgtgcctgtaatcccagctacttggtangcccgangcaggagaatcgcttaaacccgtgangtggaggttgcagtgagcaaaagatcacgcaactgcactncactttgggcaacagaatgagacttaatcttgaaaaata

SEQ ID NO: 7831 - DNA, 760 bp, Homo sapiens
  misc_feature 6, 10, 685, 709, 718, 726, 752, 753: n = A,T,C or G
gttganttcnatcaagctacttgttctttttgcaggatcccatcgattcgaattcggcacgagcttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaaatgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcacctttaagtgtccagtctgcttttacagtatttgttcaagcaaaccaagttgcagccacatattttctctgcccatggacaagaaagacaagatctatgactgtncacaatgtcccacagaagtttttntttcaaacnaacttgcngaattcatacaatgaccccaccacanncattttt

SEQ ID NO: 7832 - DNA, 750 bp, Homo sapiens
  misc_feature 2, 3, 9, 11, 14, 486, 662, 714, 716: n = A,T,C or G
gnntttgantncanatacaagctacttgttctttttgcaggatcccatcgattcgaattcggcacgaggcactcggtaaactctgggactggagccaagagactgtgagaaatgacctttctcatcaagtttgtcccaagccaggcttaaattgatagatcgtctaggttttctgatgctggtaaagagactctgtgcctcagggacaggtctgcaaagatcattaagaaacagattaaaattagggagcaagacaagacaagagaaagtttctttacgttctcccagacctctctgggcctataggcagatcaaatttggcctctagatcagcttggacaaaatgatgtccacggtgtctgagtaggtcttttcatttttatccctcttatagccatctttagctgcaggtgccttttagagttatggtttttggaacttagggacattttaaaataaagaatgattattgctcatgatgactgngctaatgagtggaaagaacttgcttttttttcttcttttaactaacttagcctcagttaactagtaaatgtaattttttttctttcttagaagaaaaatatttaaaaaaaaatagatctggcctctggcttgctacccaccttggaggagtctgggaagtctagacaatgtcctangagccagacccactctgcagtcatttgtgaatgaattattgtatcatatgcngncttttgaattcatactttgagccaaatcccactt

SEQ ID NO: 7833 - DNA, 1191 bp, Homo sapiens
  misc_feature 6, 7, 8, 11, 15, 17, 20, 21, 23, 24, 25, 27, 30, 31, 37,39, 40, 42, 46, 48, 50, 51, 52, 56, 57, 60, 62, 70, 73,76, 77, 78, 79, 84, 87, 88, 89, 91, 92, 98, 105, 109, 110,111, 112, 113, 117, 118, 139, 140, 141, 142, 143, 144, 147: n = A,T,C or G
  misc_feature 152, 153, 158, 160, 172, 173, 175, 176, 177, 182, 183, 189,191, 192, 195, 210, 220, 227, 243, 248, 251, 252, 254, 260,280, 281, 286, 287, 293, 294, 301, 313, 344, 352, 354, 355,357, 368, 369, 370, 371, 372, 377, 378, 381, 390, 395: n = A,T,C or G
  misc_feature 403, 406, 408, 412, 418, 419, 432, 434, 439, 443, 446, 447,454, 460, 462, 468, 469, 471, 474, 481, 499, 513, 516, 517,518, 519, 522, 533, 542, 548, 552, 555, 558, 561, 563, 564,566, 584, 588, 591, 599, 602, 605, 612, 622, 630, 632: n = A,T,C or G
  misc_feature 633, 636, 637, 638, 639, 640, 644, 648, 652, 655, 659, 663,668, 675, 677, 681, 682, 690, 697, 704, 706, 719, 740, 747,763, 766, 768, 771, 779, 782, 791, 800, 803, 807, 810, 811,814, 817, 825, 829, 844, 848, 860, 873, 875, 876, 877: n = A,T,C or G
  misc_feature 879, 883, 887, 897, 909, 915, 925, 937, 940, 947, 951, 952,954, 955, 973, 980, 984, 990, 999, 1007, 1009, 1012, 1014,1032, 1034, 1037, 1046, 1049, 1065, 1071, 1074, 1076, 1077,1078, 1082, 1089, 1092, 1095, 1097, 1102, 1104, 1107: n = A,T,C or G
  misc_feature 1112, 1134, 1150, 1160, 1165, 1179, 1181, 1183, 1184, 1190,1191: n = A,T,C or G
cacccnnnacncaananaannannnancannacacancnnanaaanancnnnaacnnaananaaaccaanacnaannnnacccnccnnncnnaccacncctaccncacnnnnncccnnttttttttgaaaaaccccttnnnnnngancgggnnccacncnaacacccctctnncnnnaaaanncccacnanntanaaaaacacccatacnacccactatntcacaanaccataacacactacnacatnaanncntccatncatattcacaatctacacannctacnnacacanntatactnatacacacactnatcactctaccctacacaatataaaacaatntctaaacnannanaaacatacacnnnnnaactnnacncctaatccncctcnaacacccnaancnaaanactacnnccccatccataananaaaantacnccnncaaacancacccnanaaaaanntnaantcatacncctcacaaccccaccctnaaaacaccacccanctnnnnaanaccacacaccntcccaaacnataacncacnaanaanaanannanaaaaaacacaaacaccanaaanacnataaaccnacnacnacatacncaaaaccccncaatacanannaannnnnaccnccancacntanccantacncaccnacctcancnaccnnaccctccnaactccncaccccnanctcaccactccantcacaacaaccctcccccacncactcanacattatcacacaccncananaantcacaacnatnaaaacacanccactaaanaanaatnacnnacncanacaacatntcanccacaacccctactnaccnccaccaacactntatcaccacatcnannntncctncctnccatccttcnaaaatactcaanataccncatcactacnccatattacacnacnactcacncaannannttacactcactatcacancacaacntctncactcnacactctanaccctccnancananacaaactatcacaaccananacnatacacacnatncatatatctcacacancaccanatnannnctanaacccanatntantncacanancantcacnaaactcactccacttcaacacntactctatcaacaacnctacatcacnatatncatcaacacatacnananntaacann

SEQ ID NO: 7834 - DNA, 745 bp, Homo sapiens
  misc_feature 1, 11, 513, 676, 678, 679, 684, 685, 686, 687, 688, 689,690, 691, 692, 693, 695, 696, 697, 698, 699, 700, 701, 702,703, 704, 705, 706, 707, 708, 709, 710, 711, 712, 713, 714,715, 717, 718, 719, 720, 721, 722, 723, 724, 725, 726: n = A,T,C or G
  misc_feature 727, 728, 729, 730, 731, 732, 734, 739, 740, 744: n = A,T,C or G
ntttgattcgntacaagctacttgttctttttgcaggatcccatcgattcggttttataagtggagtcttcagggaatgattatttgggaattaggctttgaaagagcctcagctgtgttccaccccctccaagaattcaggctgttatttttcaaggctgccacagaggtggggagtggaaaatgagactagtaagttaaaatactacaaagcttgctgttcttacagaaattcagccatttttcttgaataaacacttccatggattgctgcaagccttgattaattgccagaatctgaaatggttgcttttgacagtttttttcccataggtttttgttgcttttatggaagagcaaagttttggaggttcttcaccatggtcagtgacatcatttcttggttttgctcttgccccctctttctttctgaagcatcataaggattagaatgatccttgtgttgatgagttctctttgtgacatgttgaatgatgctgtctgtggcacatncaggaaatgtctaattcacagctgagtttcagaatctggatcttgatgtagtcatctatttatagatgatagttaaaacaaaagtggattaaatagcctaaataaagcatttataatgaaataaccaaagagcttctatatttgaagttggataatgcttccnannaaaannnnnnnnnnannnnnnnnnnnnnnnnnnnnntnnnnnnnnnnnnnnnncntttcnncttnt

SEQ ID NO: 7835 - DNA, 735 bp, Homo sapiens
  misc_feature 11, 633, 668, 675, 693: n = A,T,C or G
gttgacttcgntcaagctacttgttctttttgcaggatcccatcgattcggtttagtgttcctccactgctagaaattttggttgttcctgatttttattttcccttttataaatgtctctttggtgaacgttattagacttacagtataatccagttgatacataagcgaatgaagacagtaaccctcaaacagatgtgtgtgtggcatgtacattaactgctatcctttcagcactttgttttgttgaaatggccatttccattatgttcaggaaaactcattttgggaagaataagcaataaatttgtaattaatgaaatctggttcagtttttcagtttgtccaggttttaagagaagttaggcactggcctagctttaactgatgtctgttgccagtgagttgagatcatcaggattgctctgaatacatgccagataaggacgctgagtaccagcacataggcacgggtgaatgctgcttcaaatggtcaaaatgatgttcacccataaagcaacaagaacatgttaatgacatacgttgaatggcacctcttgaagtccaaagtcaggactttattgattaccatatgaagtgtttcctgggatgcccagcatgtttccagaaganctgctggggtgcatcgtgggtttatccagcttggncatgaanggcagatctcaactatgnatgtttcatcttttaaacaaaccttggcatagaaaccacaga

SEQ ID NO: 7836 - DNA, 753 bp, Homo sapiens
  misc_feature 1, 2, 9, 11, 499, 596, 641, 701, 714: n = A,T,C or G
nngttgatncnttacaagctacttgttctttttgcaggatcccatcgattcggtaaactgtatatctgtaatatgaatcccagcttttgagtctgacaaaatcagagttagggatcttgtaaagggaaaaaaaaaacaaaacaaaatgggagatgagtacttgctgagaaagaatgaggggaagggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgcctaaaaccgttnccggaacttttcctggtgtgggcgcttctaacctaatcctcaatcgattccagaactattactctgtttccacagtgatactgtgtctaggttttanggaggacagttcattgatgttacttaaaaatgctttccaggtggnaagttccttaagttttgaggcttcaaatttccttacagccattaaaatcccattcatgantttgaaatactgntctgtggcttggaaatcccaatcagaatggttggctgaa

SEQ ID NO: 7837 - DNA, 822 bp, Homo sapiens
  misc_feature 9, 11, 453, 460, 525, 594, 686, 694, 717, 734, 741, 756,757, 772, 778, 802, 804: n = A,T,C or G
agttgaatncntatacaactacttgttctttttgcaggatcccatcgattcgccttggtgcatgggcctggagccctggggggaactgtgggaactctgagccgtctggccctgagggctcagcctcagcctccacatctgcctgttgcggtcctggctgtggggtctcaggataaggacatagccccctggaagctgggaaggccccacatcaggccttgcagtttctaacccaggaggtggccgacagcagtgcgttggggctgcctgtccctgcacacgaagccctggggggtgaatggaggctctccctgtttttgttagcattggaggcctgagcagggctaacgcccaaccgcttgcttaaagcgcataaagatgctgagatggaaaacgtgttgcatggtgtaaaccatgcaaagcccttccagccagtgcaagtgatcgaggcanacagaanggaaaccgccttttgcaaaagagaagctcggctctctctggggtacacagatcaacccaaactgngcaaagctcacattcatcccaacttcacaagcttgcctgcattcctgtttcacaagcaccctccttgtnccgttgaaccctttcttccccccacttgaagtggggggggcttttcgggccttcaaggtgggggggtgttttgcaagacacagcctatttgntccttgtnccccttggaaacttcattaaacnatagaacccatggggcnataagancttgtttccttgaannccccaaggttcattngcaacnaattaaccctttttcaacattcanancccaacagttaattgcct

SEQ ID NO: 7838 - DNA, 784 bp, Homo sapiens
  misc_feature 1, 2, 3, 4, 6, 13, 14, 19, 20, 23, 88, 91, 145, 173, 175,229, 240, 243, 279, 284, 286, 308, 350, 373, 385, 409, 439,452, 462, 472, 515, 587, 590, 672, 692, 709, 728, 736, 774: n = A,T,C or G
nnnntntgaactnnttgtnntcnctgcaggatccctcgattcgagccgagctgggccgtcctggggatcggtacagctccctggggtnttnacaggccctttgtgaaagttgtgtgcttggtcttccaccccaccccaacactgnttcaaatagcaccaaccagatgggagtncncatctgtggtggcaaaatgctgacattttcccaagaggtcacaaggtgggagangcctgctgtancanaagtgtgtgttagagaaacaggggcctgatttagtngccananactgggtgagaaaaatggccanagaaagtgacctgccagctaccagtgtttccgaaaatgaggntgggatggcccatttcagagcangacacagtcatncccatagccctctgaggagggganggatgcttagagcaggcatttcttgtcagntctgacgtggcangtgccattgnaacttgtgcngaggagtcttaggaagtgctgccataattcataaggtcaacancacatctggatgaatgaaccacctgaaatgtgtgtgggctgagccacaggaagggtgaatcctcttgcttgnggngctttatggggtgcaggttgcttgcttttccacattctctcattttgcttgaagcagcctaacaaaagggagttccccaaanagctccatgaaaaccttaanaaaattcattttcctgnaggaccaaagaagaccaanaatttgtnctttggtcacactggttgaagcttctgtctttacaacntgattgttct

SEQ ID NO: 7839 - DNA, 751 bp, Homo sapiens
  misc_feature 20, 33, 35, 37, 39, 702, 718, 746: n = A,T,C or G
agttacttcgatactcctcntgcatgcctgcgntnancncttcggatccaattcggcacgaggtccatgctaatttctagattgatgttttagccataaaaatgcagtatttaataatattttattttccaaattatgggaaagcttcagaaatagaaatattcaatataattagtactctctaatcttttttctaggttgaaaaatctttgttttgctttaggttagattatgttgaaacacatctgtgtttcagatgtgttcagagctgaggtctcagctgaggctccactgaagcaggattcacttccaaaataacagagttgttgccaatattcagttcgtagcaaactactggaacaagaatctgttttcttgctgagtgaatttcttgccatgtggccctctccaaatgctggacataaaaaagtaggctgagcacaatggctcacacctgtaatcccagcagtttgggaagccaaagtaggaggatcgcttgaggccaggagttcaaaactagcctgggcaatatagggagacccccatctctacaataaataaaaataaaagctttcatttacaatgatggtagaccaaagaaatttgtcctagatcttcactggagaacatctagaaaaagctggcagctgacaaaaattttaaaaacatctgggctgggcccggtggctcacacctttaatncccacccctttgggangcaaggctaggggatcacttgagctcangagtt

SEQ ID NO: 7840 - DNA, 742 bp, Homo sapiens
  misc_feature 58, 62, 74, 115, 116, 125, 133, 137, 142, 144, 147, 150,154, 156, 160, 170, 171, 172, 200, 214, 217, 221, 223, 224,226, 228, 231, 243, 247, 257, 288, 295, 313, 383, 419, 421,422, 449, 516, 522, 524, 552, 587, 592, 621, 622, 637: n = A,T,C or G
  misc_feature 641, 658, 712, 715, 730, 731: n = A,T,C or G
tacaaactacttgttctttttgcaggatcccatcgattcgaattcggcacgagctttnttgnatttttacgctntgctgtccatgacatatttctaacacctttatgattattgnncctgcttgnaaaagggntggnatttntntgngtnctcngntcgnagaaaaggtnnntgtgcccccccttctgggggcagtttgncactttgctttccngtnctgngnncntngcntgagattttttnaaanactcccgcangctttcacttagtttcattgttgagaactgngacaggnccatctctagctgcaaangaggctgagaaagtgaacacagcagtcctccttatccttggggaatacattccaagactggatccctganacagcagatagtactgaaccctatatatactatgtntnngcctatgtatatatacttgatatggtntggctgctaccccacccaaaatctcatctagaattataatccccaaatccctatgtgttaagggtgngaccangnggagataattggatcatgggggcaattnccctgtgctgtcttgagataatgagtgactctcangaganctgttggttttataaatgcctggcgtttnnctgcttgcagcactncatnttgctgcctgtgaaagngcctgcttctcttgccttctgccatgaatgtaagtaactgaggccttccagcangcngaactgtgagtaagnnacctgtttctt

SEQ ID NO: 7841 - DNA, 745 bp, Homo sapiens
  misc_feature 10, 12, 652, 668, 673, 687, 693, 720, 735: n = A,T,C or G
agtttaatananatacaactacttgttctttttgcaggatcccatcgattcgaattcggcacgaggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaacccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgncctctccgtaaatggnacctncttctgtaaagcangcaganctttgatactcttcaaaaaacctttanaatatcttttcaagnttcccacttt

SEQ ID NO: 7842 - DNA, 748 bp, Homo sapiens
  misc_feature 7, 9, 12: n = A,T,C or G
agttgantncanatacaagctacttgttctttttgcaggatcccatcgattcgaattcggcacgagtgtaggcacaagattttcttgctagcggaatgtgaaccaaaaagtgtagaggccaatcagtaaaaatattcaaagccagttttgttgttttcagcagttagtaactatcagtagatgaatatttactaggaaacattggtcttttaaccactttgggcatgcttcttatttagtatgttcatcatgatttagtatcatgacattcagcgaacatttattgagtgcctactgtgcactagggactagtaagcatgttaagtttgtaagctttgttgatttccaccacaaacccataggacctcaggttattctcataattgaggaaactgagattcccagtgttgaatgaaagccacacagtatcacatggccaatatcatgtgattgcagagtcaggactcaaacccagctcttaaccaccacgctatactgacggccctttcccagttcacagggaaaattcaggaacagggagagaatttcaaaatattaaagtttccccatagaattttctgaagaactttgggtatatgttgccccttggtcactaacaagttctagcagatgacagaacaaatgaggaagtagctaattaatattaatgaacaacctcagaatttttctgagtgtggaatagacttggatattcaacagtctcaaatatttgacccatttaatggac

SEQ ID NO: 7843 - DNA, 737 bp, Homo sapiens
  misc_feature 2, 7, 50, 51, 556, 568, 590, 660, 671, 705, 730: n = A,T,C or G
gnttgantacgatcagctacttgttctttttgcaggatcccatcgattcnnaaacttctttgtcttttgaatagtgtgcctttaatagaacacatatagcatagttctagggattagagtcttctgacttcattactatttttacagtaatttatatcttggtttcttcaattagaaaaaaaaatcgggcctgattttttatttcatttactagctcagctgttctcacacctacctgctgaattagaagggacaagtataatccatcttcttttcttctttccctccttctgtaataatgtttttctattttgcaggggtaatttttttttttttttgagataccgcttgctttgtcacccaggctggagcacagtggtgcagtcatggtttgctgcagcctcaacctcctgggttccagcaatccttctgcctcagcctcctgagtagcttactacaggcatgtgccaccatgcctggctaattttttgtagagatgaagtcctactatgttgtccaaactaaaaagtaatttttttttctagaagaagtttanaagatttagganggaaagggtggtctttaaatangcttctttttttcctggggtggggtgcaaaatcttccttggtacccaggttggaggcagtggcacggctncagcactgcanctctgcctccaggtcaagctattcttctgcctancctcacgagtggctgggatacaggngctgccc

SEQ ID NO: 7844 - DNA, 753 bp, Homo sapiens
  misc_feature 1, 4, 12, 91, 92, 696, 730, 733, 738, 744, 745, 747: n = A,T,C or G
naantgaatccnttacaagctacttgttctttttgcaggatcccatcgattcgaattcggcacgagccagcattcaaaattcccatgcttnnggaatccattgggacttctccccaggatgtactgaattcaaggaagctttctctaggtgtagcagaaactgctgctgtcatgtctctgctcaccaggacgtagcttctctctacagacctttatttctttccctggaggcttcagtccatgttgaagtgtaaactccactcagctccaggaggaatcgtgttttctttatcaccaggggcttcttctacgagttgcctttgatagggaggccaggaggaagataggcccaagctcaggggtgggatcggggagcaggaagcctgtgggctttagaatcgaggtattggtttctccctgtcaccatcatccaccacctgtgtgaacttgagccatttatcgaacctcacggagccccaagtttctcatctgtaaacaaggggaatgagccctactttgtatggttgtcaagaggatttgagacaatatgtataaagcaatggacacgcagaggaagtcaataagtacaaggtaactctgaaaatgccaccaaagggaggctagggacaggaaaaccatctccgccaacctcaagaaccgtggccccgaaacttgttccaggaactgggcattgtntgaagataaaaaaaaaaaaaaaaaactcggcctntanaactntagtgnncntattac

SEQ ID NO: 7845 - DNA, 918 bp, Homo sapiens
  misc_feature 5, 6, 7, 8, 9, 10, 15, 16, 17, 18, 24, 30, 31, 32, 33, 51,71, 102, 163, 203, 269, 273, 604, 647, 650, 755, 783, 796,876: n = A,T,C or G
atggnnnnnnttttnnnnaaattntttccnnnnaaattacccttccaaagngccctttggggccattggtntttttgttgggcccaaggggaaatccccccnattcccggaattttcccggttttttttttaatttttttgggaaaaaataaccttttggggncttgggaacttttaacaaaaaaaaggaacttttccccccntcaacaacttttggaacaatggaattggaacaaaaaaagcctggttttggcaagtggttttccctngcancggaatggaaacaaccaaggaaacctgggggaaaggtggaagaaagaaaccctgggggaatggaaagtcatcctggctgggaatggacctggcttttcaggctgactggcccccgcccatgggggaacctatctccactggctatggccagctatttttttcgagccaggctctcgctctgttgcccaggctggagtgcagtgggtgcaatcactgcactgatcctcccacctcaacctacaagtagctgggactacaggcgtgcaccaccacgcctagctaatttctaaaatttttttgtagagacggctctacaatcgcttgagcccangctggtcttaaactcctggacccaagcgatcctctgtctcggnctnccaaagtgttggggattatgggtgtgagccaccgtgttgggccttttgcccaactattttgatgcccagacctgcttcacctttgtgtattgaagcccgttttgnaaaccgtgtgttgtggtgcctttattgnacatcctccaatnggcggttcttttttactctaatggtcttttgggttcccccctcagaagaatcatgaaatttgcaccagacctaatttttngggtacttttgggcttattgatggatttggaaaatgaaagaa

SEQ ID NO: 7846 - DNA, 1320 bp, Homo sapiens
  misc_feature 5, 6, 7, 8, 10, 12, 14, 15, 17, 19, 21, 22, 23, 28, 30, 33,40, 41, 51, 57, 67, 69, 72, 83, 88, 94, 97, 105, 109, 112,113, 117, 119, 122, 125, 127, 134, 135, 136, 144, 150, 154,158, 159, 160, 161, 162, 163, 165, 166, 167, 170, 174: n = A,T,C or G
  misc_feature 176, 185, 192, 194, 202, 204, 207, 225, 227, 241, 245, 257,271, 272, 278, 283, 288, 294, 300, 314, 316, 324, 328, 329,332, 333, 336, 341, 342, 346, 357, 358, 359, 361, 363, 365,367, 369, 371, 373, 374, 375, 378, 380, 395, 399, 401: n = A,T,C or G
  misc_feature 413, 427, 429, 431, 435, 439, 443, 446, 450, 451, 456, 459,461, 463, 470, 475, 477, 479, 480, 486, 487, 488, 496, 506,509, 534, 538, 541, 542, 555, 559, 562, 570, 584, 585, 592,593, 595, 600, 601, 611, 612, 614, 616, 622, 625, 629: n = A,T,C or G
  misc_feature 631, 633, 636, 638, 639, 642, 645, 648, 651, 653, 656, 659,661, 662, 665, 670, 672, 681, 687, 696, 697, 698, 701, 703,704, 710, 712, 713, 715, 721, 722, 728, 732, 733, 735, 738,740, 743, 748, 754, 756, 767, 769, 771, 778, 780, 795: n = A,T,C or G
  misc_feature 798, 799, 805, 807, 822, 825, 830, 831, 842, 844, 845, 846,847, 848, 851, 854, 856, 857, 859, 862, 863, 868, 870, 879,880, 886, 888, 890, 904, 912, 927, 930, 933, 942, 944, 948,951, 953, 956, 957, 961, 962, 968, 973, 988, 989, 991: n = A,T,C or G
  misc_feature 994, 999, 1006, 1010, 1011, 1019, 1020, 1023, 1026, 1032,1034, 1037, 1042, 1046, 1051, 1054, 1057, 1068, 1070, 1079,1089, 1094, 1095, 1097, 1099, 1102, 1105, 1107, 1123, 1124,1126, 1128, 1134, 1135, 1136, 1137, 1138, 1141, 1142: n = A,T,C or G
caaannnnancntnncnancnnnatttntnatnatctaanngtgggggggntttgtnttcaaatacncnttnttttttttgcntaaanaatccnccntccaatanggtntannctananttnagncnggggggnnnttaatctntatctnaatnttcnnnnnnannnccncgcnanccccccctntatactntngattatangngcnatttcactcaatataatnangtgtaggagtgctnctcnccccccttactntttctccatatctnnctaacncctanaaatntagganacttcnatcacttctccatntntctctcanactnnatnntanccacnngacncttctgtattnnntncncnangncntnnnctntnacataacattctacncatnanacataccctatntacacctttcgctncngnctcntttntctncancacnnaatcntanancnaactttnaatancntnntacatnnnctcacatnattacgagtnacntttcttctgcaaacatatccacctntcantanntgtcatgatcttntaancanatcccgtntctctctacattannatatctnntnatttnnctctttttcnntntnctattnaantctnancnctntnnatnttncanctntnccntanannttntcacntnatcatatanctatcnaaccatatnnntcntnnataatntnnanctctcnnctattntttnncntangnctnctacnaatacncncactatatatncncnctatcananttctacactaatatntanntacacncntactctttctcactnacncacgnnatatctacctnannnnnctnttntnncnctnnttctnancactcatcnntgaccntnanacgtcacatctcancatacacntccttctctactttnacncanactacttcnanttcnctnanctnntctnntctctntctgntatcacacacactgnnantgnccgtncgactcnttcnntcatactnnctntcnaacttncnctnctaantcanctctnctnctntatatcacatnanatatatctngataacttancatcnncngntantgntntatatatccaactcanntncnccactnnnnnaanntnactntcatcnntctatatcactnaccntacatntacctcatanctncnatcntaaacaanacncnctctannatncttantacatctntncnacctcnatantctatntataatactncntnattntngtntcctantntaggtcatcnangnnacncactcnttancnatcaccn

SEQ ID NO: 7847 - DNA, 1031 bp, Homo sapiens
  misc_feature 2, 3, 5, 6, 7, 8, 11, 14, 23, 30, 36, 40, 43, 47, 57, 59,60, 63, 66, 67, 68, 69, 70, 76, 77, 81, 90, 95, 96, 98,99, 121, 127, 129, 130, 132, 134, 138, 141, 143, 144, 153,155, 157, 158, 162, 164, 165, 170, 172, 174, 178, 180, 185: n = A,T,C or G
  misc_feature 186, 192, 195, 198, 201, 205, 206, 213, 227, 230, 231, 233,234, 235, 236, 240, 242, 243, 246, 248, 249, 252, 255, 261,262, 265, 267, 268, 270, 271, 273, 274, 275, 277, 279, 281,282, 288, 291, 299, 306, 308, 314, 319, 320, 325, 328: n = A,T,C or G
  misc_feature 330, 334, 335, 344, 345, 346, 348, 351, 353, 356, 358, 362,363, 364, 365, 367, 374, 378, 379, 380, 382, 390, 399, 402,410, 421, 424, 426, 431, 432, 437, 444, 451, 458, 459, 460,465, 469, 471, 474, 478, 480, 481, 489, 490, 497, 503: n = A,T,C or G
  misc_feature 504, 508, 512, 516, 517, 518, 519, 520, 524, 527, 539, 540,543, 544, 547, 552, 553, 558, 567, 571, 580, 583, 587, 598,599, 600, 605, 608, 610, 611, 612, 618, 625, 626, 628, 631,633, 639, 642, 644, 651, 656, 657, 658, 660, 661, 668: n = A,T,C or G
  misc_feature 671, 675, 676, 684, 689, 691, 693, 697, 699, 700, 704, 708,709, 711, 712, 713, 714, 717, 720, 731, 737, 744, 745, 746,748, 751, 755, 756, 761, 766, 781, 786, 788, 795, 803, 808,811, 813, 814, 820, 821, 829, 833, 839, 841, 847, 848: n = A,T,C or G
  misc_feature 851, 855, 857, 858, 862, 867, 870, 875, 877, 879, 889, 903,908, 909, 912, 913, 914, 915, 916, 920, 927, 930, 932, 935,938, 939, 942, 947, 948, 953, 954, 955, 957, 967, 986, 988,989, 993, 998, 1009, 1017, 1019, 1022, 1024, 1026: n = A,T,C or G
gnncnnnnttnaanagtgggccngtgcggnttgaancccntancctngcctgggtcncnntcngtnnnnnccgtcnnttancttcggggnaatannannggggttttcccctctttatcgnataccntnnangngggntgntnngttgtctcncncnnatantnntgttncntnccgntnagcanntattcngcncanttncctnncctcccncttcttaccttacnttnnannnntcangnntgntnngtntantgtttnntcntnnanncnnntntntnncaatgnaangctcctantctcacntnttactntgtgnnaaaangcnantatnnttcttctcnnntnagntntcntnctcnnnncnatcctcnatannncnttcatctncttcccccntgnatattcanaactccattcntcncntattnncgctngcctttnatcgtcntgctggnnntcccntctntnttnacancnnatactgtnntgctgcnatacanntacnttancgannnnnactntcntcacaatacttnnttnnctnactcnnttacnatgacgatnattnttcactctngtnctantgtctagtacnnntaatntantnnnttctcntcctaanntnctntnattgtncgntnatcttcntaggnnnanntctattncgngtcnnctacactnatctncntnactntnntacngtgnncnnnncgnacntctgcggcctngtgtcntctcatnnntnctntctnnatctncatcnttttcttcttcctanactcntncgatcancctctatntcttnatntnntcatgnngtccacgnactncccccncnttgcgnntcngatntnnccanggtcntcnatttncntnaacaggttcncttccggacatccnatatnntcnnnnntcanttcgaanttntnttnctnnttntgaanntgacnnntntatttcctgnctcactcccttactgtacntnnactnacccngatttattatnatcccctncntcntngntcncg

SEQ ID NO: 7848 - DNA, 692 bp, Homo sapiens
  misc_feature 3, 5, 6, 9, 31, 32, 33, 34, 35, 36, 37, 38, 39, 661, 692: n = A,T,C or G
ccncnntcnaattcggcacgaggggagctgnnnnnnnnngtctagctctcagcagagctgggagcaaagcctggccgcccaccccaacctggggctgcctcccactccgtgagatgcttctgtctcctgttcactttgtgtggtagtttcttattttcaaaatgcatctcatttgatcattactgtgaccttgggaagcagcaggacagggatttctttttagaggtgcaaactgctcagaggggacacacctcagcctctcactgtgggtacacgtggcgtgccatgagtggggaagagcaacaggcgagatgcctcattctactggaacatcactgtgggtgaacagagatttccaggttttccctcttaaaatatttgtcccacaccgacaagagtccagtcaccaggcctcaaaggaacttctgcttgtagcagccgcctcccctgtgccccagcctccttaatgtgtgcactctcagagggcacagctcgcgaggctgggtttgggggccaagtggcttgttcattccagcatctaacatcataaaggtgggcccagatttcttgattcgaccacagtgctgttcctaccacacaaatatccattcctgttttgttgaagcagccactggtcctcttgtttcccctgcaaacgganggacctgcagtgcccattcattcaacccccn

SEQ ID NO: 7849 - DNA, 1239 bp, Homo sapiens
  misc_feature 3, 5, 6, 8, 14, 17, 18, 19, 29, 39, 40, 41, 55, 57, 59, 61,64, 67, 69, 70, 73, 75, 79, 82, 93, 105, 116, 118, 119,126, 129, 130, 136, 153, 154, 155, 156, 159, 175, 178, 180,186, 187, 191, 193, 194, 200, 201, 206, 212, 214, 215: n = A,T,C or G
  misc_feature 220, 222, 224, 226, 227, 228, 230, 232, 242, 246, 252, 260,261, 274, 277, 282, 285, 289, 297, 302, 307, 309, 311, 334,336, 338, 341, 349, 358, 364, 373, 376, 377, 378, 383, 384,386, 387, 391, 396, 406, 407, 411, 415, 416, 417, 419: n = A,T,C or G
  misc_feature 423, 431, 436, 442, 448, 454, 456, 463, 467, 476, 479, 481,483, 485, 490, 497, 499, 504, 512, 514, 521, 524, 529, 532,540, 542, 548, 553, 554, 577, 582, 585, 590, 591, 594, 596,600, 602, 604, 609, 611, 614, 617, 621, 622, 623, 629: n = A,T,C or G
  misc_feature 632, 635, 638, 640, 662, 667, 676, 680, 682, 685, 686, 688,689, 694, 696, 697, 701, 705, 706, 709, 715, 717, 719, 733,739, 750, 757, 766, 772, 777, 780, 782, 787, 810, 814, 816,821, 822, 826, 830, 833, 835, 836, 838, 843, 847, 850: n = A,T,C or G
  misc_feature 851, 853, 868, 869, 882, 886, 896, 897, 901, 909, 912, 920,934, 936, 939, 944, 960, 966, 967, 973, 974, 984, 997, 999,1004, 1005, 1014, 1019, 1028, 1033, 1036, 1041, 1051, 1057,1063, 1069, 1070, 1071, 1075, 1076, 1077, 1083, 1086: n = A,T,C or G
  misc_feature 1094, 1099, 1100, 1104, 1111, 1136, 1137, 1151, 1153, 1156,1158, 1165, 1170, 1173, 1175, 1177, 1178, 1179, 1180, 1188,1189, 1191, 1195, 1199, 1202, 1204, 1205, 1207, 1208, 1210,1216, 1217, 1219, 1228, 1233, 1235, 1237, 1239: n = A,T,C or G
ttntnntnagaggntgnnnttgaagcatncttaaggggnnncttttgaaagtggngntncncgnatnanngangncganccntttcttttatnatgcattgaatnaaagtttatgntnnttaccgnagnnatgtgnggggagtgatattcctnnnntanattatgattcttgtgntangnagatannattngnntgtggnnaaacnttcggnanntgatncntntnnntntncaaaataatnatcnccatantttctagnnggagaaaaaaagngtntccgnatnagtntcatatgnataangcttntntngcgggtatagattgtgtatctcntntntgncgatatangcacctgtnttccgnatactatgngtnnngatanncnntatnttacntttgaaatgnngcanactnnntngggnagtgtccntccgnaatgtnactatnacgcgntntttgganatgnactaacacnatngntntntcgcnatcgttncntattnttattgtntnctatgtntcnctgcnatncattatcntntcatcnatatnnttttactggcctcacagatttgnggtcnaanattgnntgnanactncnantgtancnganatnctannntcattntangancantnatatgtattggattggatagcnattantaataatcnggancntanntnngcgantnntacntcannaanagatantntntttatatgaaactntctggngagcgagaacnggggcantttcgtggncctatntatancgngntgttnttgcgtaagatatttacgagctncttncntgtanncctngatnacntnnanaatanacgngtnncntatatgagaagtgtnncatgtttttatantgcngtaattactnnatgnaatagatnatntgtgtaanagagataatgtgtntncgncggtntgcaacatagcatagngaatgnnacgagnngtgtaagtgnatcatatgaaatnantggtnntcacgctangttanatcgtatcncgtgnaantgtangtataaggtnatattngaattngaaacnnntatnnntatggnatnctacgtgnggggnntgtngttttantcagaggatattatttctagtgcanngtggtaaagaaaananatntnatgtatntgtangantnannnntcgatganngnatangatngtntnnanngnataggnnantcggcgtancgatnangngn

SEQ ID NO: 7850 - DNA, 674 bp, Homo sapiens
  misc_feature 2, 8, 103, 109, 114, 124, 155, 315, 348, 426, 444, 448, 461,482, 486, 489, 500, 514, 522, 546, 547, 560, 566, 572, 573,578, 584, 590, 607, 609, 612, 613, 622, 636, 657, 665, 674: n = A,T,C or G
tncggggncccggctttaagagcacaaggagggaaagtaacgaaagggctggactactataaaagttacaaatacgtagttagaccaatagatttatataagncaggtntttgncatgtaattnattaactaactattacagaaacacagctaanaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagcncgcctgtgtattgcaattggccgttaccttaancactgagccacccgggtttagttcagccatttcaagaagtatatttaacgtcggtagttctgctttattaaaatgcancagaggtactcttctgtncctnccgtttatagttntctgaagagagttctattttntggnatnggtttgggttncttttgcatttttngtatcttngtatttatccctgaacatgttttnnacctttttttttnttaaanaaaaannaatcnttccgnggtttntaaaaaaaacctacgangnaannccttgaagnaaatgtggcggtcncttaaaaaggtctctgttgcngcaagggnttaaatccn

SEQ ID NO: 7851 - DNA, 967 bp, Homo sapiens
  misc_feature 2, 3, 6, 8, 15, 19, 22, 25, 26, 27, 39, 40, 54, 56, 59, 67,68, 69, 72, 73, 74, 76, 77, 78, 89, 95, 96, 97, 99, 100,106, 107, 108, 110, 113, 117, 119, 131, 132, 139, 141, 143,145, 146, 147, 149, 150, 158, 165, 168, 169, 171, 176: n = A,T,C or G
  misc_feature 177, 181, 187, 189, 191, 198, 199, 201, 213, 215, 218, 223,226, 228, 229, 234, 239, 240, 244, 250, 254, 258, 260, 261,271, 273, 277, 286, 290, 292, 295, 300, 302, 304, 305, 309,311, 313, 314, 324, 325, 326, 330, 332, 334, 338, 341: n = A,T,C or G
  misc_feature 347, 352, 360, 364, 367, 370, 386, 389, 394, 397, 399, 400,409, 410, 412, 414, 415, 417, 423, 428, 430, 431, 439, 441,444, 455, 457, 458, 462, 465, 486, 487, 491, 493, 494, 495,505, 509, 510, 512, 516, 517, 523, 524, 525, 529, 532: n = A,T,C or G
  misc_feature 534, 539, 544, 547, 565, 570, 572, 579, 582, 586, 590, 595,597, 603, 608, 610, 614, 615, 619, 626, 632, 635, 638, 642,643, 644, 646, 648, 651, 652, 657, 661, 662, 665, 667, 669,676, 677, 679, 680, 694, 704, 712, 713, 717, 720, 729: n = A,T,C or G
  misc_feature 737, 742, 758, 760, 762, 767, 768, 775, 778, 780, 786, 789,793, 795, 796, 798, 803, 806, 807, 818, 824, 825, 832, 836,840, 841, 854, 862, 866, 869, 878, 885, 886, 887, 888, 889,894, 896, 898, 911, 913, 914, 920, 922, 924, 925, 927: n = A,T,C or G
  misc_feature 932, 933, 935, 940, 944, 948, 953, 961, 964, 965, 966, 967: n = A,T,C or G
tnnctntnttttagngggnttnttnnnttaaatcccctnnccatagagcggggngnttntcttttannnccnnncnnngggctagaganttcaannngnntggcgnnncnctntatncnctcccacaatanngggatgnancntnnntnnactttatnaatctcnttnntntctcnnacgngtgatntngntttagtnncntcgccgctttcncnggnttggntcnannttgtncattnnaggnaatccntttnatcnannatcatcatcncnggtnatctgttcnctcnancgncaccntnanntccnantnncttagtctcnnnagcnanantatnttnatagtnaccanatcttttncttnaanggnaatacatatcctcctnctnagaancgngnncatctaganncntnntntctccncttantnngctcctcnangtnccttataagtncnntgcntcnaaaggcgaaaaaataatttannttgnannncgtttcattnacanncngcannggtatnnnagancgnanctctntttantgnccttaccctttaaccaantctantnatatttnaanttgnaacnttatntntggggntaccnanacannatcntctcggnggttanacntgnactnnncntngtnncaagntatnntantngncatgtgnntnncttgcctagtggtnaggtattctnaaaatttnntaantcntaaatttancatgccanatggnacgtaatagtatcaanantntggtnnatttttnggnancctttntcngtananngnggggntanngctgccttcantttcannccatcanatgntttnncaaagattttatngtactctncttntanattctttanagccaannnnngaagncncngttcacttttcgnanntaagantntnncntatgnncntcttnctanaatnttctntctcctangtnnnn

SEQ ID NO: 7852 - DNA, 734 bp, Homo sapiens
  misc_feature 3, 6, 431, 540, 569, 584, 592, 608, 626, 633, 637, 668, 682,683, 685, 708, 722, 734: n = A,T,C or G
ccncgnctcgaattcggcacgagacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatattcatcgctacttgtgcctggacaagtcggtcattgagctcagccgacagggcaaagaggggagcatgattgatgccaacctgaaattgctgcaggaagctgagcaacgtctcaaagccattgtggcagaagaagtttgccattgccaccaaggaaggtgatttgccccaggtggagccgctttttcaagatcttcccactgctgggttttgcattgaggagggattaanaaagttctcggagtacctttgcaagccaggtgggccagtaaaagcttgaggagaatctgctcatggtgcttggggacagacattgaagttgatccggagaagcttccantcattttttgcaagataccccttacttcnttcttgtttggaaangggaattngccccccaatttggtngggagaaccccaccccanccccaanggangccttgaaaccgaaaggctttgtccttggcntttgggggggggannantctttgaacaaggccccaaaaancctttttcttaccngggcttgggccn

SEQ ID NO: 7853 - DNA, 654 bp, Homo sapiens
  misc_feature 3, 6, 14: n = A,T,C or G
ccncgntctggaantatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcctttgaggagcactcactcttg

SEQ ID NO: 7854 - DNA, 668 bp, Homo sapiens
  misc_feature 4, 7: n = A,T,C or G
cccnccncggaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgacttttgtttctcattcagttttgggaggaaaag

SEQ ID NO: 7855 - DNA, 1381 bp, Homo sapiens
  misc_feature 4, 10, 14, 16, 17, 28, 29, 31, 32, 33, 36, 37, 42, 51, 52,53, 54, 61, 62, 63, 64, 65, 66, 67, 68, 69, 71, 72, 75,76, 77, 82, 84, 85, 91, 98, 101, 102, 103, 104, 105, 110,111, 112, 113, 114, 116, 117, 118, 122, 123, 125, 132, 139: n = A,T,C or G
  misc_feature 143, 144, 146, 148, 159, 161, 165, 168, 169, 170, 171, 172,173, 183, 194, 195, 215, 217, 218, 219, 224, 228, 229, 230,236, 249, 257, 258, 266, 267, 273, 281, 282, 288, 290, 292,303, 306, 311, 316, 319, 320, 323, 326, 333, 334, 336: n = A,T,C or G
  misc_feature 344, 351, 358, 360, 363, 365, 367, 370, 375, 380, 383, 397,399, 405, 409, 413, 416, 426, 448, 456, 461, 467, 474, 487,494, 495, 498, 499, 507, 508, 509, 511, 515, 522, 526, 528,531, 536, 541, 542, 545, 551, 558, 562, 571, 573, 578: n = A,T,C or G
  misc_feature 589, 591, 592, 595, 596, 610, 617, 620, 622, 628, 629, 631,635, 639, 643, 644, 650, 651, 653, 655, 660, 663, 664, 665,667, 671, 672, 673, 677, 678, 681, 696, 697, 699, 705, 709,711, 712, 719, 720, 721, 723, 738, 740, 741, 745, 746: n = A,T,C or G
  misc_feature 749, 750, 751, 752, 755, 757, 758, 766, 768, 770, 772, 776,777, 782, 785, 787, 791, 792, 795, 799, 807, 808, 810, 817,819, 820, 821, 824, 831, 838, 841, 845, 850, 853, 866, 872,873, 876, 881, 886, 888, 895, 903, 906, 908, 923, 924: n = A,T,C or G
  misc_feature 925, 932, 939, 941, 944, 945, 949, 950, 951, 953, 956, 958,967, 971, 972, 974, 976, 978, 982, 989, 995, 1000, 1001,1007, 1012, 1014, 1026, 1027, 1029, 1038, 1040, 1043, 1046,1050, 1059, 1061, 1071, 1076, 1085, 1089, 1098, 1103: n = A,T,C or G
aagngggaancagngnnaccacgcacannannnccnnaaggnggggggggnnnnacaccannnnnnnnnannggnnngacgngnngaaaanccccccnccnnnnnacccnnnnnannncagnncngacgggnggggggnaacnncncnaaaaacgcccntntggngannnnnnccctttaccnccccggacaannaacccagcccaggggaaagnannnacacncgannngggagnagggccggcaccncacaatanncacacacnncgaacntaacgganngcggananancgtacacaacnccnacganaccanaanncancanaaaacannancacccagncaccacntcatacntnctngnanatnatacntcatnatnctgccatatcatcncnacagtnccanggcncgngcagatccanacaatactacgcgcagcaaggnaccaacanaaatnaaaaancaaccanggaaccccccacnacacacnncgnncgcagaannnanatanaccacanctgntncanaaacnccacnnagngaaacngccagcngaantcagaaccngncaacntccacgaccanannagnnggaaccaaccaagnccagatngcnancaatannancacncganccannacaatnncncnacacnacnnngnctcnnnaacnncangaaaaaagtcatcgnncnaccacnacgngnnaaaaacnnncntacgacatataccancnnaacnngcnnnncgncnnacgcaagncnancncacnnctatngcnancctnnaancgcntgtcaatnntnacgcccngnnnacngtagacnactggancanacanacagnggngccacgttgaaanatgcgnntantacgngatgngnacacaanaaaacacnccncncagacgcgcacgacnnncacccgnggggcgnancannaaannntncgnanggacaacgncacnngntncngganaccgcantaaaantccannccaaanactangngtggacgaaaanncncgaggacananacnganacgntgaaggacnanagctgcaaangggcnacacaacgnccangctgaacanaccgncacaacangcntncatnnnngngcgcncacngacnacatcncaacgcgcgtnaaancnanaacgggnacacacannnaataanacacacgcangaaaagaaaaacnggnaacgagnngaaaaatngacccaaatatcaagnncnanaacncangcaggggcacgnggannngggacaagngaagancncggnccngnannacncgaaaggcnaganngaggccagacacacacaaaaactacatcaggaagacnaggaacnngaaaaagagaaaancn

SEQ ID NO: 7856 - DNA, 1027 bp, Homo sapiens
  misc_feature 4, 12, 13, 18, 19, 22, 25, 27, 32, 45, 48, 49, 55, 56, 57,65, 71, 72, 74, 75, 83, 86, 90, 97, 109, 112, 113, 114,119, 122, 126, 127, 131, 132, 137, 138, 140, 142, 151, 153,156, 157, 158, 160, 163, 164, 165, 169, 174, 178, 179, 180: n = A,T,C or G
  misc_feature 182, 190, 196, 200, 212, 218, 227, 228, 248, 253, 256, 271,286, 288, 289, 292, 303, 307, 311, 316, 323, 340, 356, 362,363, 365, 368, 377, 380, 383, 390, 392, 393, 396, 398, 405,406, 408, 413, 418, 422, 427, 434, 435, 437, 441, 443: n = A,T,C or G
  misc_feature 447, 457, 461, 464, 467, 473, 474, 475, 495, 496, 498, 499,500, 501, 506, 510, 514, 516, 520, 528, 531, 532, 536, 564,575, 579, 580, 587, 589, 596, 604, 614, 616, 620, 622, 623,626, 628, 638, 641, 642, 650, 651, 652, 664, 666, 669: n = A,T,C or G
  misc_feature 670, 672, 673, 676, 678, 687, 690, 691, 693, 696, 705, 706,708, 712, 714, 717, 718, 723, 731, 733, 737, 746, 750, 751,753, 754, 756, 759, 764, 765, 766, 771, 775, 778, 782, 783,788, 795, 801, 802, 803, 805, 807, 812, 813, 817, 818: n = A,T,C or G
  misc_feature 823, 825, 827, 829, 851, 861, 870, 871, 882, 886, 903, 910,911, 915, 916, 917, 919, 921, 922, 925, 926, 929, 931, 938,945, 948, 949, 954, 959, 962, 964, 967, 969, 970, 972, 977,979, 986, 997, 1003, 1004, 1005, 1014, 1015, 1017: n = A,T,C or G
  misc_feature 1025, 1026, 1027: n = A,T,C or G
aacncaccccannaaaannaanacnanaaaanacatcaaaaacanacnnaaaaannnaaaaaaanaaaaannanngggaaaanaanacanaagaaangggtcaaaaaancannnacatnacnatcnnaacnncgaanntncnaaaaaccancnccnnnanaannnaggnttttnaaannncncccaaaantttttntaanacacataaaaantttacnggggggagnnataaaaaaaaataaaaagtnccccnccnatattcactcacaantccacacaacatacnanncanaaaacataaantttnaaancctgnagtgccnaaataaatgacacaaantcacaaaaaatatcanagcacnnanagnccattatcnaanacnctaaacntnntgncncaacctnnanaaatnaaaanctcncaacncatctannanacananatanataaaaaatnaacncantancaaatnnncaataaaattaaaataaatnngnnnnaaaanccantcananaatnatataagnacnnactnatatacatcattctacatcaaactaaanaaaaatccaantatnntaaaacnanaacaatncaaaacanccatacatananattnannttnanactctaaaanaanncaattctnnnatcactacaaancnctnntnncantnaccaactanctnnancancctaatcannanactntnatnnaaatntattcctnanaacntaacaaaancacnnannanctncactnnntactnaatntanactnnataancaaatancaatannncnanataannacannacacnantntnataaacaacactactacgtaanctactacacnacacatatnnctaacaaattnaacnatacgaccatcataatntaaactnnttannnantnnctnntancnactaaanatacaancannaaatntcttnaanancancnntnctatnanaaaacantaatcaatctnactacnnntaaccaatnncncatatatnnn

SEQ ID NO: 7857 - DNA, 670 bp, Homo sapiens
  misc_feature 644, 648, 661: n = A,T,C or G
ttatcgaattcggcacgagacagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaattggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgactccccgaataactgaaaaatggctgaatatttttatgggtacttggatatttatttnccangagtgagcctaanactttttcc

SEQ ID NO: 7858 - DNA, 1558 bp, Homo sapiens
  misc_feature 3, 13, 16, 18, 19, 20, 24, 26, 31, 33, 34, 35, 39, 40, 41,43, 45, 46, 50, 51, 53, 54, 56, 58, 59, 62, 64, 69, 71,78, 81, 84, 85, 87, 91, 93, 94, 100, 102, 108, 110, 111,112, 117, 123, 124, 126, 128, 130, 131, 135, 138, 141, 142: n = A,T,C or G
  misc_feature 144, 148, 152, 159, 166, 174, 187, 196, 197, 201, 205, 208,215, 219, 222, 223, 225, 237, 239, 243, 247, 253, 255, 259,260, 267, 268, 273, 276, 278, 283, 286, 288, 291, 295, 297,298, 299, 300, 301, 303, 304, 306, 307, 311, 318, 323: n = A,T,C or G
  misc_feature 326, 327, 334, 337, 339, 343, 346, 347, 348, 354, 355, 360,361, 364, 369, 374, 377, 380, 385, 392, 393, 396, 399, 401,402, 406, 414, 420, 423, 425, 426, 431, 432, 435, 437, 441,448, 452, 453, 455, 457, 458, 460, 461, 466, 468, 469: n = A,T,C or G
  misc_feature 474, 475, 478, 481, 484, 487, 492, 493, 494, 497, 505, 508,509, 512, 515, 516, 521, 528, 536, 537, 542, 553, 554, 559,566, 574, 577, 579, 582, 586, 587, 591, 601, 604, 605, 613,617, 620, 622, 627, 644, 647, 650, 651, 656, 657, 660: n = A,T,C or G
  misc_feature 663, 665, 668, 669, 675, 678, 680, 682, 686, 690, 702, 704,706, 708, 722, 726, 730, 733, 736, 738, 739, 744, 748, 758,761, 764, 779, 785, 789, 791, 793, 794, 801, 803, 805, 808,814, 816, 818, 825, 826, 836, 849, 856, 859, 865, 868: n = A,T,C or G
  misc_feature 871, 879, 889, 891, 905, 911, 916, 918, 919, 920, 921, 933,939, 941, 946, 947, 953, 955, 957, 958, 961, 963, 964, 966,968, 971, 980, 981, 984, 994, 995, 999, 1000, 1006, 1009,1013, 1018, 1020, 1029, 1033, 1041, 1042, 1043, 1045: n = A,T,C or G
canggaacaatcngantnnntatnantaccncnnntgannnantnnttgnntnnanannaantnacctngngagtaanatnatnncncaancnntcactntncgatantnnntacgnttattnnantngnnaaanttnatnnanaaantaanactaatntcgtttntgggggtntaattgtaccctngataccccnnaatngggntanaaatttncaangtnnangattcgcaagcnanttantcanacaatngnaatnntaacccnnagtcnaananggggngtntnttntttntnnnnntnnannattnaccccantaacnatnnatcatcnatnantagnctnnngaatannataanncanatctncaatntcnacngtacntatatcnntantananntgtnaatagaancgaaanagntnnagaannatnanaatntgtcttnaatnnancnnanntaccnanngcggnnacnagnaantancgtgnnngantaacgacnagnnaantcnnaatcntacagtnattcacgnntgtantgctcatacgnnagcantgtcacntattatcncancncanttgnntccngaactgatcnagnnatcacaanatantanantacanatattaactgatatttncangannatttnnacncantntannactcangancntncgcngctngttgcacattanancncntaacacacatcacnatanacancancantnnatacnctcngtgcagtacntgntanctcttttcatgaagntaatgncgancntnnagaaaanancncanattctnancnaatacanngctaacatantagtataatacanatacganttncacatntgncanttacattnagagcaccgntntacacaattgttcnactgantatantnnnngcagtaacacgngctgtncntcacnngtcacnanannagnanncntnacntgtaattanntgnagctaaatcnncagnnagatanatntaantatcngncatatcgtntttntgatacannntncnntctctacgctnncgcatttanganntcnatatagcnnanncntnnctnnanaannanncgtaaatnatnctctacnttnnatatntaacgaatcntaanttnntatctatntatacanngcactatcntataatgnnacnatttntnatcgncaaaantcttntantatcnatnananantnnctngctncanattantannaacnnactcnnccgntnncaagntntnncanattannntnataaatcantgntatgatgatgagctcncaaancatcncgtagnntgntgtatacnncnagnnangtataagacnactttncacnnnactacgnatgactangannatatttntncgcngtncctcatncnangcanatccataananntggataanntttactgagatacnatctnncgattacatnacnccactacatctgtgattacaactanagnatagaaatnancncntncctattctnaatntatngantntgtgagatnc

SEQ ID NO: 7859 - DNA, 682 bp, Homo sapiens
  misc_feature 1, 5, 12, 14, 15, 17, 20, 31, 34, 45, 594, 629, 651, 661: n = A,T,C or G
nttcnctgactnannanctncacaacactgntancttgactgtanctatgtaataacattagatcccctaattgtaattatattgggtttgcacagaacactttaatcttcccctcaccaatgtgaagtgaggaatcaggagtcaaactgtagaactaaaatttgacttcagtctagcgtttccttggtgtttttaggttgctttggtaagtttaggtttgctatatttctgattgcttagaattttgttttagccctttaaaatcagatcataaatatgaattcatacttctaaggaattttcttgctataagctggagtttaggtgatgtataggttcagttgagacatttttggaacaggcaaatccttagttaacataagatatttaacagttgaagatagtgtcatggatttttatcttttttagcaagtaatgctaagaaccactggcctgagctactactcttcagtatacattattaggattgcatagacttactagaggaacagtttcaggttttgatgctaatcagtggttgtgtcctaaagttgtcctttgtgcctttaaaaaggtttggatatatcttctangtttaaaaattgcttattaaggaaattcattttantaattgcaggtggggaaaagtnatgggtcaantaaccactagggtaagactat

SEQ ID NO: 7860 - DNA, 678 bp, Homo sapiens
  misc_feature 2, 24, 25, 548, 637, 658, 670, 676: n = A,T,C or G
antaacgaattcggcacgaggcanngtggtgactaatatagtaaatgtctttatagtaatacgtgagtaatcattaattctaaagatagaattattattacaataaacaaactttagtcacatattggcagtttttctatttcaaacacagcaccagagatcagagtctacttgaaacttacatttgtgttatttaacaatttttctgtatctttttcattggtgttttgttttgtttatcttttgtttttgtttctttggtttggtttgtttttgttttgttttttgagatacgatctctgtcacacaggctggagggcagtggcacagacatggcccattgcagtctcaaactcctgggcttaagtgactcttctgccacagaagatgaggaagaatacatttttcatagtgatggggtctcactatgttatctaggctggtctcaaactcctggcctcaagcaaccctccaccttggcctcccaaagtgctgggactatagacatgaatcaccacactcagcttccatgtctttttatgaactanggttcctaattaatcagataaatttggtattttcatctcctaacttgccatatgttttctgggaaatcttataagcagccgagagtggnggctcacgctggaaatcccancacttttgggangctgangg

SEQ ID NO: 7861 - DNA, 1415 bp, Homo sapiens
  misc_feature 3, 4, 13, 14, 16, 18, 24, 26, 28, 30, 31, 33, 41, 43, 47,48, 52, 53, 60, 64, 66, 68, 72, 73, 74, 77, 80, 86, 88,93, 94, 102, 107, 108, 111, 121, 126, 127, 128, 134, 136,147, 150, 164, 167, 171, 176, 180, 181, 195, 196, 210, 212: n = A,T,C or G
  misc_feature 216, 217, 234, 241, 242, 256, 260, 266, 267, 270, 272, 278,288, 292, 293, 315, 321, 325, 330, 336, 337, 338, 339, 352,355, 357, 358, 359, 363, 366, 376, 378, 384, 393, 401, 405,410, 411, 412, 414, 418, 419, 424, 428, 429, 432, 438: n = A,T,C or G
  misc_feature 442, 450, 451, 453, 459, 461, 469, 475, 483, 491, 493, 494,501, 507, 513, 514, 517, 520, 524, 527, 529, 530, 534, 535,537, 539, 550, 555, 556, 561, 566, 576, 579, 585, 587, 588,589, 590, 594, 595, 597, 601, 602, 603, 610, 618, 620: n = A,T,C or G
  misc_feature 624, 636, 639, 652, 653, 667, 676, 680, 681, 696, 698, 707,710, 712, 715, 724, 732, 740, 742, 744, 762, 769, 771, 792,801, 806, 808, 811, 812, 817, 824, 825, 830, 831, 832, 842,847, 848, 852, 853, 858, 866, 871, 874, 875, 883, 887: n = A,T,C or G
  misc_feature 889, 890, 892, 896, 897, 898, 899, 911, 915, 920, 921, 925,926, 937, 938, 940, 944, 946, 948, 951, 957, 960, 962, 963,966, 969, 973, 974, 985, 998, 1005, 1011, 1014, 1016, 1019,1021, 1024, 1025, 1030, 1032, 1038, 1048, 1049, 1054: n = A,T,C or G
  misc_feature 1056, 1062, 1067, 1074, 1075, 1077, 1080, 1084, 1089, 1092,1094, 1100, 1104, 1107, 1112, 1113, 1115, 1120, 1122, 1125,1128, 1129, 1132, 1135, 1146, 1148, 1149, 1154, 1156, 1168,1176, 1182, 1186, 1193, 1197, 1221, 1222, 1231, 1232: n = A,T,C or G
ctnntaatatacnnanancaactncnantnnantattttancntaanntgtnncactatntaananantctnnnctnaanacaaantnagtannctttgtanattcnnggnaatctctttnagaannnatcatntnaagtatatcgnacnagctcattaatatnatngaantcatnacannagaataatatcaannactaaatcaacacncncaanntaatatcgaattcgggncgaagannaaacgcaactaggncacnccgggnnggngnagaccntacaaaaaanatannaaaaaataattaataagcccancttgancctnattangggggnnnntttataaaaaaanctntnnnccancanacatataacntnatatanaataaattnttacttanaatnatagnnnantatnnctatnaggnntanataaanactnaattaacnnanaatttnanattagagnagaaantcataaanacattaananncgactanctcttnaaagtnngtnaanttgntananncatnnancntatactatatnctatnntcctntaatncacagacgtnttntgagantnnnnttcnntnatannntattctnattcagantngcgnattatatatatnatnataaactataganntcatattatcacanattaaatancgcnntcctcagatctgctncntcttataanttntnganataagtacnaaatacanatacactntnanagtcttaaatatcaatangaacaananttatatatatagtacacggtntcttatatnataanantanntctcntattaanntctcnnnctactatatntcacnnaaannatcanaatcgaanacatnttnntattactnctgntnngntacnnnncaatgtcaacantttnatacnnccannaaatctttctnntnaatngncngantatacntancnnaantantctnngtagtttatancaaacaggacaanccattantaaaanctntnatnanatnncatantnctaaanatatatctcnnattananacatanaatanagataanntnatnatcnttaancanantattanatantanaatanntnaatcntnaantannacnttntcctctactancnnctctntntttaagctatantgagttcncgcacntatntcggatnctancatctataacatattaataatatnnatatatatnnagttctgtaacactcacaanacgcgctnanncgaaannncagantatatanacatatcaaacnntannattatcttctctntatattctntttacacantctancntanttntctanaannatcatnaacaattgttgcgactatcatacantcataatcaccaancagtcacggngagngcn

SEQ ID NO: 7862 - DNA, 673 bp, Homo sapiens
  misc_feature 2, 566, 587, 609, 618, 625, 653, 664: n = A,T,C or G
tntcacaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttcttcagtggaagagccgggacctttcccctgcacccccgacatccanggacggggtgtgaggaaaacnctgccttccaatggcctggacnggatgtttncaaactnttggtcccctacgtctcaacaggcgctnacttgaagtgnatgaatatt

SEQ ID NO: 7863 - DNA, 694 bp, Homo sapiens
  misc_feature 2, 3, 6, 12, 14, 35, 100, 608, 625, 637, 665, 689: n = A,T,C or G
gnnccngtagangnaattatcatgtttccagtccnagtattcttttttgttccacaaatcatagatgtcaccattgaaccttctgaagagcctttatttnctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagcccggaaactatgggatgtgttggcaagaaccgtatagccccaagatttctctacatttgggccaaatgctcgtatctcaattgatggggagggagaaccaggcancccaatgtggttggccncgataaccaaanggacccaaagaaccccgggaaaggaaancaagttcttccagtgcttgattgnaaccg

SEQ ID NO: 7864 - DNA, 675 bp, Homo sapiens
  misc_feature 547, 660, 675: n = A,T,C or G
tttcgaagatgaagaagttctcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcangttaaagcaggtgaagccttgaaaggaaaggtcacaggttcacaagaataagaaagatcccccgttctctccccggaccctcacgttgaataaattcacctcaaacttatggncttccagtggaaacn

SEQ ID NO: 7865 - DNA, 661 bp, Homo sapiens
  misc_feature 3, 7, 9, 10, 11, 12, 14, 16, 18, 20, 337, 429, 447, 565,585, 600, 604, 610, 658: n = A,T,C or G
ttntcgntnnnncnancnanaaaacatctggtttttgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagangaaatttctgacctgtcgatcacaccaccatcctgtttgcagccgaagtgttttacgacgaccacttgactgatgctgtgtttaaaacgctnttccgactcgcccacaanattgaaaaatgcctgccagccatactgtcggtggagaaaaaggctcaacttcacacttgagacactttggacgtcacatgtgaagcctacgaataactttcgcttcttgcttcacccnctggacaacttacaaatggnagctgcctttttggngganccccgnggaggcctccttccccagtctggttacaaccccttcacaactggactntga

SEQ ID NO: 7866 - DNA, 676 bp, Homo sapiens
  misc_feature 27, 30, 33, 36, 41, 542, 570, 576, 578, 580, 586, 587, 588,589, 591, 592, 593, 594, 595, 596, 597, 598, 599, 601, 602,603, 604, 605, 606, 607, 608, 609, 610, 611, 612, 613, 614,615, 616, 617, 618, 622, 624, 625, 626, 628, 630, 631: n = A,T,C or G
  misc_feature 632, 633, 634, 635, 636, 637, 638, 639, 640, 641, 642, 643,644, 645, 646, 647, 648, 649, 650, 651, 652, 653, 654, 655,656, 657, 659, 660, 661, 662, 663, 669, 671, 674: n = A,T,C or G
tttcatggaattacttttcttctagantantanctntcttnccactctcacttgaacccactccaaccaggcctccccatctccatgaacctgatcttgtcagagtcacaaggacctccacgatctccacattgctaaccaaatggtcaatgttcagtcttcatcttattcagctcatcagcagtccataacttcctcttccttgatgcatattcttcacctagcttccaaaacctatacttctcctggcttttctctgccttaccagtaatgccttactggtctcgttgctggctccttctcttctgccccactttatgcacagaaatgccctagacctgccctttctctacctatactcaccctctactgcttgtgagcatcttgcggtcagctctccacctacccagccccctgcagtttgagctcaatacctgtttgttgaagtgcactgagtccggaaagtcggttctgtcagtgagcttctacagaaaggaaagcctttgaaaattttttttgagaaaagaagacggggcaagaangggggcccggaataaaacactgcactcncttccnananaaaaannnnannnnnnnnntnnnnnnnnnnnnnnnnnnaaanannntnannnnnnnnnnnnnnnnnnnnnnnnnnnncnnnnnttaaantntcncg

SEQ ID NO: 7867 - DNA, 636 bp, Homo sapiens
  misc_feature 19, 21, 465, 619: n = A,T,C or G
ccgttcctgatggagctgnanagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaaccagcaaccagcatctgttaatctaaaaagtgagtcctaaaagangacgacctgcagcttccagaaagtcaagattccaaaaccaagaggcagacccaaaatggtaaaacagccctgtccttcaagagtgactcattactgaagaggacaaaagtaagaaaaggggcaagaggaaaaacacctaaaagcacctaaaagngaaaaggccaaaggaaa

SEQ ID NO: 7868 - DNA, 906 bp, Homo sapiens
  misc_feature 2, 4, 5, 6, 8, 10, 12, 15, 16, 17, 18, 19, 20, 21, 23, 25,27, 28, 30, 31, 32, 33, 35, 36, 37, 38, 39, 41, 42, 43,45, 46, 49, 50, 52, 54, 56, 57, 58, 59, 60, 61, 62, 63,64, 67, 68, 69, 70, 71, 72, 73, 74, 75, 76, 81, 88, 91,94: n = A,T,C or G
  misc_feature 100, 101, 102, 103, 104, 106, 107, 108, 110, 111, 120, 125,136, 139, 142, 143, 144, 145, 146, 148, 149, 153, 160, 175,188, 190, 236, 260, 746, 753, 776, 786, 847, 897, 900, 906: n = A,T,C or G
tntnnntnanantannnnnnnancncnntnnnncnnnnnannnannttnnancntnnnnnnnnngannnnnnnnnntgganattcatnatncancattcnnnnncnnntnnttccccccnccccnttccccccccnccntcnnnnntnnaaantttttanaacaagggggcatantatgaatgctacncnccctgtagattctgaaaagttggccatgttagaggaagtatttgtnagccttgaaatctccttcaaaagngaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaattaatcactttaagtctttggggaagcaagtgattttgaaatttttgagggtgacaggcttttaaagggataattttgtancattggnttggcaatctacaacatgtgggncaaattccancctggctggctggttttaatatacccctgtaagctaaaaatgggttcccgcatttttaaantgggtggggaaaaaaaaatcaaaagactaattaatttcatggaccgtggnaanttatcn

SEQ ID NO: 7869 - DNA, 734 bp, Homo sapiens
  misc_feature 3, 6, 43, 47, 62, 64, 76, 86, 91, 108, 114, 124, 125, 128,130, 133, 140, 141, 147, 154, 156, 158, 166, 175, 176, 178,186, 191, 192, 195, 199, 205, 209, 215, 217, 237, 249, 252,253, 257, 262, 265, 275, 280, 281, 282, 288, 292, 297: n = A,T,C or G
  misc_feature 299, 301, 305, 306, 309, 314, 322, 325, 327, 334, 350, 351,353, 354, 361, 365, 369, 384, 385, 387, 389, 390, 391, 394,398, 405, 407, 410, 412, 429, 449, 459, 492, 493, 496, 497,500, 501, 520, 526, 542, 548, 552, 553, 555, 558, 608: n = A,T,C or G
  misc_feature 618, 623, 636, 639, 640, 643, 648, 649, 656, 666, 667, 669,674, 675, 677, 681, 684, 686, 687, 688, 689, 690, 691, 692,693, 694, 695, 696, 697, 698, 699, 700, 701, 702, 703, 704,705, 706, 707, 709, 710, 711, 712, 713, 714, 716, 718: n = A,T,C or G
  misc_feature 719, 720, 721, 722, 723, 724, 728, 729, 730, 731, 732: n = A,T,C or G
acnttntcgaattcccacgagagcacaagtagatgtaaaaaanaaanaaaaacccccccccngnggaaagaccctntttaggtttngtttngtttttttttgggtttngttttnggtttttttnnctntnggnaaacccnngccaangggccanancncctatccngattttttnntnagggcccntttcnnaanaatngggtcnaccnggaaangnaaaagggggggggggggggnaaaaaaaaaaanctnnggcnttggnggntttaaaaaantttannnccattngttncaaanancncaannttnaaaancaaaaaantcncnccccaancaacccaaattttaanngnncaaattnggcncccnaaaaaaacccccctnncntnnnttntttnggggcantnttnancccccccaaaaaattgncccaaaggggtttaaaaaantaattttccnttaaaggtaaccccttccccccaaaacagcaannttnnggnncttttttggatggcaaccnggatanttaattgttcaaccantttganaaannanccntttggaacctgaaaaaaaaaaaaaaaaaaaccccccccctttaaaacttntggggggggnttttnccggaaccccacnctnnaanaaaanntttgggngggttggggnncnccccnntnttanaantnnnnnnnnnnnnnnnnnnnnnntnnnnnntncnnnnnnntctnnnnntc

SEQ ID NO: 7870 - DNA, 536 bp, Homo sapiens
  misc_feature 2, 3, 8, 525: n = A,T,C or G
gnnattanatcaactacttgttctttttgcaggatcccatcgattcgaattcggcacgaggtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagaccanccaaaaaaaaa

SEQ ID NO: 7871 - DNA, 1014 bp, Homo sapiens
  misc_feature 1, 2, 16, 18, 38, 44, 46, 53, 54, 56, 61, 62, 64, 72, 74,78, 81, 82, 87, 102, 108, 138, 142, 152, 154, 169, 178,182, 186, 187, 193, 203, 206, 212, 213, 216, 217, 222, 223,237, 239, 242, 244, 251, 252, 255, 256, 261, 265, 267, 270: n = A,T,C or G
  misc_feature 272, 273, 274, 277, 279, 280, 281, 287, 304, 307, 318, 321,325, 327, 329, 330, 336, 343, 352, 354, 355, 364, 375, 378,381, 396, 401, 408, 409, 410, 414, 415, 420, 425, 429, 431,437, 450, 451, 452, 457, 463, 465, 466, 475, 479, 480: n = A,T,C or G
  misc_feature 485, 498, 508, 515, 518, 526, 529, 539, 543, 553, 554, 555,566, 568, 579, 580, 595, 599, 604, 609, 623, 628, 634, 640,654, 661, 666, 681, 699, 713, 714, 727, 730, 731, 735, 748,752, 753, 755, 757, 758, 764, 772, 786, 788, 789, 790: n = A,T,C or G
  misc_feature 804, 810, 823, 825, 827, 828, 829, 837, 839, 846, 847, 848,849, 862, 864, 872, 879, 880, 883, 889, 893, 894, 900, 906,912, 921, 929, 937, 940, 942, 957, 963, 975, 976, 982, 992,1012: n = A,T,C or G
nntacgatccctattntngaaaatataatttgacaaantccttncncttcttnnanactanngngaagggtnantganggnnttccnactatagtgtggagntcctcnccctgaggtgggtacagaaatcaattgccncctnatgggggttnanaataaaaatagtggngcacaagcncatnggtnnccaaancccttcctanaancacaanncanncgacnngccacaccccgatncnttncntcacacnnatnnttccntaanancanannntcnannncgtcanctctatctaaaaccatnctnttaacatcttnctnaccnantnntcactnaaaaaanccaccacgnanncacgtttanaaccccatctnaantgnactctaacaccaatnaatantaacaannntatnntttcntctcnctananaatatnccatcaattctcnnnaactncctcantnnacatactantctnnagacnttatacctatttntctatacttncccactntancttatcanacncaccattctnctcntctccttacnnntatatatcaanancacatcttacnntcatcacggcactanatanccacntcacnacctctcaccatancgacntatccnattaantaacactccgagtncaacatnccgcnaataaaagaataccntctgaggtatcttattanatatttatcacatnnctacgcctatccnacnntcgnagcataccccttntatnntngnntcactnctataatnccatcatctaaacncnnnatcttacactcccncaaacnaatcaactctatntnannnataatatnanacacacnnnnactctttttcctncntaattctnaacatcnnctnacatgntacnnctaaanactctnaactanagacccctntactactncacctctncantntacacaacctatctntactcncagctcacctgnnataacnttactttctnccatcttcttataactcttncg

SEQ ID NO: 7872 - DNA, 716 bp, Homo sapiens
  misc_feature 482, 483, 495, 509, 515, 527, 535, 538, 539, 544, 546, 564,566, 578, 588, 603, 613, 621, 627, 640, 645, 665, 668, 675,685, 687, 688, 690, 691, 692, 693, 694, 695, 696, 698, 700,701, 703, 707, 716: n = A,T,C or G
agttccttggctgttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttcctttttttttttttttgaaatggccaaannttttatccttcntgatggggggttantttttntgtgaaaaaatnaaaatggnttnnttttnanatttaaggggaaaggccncntcccccaaaggntttccaattntggggtggagccttnggaaaaaaangccttttncaaggnaccttcccctttnaaaancctgttttgggctttccaanaanggattgnaacctcaaananngnnnnnnnananncntttncctttcccn

SEQ ID NO: 7873 - DNA, 928 bp, Homo sapiens
  misc_feature 2, 3, 10, 25, 47, 54, 71, 72, 76, 79, 80, 89, 103, 104, 106,113, 114, 116, 128, 130, 131, 132, 135, 136, 140, 143, 144,156, 158, 160, 171, 172, 174, 181, 188, 193, 198, 199, 214,233, 235, 239, 240, 252, 259, 268, 273, 288, 289: n = A,T,C or G
  misc_feature 294, 298, 304, 309, 316, 332, 333, 334, 335, 337, 340, 352,358, 411, 422, 432, 447, 478, 508, 511, 516, 520, 526, 536,563, 565, 571, 583, 591, 596, 601, 606, 624, 652, 666, 678,683, 721, 743, 749, 759, 793, 806, 815, 836, 860, 869: n = A,T,C or G
  misc_feature 870, 888, 913, 921: n = A,T,C or G
cnnaagactntttggaaaacccgtnctttttgcaggatcccatcgantcgaaanttggaccgggggaaggnntacnggnncccagaaanttttttttgggggnncnggggccnngnaggggggggtgntnnnttnnaaanttnnaaaattttccantntngggatgggganntngggattnggttttntcctngggcnnggccttaaggaaaangtggaaaatggccttaaanantccnnggccttcttaanaggagcntttaatttnacagnggcaaggggctggtnntgganaacnggttgnggctntgaattntttaatatacccaccnnnncnttnggcttacactgnacaatnggagatgttggtacagggtccctgagatgcaatcaagaattaagccgtagccnaggcatttggnccaatggggnaaaggttcaaaaatnaaattttattttttttttttccccttttttnccccccttaaccccccaattccccccaggnccnaaagnaaanttttcnttttttttcnaaaggaaaaatttcggggccaattccnantttccntttaaaaaaccnaaaccaantttcnttttnaaaancccccccccaagggcttnggggggggttccccccccaatttttttnaaaataagggaaangggtccaaattnggggntttcaaagggtctttaaaaccgggggggccccgggggnagggggccctgggtttttggangggggnaaaaaacaantttaggtttttgggaaaaaaatacccccgggttnccccttttaattnccactgggnccttgggttctttccaacgtnggggaaatggtgcctttggggggnccccttcannaaaagaaaagtctgggtngggcttcctaaaggggttggggggngggggganacaacct

SEQ ID NO: 7874 - DNA, 1173 bp, Homo sapiens
  misc_feature 40, 41, 43, 44, 47, 54, 55, 56, 57, 61, 66, 67, 71, 74, 76,79, 86, 87, 90, 100, 103, 115, 123, 125, 126, 127, 129,130, 142, 144, 145, 150, 153, 154, 163, 175, 177, 180, 182,183, 204, 207, 220, 228, 237, 241, 246, 249, 255, 256: n = A,T,C or G
  misc_feature 270, 273, 274, 276, 277, 280, 281, 284, 285, 291, 297, 302,303, 304, 305, 309, 315, 316, 320, 321, 323, 329, 341, 344,354, 355, 356, 361, 363, 364, 365, 366, 377, 385, 389, 390,395, 397, 399, 400, 401, 402, 404, 409, 412, 413, 414: n = A,T,C or G
  misc_feature 416, 420, 426, 428, 431, 432, 434, 444, 453, 454, 461, 472,488, 492, 495, 496, 498, 504, 513, 515, 516, 523, 526, 528,531, 533, 534, 536, 538, 544, 550, 553, 555, 562, 563, 565,570, 584, 589, 591, 596, 598, 600, 601, 604, 608, 609: n = A,T,C or G
  misc_feature 612, 614, 615, 618, 619, 626, 630, 636, 653, 656, 668, 679,684, 688, 692, 697, 698, 710, 712, 716, 731, 732, 734, 736,741, 742, 745, 754, 758, 762, 767, 771, 779, 782, 790, 792,795, 796, 798, 802, 808, 809, 819, 823, 825, 833, 835: n = A,T,C or G
  misc_feature 843, 844, 845, 848, 858, 868, 873, 879, 880, 884, 887, 888,889, 891, 893, 900, 902, 905, 910, 911, 928, 929, 932, 933,938, 948, 952, 961, 962, 966, 968, 969, 974, 979, 990, 992,994, 1006, 1013, 1022, 1025, 1026, 1030, 1034, 1037: n = A,T,C or G
  misc_feature 1041, 1052, 1056, 1061, 1062, 1068, 1083, 1090, 1098, 1101,1107, 1111, 1113, 1116, 1117, 1120, 1121, 1126, 1129, 1143,1145, 1147, 1158, 1159, 1164, 1168, 1173: n = A,T,C or G
cgaatcctttgcaactacttgttctttttgcaggatcccnncnnccngaggcannnnaggnggagnngacnagngncangacgggnnttntaattgatanaanaagcccccgccncacgggtntnnntnngggccggggccnanngggcnatnngccaaaaanaataactccaantnccngnnagaacatgacccggaccatcnaanggaaaatgaaacnacacaaanccagactcnaccntggcncanccctcnnagaagccccaagantcnngnnccnngcnncggganccgagnttacnnnngaangcgggnnaacnngngcccgnagccccaaggcntgncacgtggcannnggctncnnnncaaacaaaaancaacccgnaagnnctccnanannnncncccangannncnaaanccaagntnctnncncaacccttanagccccccnncaaaggncacgcactggngggaactccaaggggncganggnngnctcttncgacacccnanngcacccnacncnagnannancncgaggnctatcncancnttggggnnanaaggnagcacggcaacccnctagnanaaaangnanncanactnncanannccnngggtatncacnccaaanactcacccgagaccccntcnagaagcccaatnccctaacacantgggngcanaccnaaccnncgtacaacagcncnacgnaggggctcacggganntntnggaannganaggcacagngacncgcncagtntggngcccacanccngtaaaccntntanngntggngaggcnncgcgcatacnggananccgacttncncaccactnnnctntcggaatcgnaacgccctancacgncaaccnnggcnacnnncnangggaaananagnggganncacccaccaccggggannacnnacagnttatcgcgcncgcnacattgggnnaggngnntcacnataangcccaccctcncncnatactcacagtncaatccntacacaggncanngcanaagnggnaacngaaatgcgacncagnccganncaaaanggggggggggcaacnggcacanaaagcggnganacccantaangnggnnccnncaccncgnggataataatactntngnaggtacacacnnaaatncggnaaggn

SEQ ID NO: 7875 - DNA, 728 bp, Homo sapiens
  misc_feature 3, 9, 20, 28, 29, 33, 36, 38, 42, 49, 65, 355, 378, 488,561, 626, 642, 653, 659, 678: n = A,T,C or G
agnttttcnattcgcacganataaaatnnatgnggngngganaaaattntaattttgaaaaaatntaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctactcatcagccatttcgttctcccttccttgctgacaaagccccattttttttttctttttttttggcctaaaactctgtatggctgccttgtgctatanaatagggtgcttccctagcctanagagggtgagtgttgattagattctgtgccaatcatggtaattggcttacttgatcatttgatggaatctaggctaacgagacaaaggaagtctgaaggctttgaataanaaattttctgtgctcttaacaattgatacaagttagggatttgccagcatccctcttctgcttctcagtgaanatatgtgatatggatgtttgaagctaatctgcacagccttctgatggccatgaaagggacaagtntggagatgaaaagctntcacactgganaatagngggatgtaaaaagaaaacncctgaattgggcctctgaattaaccaatcccaggaactggtttcctttgg

SEQ ID NO: 7876 - DNA, 685 bp, Homo sapiens
  misc_feature 1, 2, 3, 14, 21, 24, 499, 516, 533, 594, 601, 631, 646, 679: n = A,T,C or G
nnnactatacgatncctattntanaaataggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaaganctgatgggcctcatcanggtgacattcaccccanggcacctgccactcttggccctcagcattattccatttggaatgtgaatgtggtggcaaantgggcanaagacccccctgggaaccctttttcctcantagtggggagactanccctaggtcccacttggttttatatctgaccanacagat

SEQ ID NO: 7877 - DNA, 1230 bp, Homo sapiens
  misc_feature 3, 8, 9, 10, 11, 12, 13, 14, 15, 16, 17, 19, 20, 21, 22,23, 24, 25, 26, 27, 28, 29, 30, 31, 32, 33, 34, 35, 36,37, 38, 39, 41, 42, 43, 45, 46, 47, 48, 49, 50, 51, 52,54, 55, 56, 57, 58, 59, 60, 61, 62, 63, 64, 65, 66, 68,69, 70: n = A,T,C or G
  misc_feature 71, 72, 73, 74, 75, 76, 77, 78, 81, 82, 83, 84, 86, 87, 89,90, 92, 93, 94, 95, 96, 97, 98, 99, 101, 102, 103, 104,105, 106, 107, 108, 109, 110, 111, 112, 113, 114, 115, 118,122, 124, 125, 126, 128, 129, 130, 131, 132, 133, 134: n = A,T,C or G
  misc_feature 135, 137, 138, 139, 141, 146, 147, 148, 149, 152, 154, 156,160, 163, 164, 166, 169, 170, 172, 173, 174, 177, 179, 180,181, 182, 183, 184, 185, 186, 187, 188, 189, 191, 192, 193,194, 195, 196, 197, 199, 207, 209, 211, 212, 214, 215: n = A,T,C or G
  misc_feature 217, 218, 220, 221, 227, 231, 234, 235, 236, 237, 238, 239,240, 241, 242, 243, 244, 245, 246, 247, 248, 249, 250, 251,252, 253, 254, 256, 258, 261, 267, 270, 277, 296, 298, 308,325, 328, 333, 351, 352, 356, 369, 372, 396, 422, 461: n = A,T,C or G
  misc_feature 464, 482, 485, 491, 493, 504, 511, 521, 522, 524, 527, 531,547, 550, 555, 556, 558, 559, 560, 561, 564, 574, 586, 595,607, 613, 617, 630, 640, 648, 650, 651, 652, 658, 659, 660,669, 671, 677, 680, 684, 686, 690, 691, 699, 708, 715: n = A,T,C or G
  misc_feature 722, 730, 732, 733, 740, 744, 746, 762, 766, 783, 790, 796,814, 821, 824, 826, 828, 829, 830, 834, 840, 842, 845, 848,850, 851, 862, 867, 872, 876, 877, 879, 880, 883, 887, 889,890, 891, 893, 894, 897, 899, 904, 905, 907, 908, 912: n = A,T,C or G
ccnccccnnnnnnnnnntnnnnnnnnnnnnnnnnnnnnngnnncnnnnnnnncnnnnnnnnnnnnntnnnnnnnnnnncannnncnngnngnnnnnnnncnnnnnnnnnnnnnnnganaggngnnngnnnnnnnncnnntngggannnncantntntgangtnntntanngnnntcntnnnnnnnnnnnannnnnnncncgccgccncncnnannanntnncccccnctcntannnnnnnnnnnnnnnnnnnnnangntancgaaantcngcacggnggtattcatcttcttgttntnctgccggtcncaaggctaacccccagnatngtagntggccttaatatcaggtnngacngtgtgaaatgttntanggggtttttcaagaggaaaagttntaggcttaaaactgactggtaaaaanagaatatttctttgtatttgatttttcagttatatgctngtnccagccagttatccttcngtnaggtgntncggtttgtaanaactgcncacatttggnnanatntcgncgccgccttcatttgncangaacnnannnntcnctttgggttnccccaatccccnaacttgttnaaaccatttggncattanaaancatgtcctggttntaaccctgantttttacntnnnccggcnnnaaccaaacntntattcnacntggnangtcnnctttagancttcttctncccgcantgaaaanaaccgggngnntggggtntgananctatatagggggttcnttcntggccccttcaccgggnggtgaanctcgancttgaaagagcccccccncatatanctntncnnnaggngggggngnttncgncnntgaaaactatnccacntcctnttgnngnngtngctngnnntnnacnanatcgnngnnttgngnnatgcgnnacanccatngaacccncncaacnnctcngtatttatanctcntncacnngntctancctcncgnctcnttnctcccaggangnaantctncagtananaanntccttngntagnancannngnnatctcnggtancctancnnggggngggaagacntctttgntctgctnattanacaaaanatatanacacngccgcgnttcttnctaaaantctntagcancgaggctccctntcaantanaggcgtcacctcntcnaactatacnangggngcnactntcccctgncgcangcatctntggcca

SEQ ID NO: 7878 - DNA, 1450 bp, Homo sapiens
  misc_feature 2, 3, 7, 10, 11, 12, 13, 16, 20, 21, 25, 26, 28, 31, 32,34, 39, 41, 42, 43, 45, 49, 51, 53, 56, 58, 59, 64, 65,67, 68, 69, 70, 71, 73, 74, 75, 76, 78, 80, 81, 82, 83,84, 85, 89, 90, 93, 97, 99, 101, 102, 104, 106, 108, 114,116: n = A,T,C or G
  misc_feature 118, 119, 120, 121, 122, 125, 127, 134, 135, 137, 140, 147,151, 162, 169, 171, 172, 174, 175, 176, 178, 179, 184, 193,196, 197, 198, 200, 209, 215, 217, 218, 219, 220, 221, 222,223, 224, 225, 226, 229, 230, 231, 239, 243, 246, 261: n = A,T,C or G
  misc_feature 267, 270, 273, 292, 299, 300, 302, 303, 305, 308, 311, 312,325, 331, 335, 338, 346, 348, 349, 350, 356, 357, 378, 385,388, 391, 392, 394, 400, 401, 404, 405, 408, 409, 418, 426,429, 438, 439, 441, 445, 449, 450, 469, 476, 477, 479: n = A,T,C or G
  misc_feature 484, 488, 490, 503, 506, 508, 509, 512, 515, 518, 532, 534,538, 553, 555, 559, 573, 575, 576, 583, 597, 600, 601, 605,606, 607, 609, 616, 618, 621, 622, 627, 630, 633, 635, 639,640, 642, 653, 655, 657, 659, 663, 665, 666, 669, 678: n = A,T,C or G
  misc_feature 680, 685, 687, 693, 697, 699, 707, 709, 710, 712, 716, 720,725, 733, 737, 743, 748, 751, 756, 760, 763, 766, 776, 778,783, 788, 789, 790, 794, 795, 799, 811, 823, 826, 845, 855,856, 857, 861, 863, 870, 877, 881, 886, 888, 890, 895: n = A,T,C or G
  misc_feature 899, 900, 903, 913, 915, 935, 936, 938, 942, 945, 951, 953,960, 966, 968, 969, 972, 977, 985, 990, 994, 999, 1001,1010, 1013, 1043, 1045, 1048, 1051, 1059, 1062, 1064, 1065,1074, 1075, 1077, 1082, 1088, 1090, 1091, 1096, 1101, 1112: n = A,T,C or G
tnnttgntannnnccncttnngttnntnttnntngcttnannncnttcncncntcntnnttttnntnnnnntnnnntntnnnnnnttcnnttntacntnanntntngntcttgntntnnnnntangngagtggnntntcntctcccntttngcatatctatntattctntnntnnntnngcccnccccctccnttnnncnccccccctnttctcntnnnnnnnnnncannntgaacagnttgnggnagggggctttctttntctccnttnggncccccccttttgttttttnttcctanntnntntanatnnctggtatgttttncggggnctcntcnttttctantnnngggggnnttttttacctttattcttccncccttanctntcnnantctccnntcnnttnncactttctntctccatntantcttttgtnntntttntttnnctcgacattcttcttttcnctatatnntntcttntctntnttctctattattntcntnntanttntcntcatattttatctncnttanttactctcgagtctntnactntctttcttgttctncnnttccatnttcctatcctttanttnncatnnncnttacttntnttnnttctntgnttncncttnntnctctcttttancntncncttntnnttnatattttcnanctaantnactttncatncngtttattncnncnactntgtnttttnttcctttnttcntctccnttctntcnccttntccntancgntcgtcttctntntcttntcctnnncttnnatcntctctatatctngtttattctctntcnccgtcattagttctctctnttctctcttnnntccntngtttctntatatantctntcctntntntactntacnnatntcatctttcntncactttctcgctcttcacanntnttanacngttctntntttctcnataccntnntcntcgtnttttctantcccntctntatancntctgttcanctntattgtatctcttatttttagctccttttntnctnatnctctccangtntnntctatctanncnctccnctcacntnnctttntcatnttctccctctntctatntatntcactatatttgtnntacgcttctttnttcttcctacactcnngtttttncntctttacnctcntcttcnttnttgcttctctcttcttcnatnctccnctttcgcgctctcntncctnngatcattctcntgctcctcntatatctnttctcactatctccatnttacttgtctctcgcntgtntcagtcttcactncnntactcttnnattnctccacttttattntcgcatctcctatntatctcgctnntantctctntcttttnatnnatctcttcttttatntncgtagtctctcntntcnnttctttntacttctcctncn

SEQ ID NO: 7879 - DNA, 700 bp, Homo sapiens
  misc_feature 17, 599, 677, 689, 695: n = A,T,C or G
aaatcgataaggaaaancgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttaaaactcctagcccacggggaagaatagangtatcatcaaacgtggcaaattttctttcaggaataataaagagcatgattccccaaaaaaaaaaaaaaaaaatccgncccttaaaactntagggngcgtt

SEQ ID NO: 7880 - DNA, 1144 bp, Homo sapiens
  misc_feature 4, 5, 9, 12, 15, 19, 20, 23, 24, 29, 62, 70, 72, 78, 96,103, 117, 142, 143, 145, 151, 155, 156, 159, 177, 184, 191,192, 196, 197, 198, 199, 202, 204, 228, 245, 254, 255, 257,258, 270, 274, 275, 279, 282, 283, 285, 289, 293, 296: n = A,T,C or G
  misc_feature 301, 305, 307, 309, 310, 316, 325, 329, 332, 335, 344, 346,352, 361, 369, 370, 376, 378, 385, 392, 395, 397, 400, 401,404, 412, 418, 424, 430, 431, 434, 435, 445, 447, 450, 452,453, 455, 458, 465, 468, 475, 476, 481, 484, 485, 486: n = A,T,C or G
  misc_feature 487, 493, 496, 501, 503, 507, 508, 530, 531, 532, 536, 546,547, 557, 562, 564, 566, 568, 573, 582, 583, 585, 586, 593,597, 605, 606, 610, 611, 615, 620, 622, 624, 642, 643, 646,654, 658, 669, 671, 673, 683, 684, 691, 709, 710, 717: n = A,T,C or G
  misc_feature 725, 728, 730, 733, 735, 738, 740, 744, 746, 748, 761, 769,770, 793, 795, 797, 800, 803, 811, 818, 822, 828, 829, 848,851, 852, 853, 854, 872, 876, 877, 879, 881, 884, 900, 905,911, 921, 928, 930, 936, 947, 951, 961, 965, 968, 975: n = A,T,C or G
  misc_feature 978, 981, 986, 988, 1001, 1007, 1012, 1013, 1021, 1022, 1031,1036, 1037, 1041, 1059, 1062, 1065, 1066, 1075, 1081, 1084,1092, 1103, 1105, 1106, 1118, 1119, 1120, 1123, 1126, 1128,1135, 1136, 1139, 1141, 1142, 1143: n = A,T,C or G
gagnnacantgnggnactnntcnntttcnttttttgccaaaaggaccagtatcataggtgtntcttgagngngaaaangagctatttcctgggggnttcttcnctatacagcggagntctgtccctgaggaggctacaatanncnaggtcnctcnnctntgcaagaaaataatactngtggganccgatanncttnnnnctngnaatgtcctgtctcaatagtcccanagaggtaaaaaaaggangaatttctnntnnactttatctggncatnngaanganngnaatnaatncanaaaantgcnanannttaccntcttgaacngggngancanccaaaatantntatttnttactcggngaataacnntttatngnctcttanaagccanatngnttnnggnaatattgnggggtnaccttnccacannggnntaaattcacngngtngnncnaanccccttnggnatctttnncctcnacnnnncgcttnggncaccnantatnntccacacttaattcttggtaannncttnttccggcagnntctatacgtnggctntntncnttcantcgcgatanntnncactttntttnacttctcnnaatnntcanactancncnctaatacttttaacgagnnganacactaantgtntttatcgaatntntnaaatacgtannatctttntctttatcactcatatgnntattttntacccccngtntnatntntcntncctntncnccccccgtatgantcaccctnnatctattcggcaactttacatcnanangtntgntgtccctnctctatntaanaaacgnnctcactacttcatcccaantannnncattccaccctcttagtnaaanntntnttngataaaatatgcttgnggtgncgggtncacaaaaaanatgtttngnggtccnaaaaatattantaancccccccctnaccnccngtgtgtnttnaancactntnttcattttctgcncccatntctcnnctcgtatnnatcctatcngcggnnctantatctttttagtaggtancanctnntatggtctntctctngantcactcantgggtgactancnntaatttaattcnnncgngcncntctcccnngtntnnnc

SEQ ID NO: 7881 - DNA, 702 bp, Homo sapiens
  misc_feature 676: n = A,T,C or G
atgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtaagtgtagggccaacatacaaagctacccagtctaatgtgtatagtagactttggggaaaagcgaatttttttcatgtattcattctgaatagttgaaatgtatatttgtacagtcttttagacctattcaagtgatgctcatgatcctgtactggngtgcccatcataaattctttttttta

SEQ ID NO: 7882 - DNA, 723 bp, Homo sapiens
  misc_feature 2, 3, 551, 611, 615, 680, 696, 709: n = A,T,C or G
anntttcgcattttttgcctttacaaaaaggcattttgttatactacagtgtaaacctcatttttttcactccaaaaggtagcagcccctcttcttcccaccctggacctgcctttcactccctgggcacagagcgcatggtaccattgatgtttggtttattccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcaaaagtgttatttcatgaatcattcatatgatttgatcccccangattctattttggttaatgggcttttctactaaaagcataaaatactgaggctgatttantcanggcaaaacatttactttacatatcggtttcaatacttgctggtcatggtacacaagctttttacnggttttttgtacaatnaatattttgagtnaaaaatgggtacat

SEQ ID NO: 7883 - DNA, 763 bp, Homo sapiens
  misc_feature 1, 2, 5, 8, 9, 10, 11, 39, 40, 45, 57, 198, 257, 356, 366,409, 426, 435, 541, 551, 588, 608, 614, 623, 630, 654, 656,667, 668, 676, 677, 701, 715, 748, 753, 757: n = A,T,C or G
nngantcnnnncgagaaaagtctcccaccttttctcctnnaactnctctcctttctntccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttanatataagttcctgcagtatttattagatagttgtacctgtaaactcacctccctagtanataagagtttcaggttaaatactggaacatatataggcagtcaaaaatactctttaaatgtcattcacctatttaaagccatgttttagcactttttangccaaagaangtctgatagtgcctgtttttatgttctgtactctcacaaactntgttactcaaaattatngcatggcangagagattggattatttatttcctatatctttataaagtaaaaaaatctttctaaacaacaaatcctaacattattactggattgtttcctaatttatcctccctnagttgaatgntaacaaagcttttccagctgaatggaatgcaccttanctgataaaccagaatttggncctttnttttccctnccttttntttttgagacaggttctcactctntnacccgaaggtnngagtgcannggttttgatcataaccttgactgnagccttcaaccttntggggctcaaatggatcctttcacttaagcctnctggngtangttggg

SEQ ID NO: 7884 - DNA, 1024 bp, Homo sapiens
  misc_feature 2, 10, 12, 20, 44, 53, 59, 61, 63, 74, 82, 88, 89, 90, 99,101, 102, 112, 116, 127, 131, 132, 139, 152, 156, 165, 169,176, 188, 219, 225, 233, 237, 246, 250, 252, 260, 266, 275,278, 293, 299, 304, 314, 340, 342, 367, 373, 374, 375: n = A,T,C or G
  misc_feature 391, 394, 395, 396, 397, 398, 399, 438, 445, 446, 466, 467,471, 473, 481, 496, 497, 505, 508, 509, 517, 542, 570, 577,605, 609, 611, 612, 620, 635, 642, 657, 662, 668, 676, 681,690, 696, 697, 702, 720, 723, 730, 733, 741, 744, 746: n = A,T,C or G
  misc_feature 752, 759, 760, 767, 790, 802, 850, 869, 870, 872, 885, 886,890, 896, 899, 904, 905, 926, 932, 934, 936, 941, 949, 957,973, 979, 981, 996, 1013, 1017, 1019, 1022, 1024: n = A,T,C or G
gnttaatacnanatactcancttgctgcctgcaggtcccatctntcgaattcnggcganangntgggaataaantgccttgnggattnnnctccattgncnntttggcaccnaaangtttttattcnaaannaaggaantttagttcttgtnaatncaagcttgnaaanaggcccncactggggtggnccaattgcatttaacttgcactgaatccttnttccancttttgcnttgnggctgcttngatnantgaggganttcaantaatttgangcnctaatggtatttttnaaattnggacnttttttggancccctaagtaatggattgaataatcntngagcaagggggaacaattgccttgntttatnnngtgggggaacttcaanggnnnnnncccccaacttgggacctcaatttttcaactaatgttttncaataannttttgaaaaaaaaaacctgnngccntntttttggngggcaagggaaaggnncttttctnttnnggcttggnggaaatcaaggcaattccttgggtnccctggggaaagccttggtcaaaaacanttaaatncgggaaaaccaatttttctttttccaanaaantnnaaattggnttgggtaaaagtttntttgggnaaaaaatttggaatntggtnccaaanaaaaaaanagggnaagtttcanaataanncatantttcaaacaaggtttttnttntaaaacnaanaaaaaatnggntnaaaaanaaaatannctttcanttttcaaatttttagggaaaacntaaggttccccngggttcggggggttttaataacctttttttgacttggcttttttaaanctttagcccccttttagannanggcccaaatgccnnggtnggaagnctncaaanngggcccggattatttttttgnaccaantntntgtgnataaaaancttggggnaaaaattcccttaacntttacncnaaaaattttggcttntttttaaaaaaattggnaaantntgntn

SEQ ID NO: 7885 - DNA, 700 bp, Homo sapiens
  misc_feature 4, 10, 36, 131, 135, 154, 166, 185, 190, 208, 233, 272, 305,309, 310, 319, 327, 329, 337, 340, 356, 385, 406, 414, 420,421, 477, 496, 497, 546, 571, 605, 637, 685: n = A,T,C or G
ttanatacanctacttgttctttttgcagtaccctngattcgaattcggcacgagccctttgagatttctggctttttgtagggacctcagttccattttcccaactcatgggttctcaataccttaactntctnttatttgtcaaattccaantcctcaaaatcncccaccattacctgacccnctggnagtcaccacaccaccttncccactttcccagggatgcttatgnattagcttaaatcctcaccattctgatttgtaatgccgnccccaccccctttttttgacacctgggagttancttnnctttctggnaagatcancntcacacanacnagcacattttcttatnatactttatctagaaaacccatgtgtcantggcagaagcatcctgaattntggtagancattgnntcgctggactggaacctcctgaaacacagcagtgggaattgcttgtaatccgctgngtctatcatcaacaaaagnnaatattgtattttttcaggggtaatttaacataagaaggttaacatttnccattcaatttaaaactaaaaacangcccgggtgcggtggctcacgcctgtgatcccancctttgggaggccgaggtgggtggatcacgangtcaaggagattgagaccattctggctaacgcagtgaaaacccgtctntactaaaaaacaaat

SEQ ID NO: 7886 - DNA, 960 bp, Homo sapiens
  misc_feature 26, 28, 29, 30, 31, 32, 36, 40, 45, 46, 47, 48, 50, 51, 52,53, 54, 55, 56, 57, 61, 62, 65, 66, 67, 68, 69, 73, 84,85, 90, 91, 92, 97, 98, 110, 129, 130, 132, 142, 143, 159,165, 166, 167, 174, 186, 187, 197, 200, 201, 203, 224, 226: n = A,T,C or G
  misc_feature 227, 249, 264, 268, 269, 276, 278, 289, 295, 300, 302, 304,323, 328, 330, 354, 368, 378, 379, 380, 391, 400, 408, 409,417, 423, 428, 438, 447, 451, 465, 472, 479, 480, 486, 490,497, 512, 520, 531, 533, 534, 535, 537, 539, 541, 550: n = A,T,C or G
  misc_feature 561, 562, 573, 589, 592, 597, 598, 603, 612, 614, 618, 622,623, 625, 627, 636, 647, 669, 683, 684, 685, 694, 695, 700,709, 710, 721, 735, 739, 741, 744, 748, 755, 756, 761, 762,763, 770, 772, 786, 790, 796, 802, 805, 814, 822, 832: n = A,T,C or G
  misc_feature 854, 856, 858, 859, 870, 876, 879, 888, 889, 891, 913, 917,924, 925, 926, 930, 936, 937, 938, 939, 941, 944, 947, 951,952, 958, 959: n = A,T,C or G
gagcaagaaccctttggaaaaccccngnnnnnttanaaangaaannnncnnnnnnnnaagnnagnnnnngagngtacaacgaanngagannnaccanntttttaaagaangccaaaacccgcaaacacnnangggggagcanncgaaaaaaaagcaacngaagcnnntaaaggngaccaccacccnnggacccgaancannanggacggcaccgggcgcaagcngnncacccacccctccggatggaangcccggaaaaaaganactnncaaaaangngacggccgccnaaagancctgngnangggcaaagcccgcaacccncgacngncaaaaaagaaacccccctgcgcancaaacgaaggaccnacagcccacnnngcgagacaccngccacagangcccagcnncccccccnggcccnacacnaaagaggaanccaccgccngganccccgagcccacanccggccntgcgccnnaactcngaanagccaanactggcacccaccanccacggcngacaatcgganannncnancnaaaaacggnaaaacaatccnnaaagcgaaccnggggaaaaccccaggngcngcacnngcgcngccccaagnangacnggcnnananccgccgggnaaaaccccacnggaacacacccacaaaaagggnaccggggaacccannnaaaccgggnnaacancggcgtccnngcccaaaccgngaaccccccccccnaaangnaanacancaggggnngcgannnaagcccncnccacaccgaaagcnccanccaccnagaccncanacccccggnccgccccncaccaaaaancacataggcgggcgcaggccgnantnnacgcgcaaacnaacgcnagnaccgggganncngaaaaacaaaccggggaccgancccncgggcgnnnaaancccccnnnncnagnagncgcnncccccnna

SEQ ID NO: 7887 - DNA, 743 bp, Homo sapiens
  misc_feature 1, 3, 7, 28, 29, 31, 37, 41, 42, 609, 623, 690, 727, 743: n = A,T,C or G
ncngctngctgcctgcaggtcgactctnnangatccngggnnccgagctcgaattcgccctatagtgagtcgtattacaattcactggcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgccccctgtagcggcgcattaagccgcggcgggtgtggtggttacgcccagcgtgaccgctacacttgccagcgccctagcgcccgctcctttcgctttcttccttcctttctcgccacgttcgccggctttccccgtcaagctctaaatcgggggctccctttagggttccgatttaatgctttacggcacctcgacccaaaaaacttgattagggtgatggttcacgtagtgggccatcgcctgatagacgggttttcgcctttgacgttggagtcccgttctttaataagtggactcttgttcaaactggaacaacactcaacctatctcggctatcttttgattataagggattttgccganttcggctatgggtnaaaaaagactgattaacaaaaattaacgcgaatttaacaaaaattaacgcttacaattctgagccgnatttctcctaccattggcggatttacccgaatgggcntctagacaattgttgn

SEQ ID NO: 7888 - DNA, 921 bp, Homo sapiens
  misc_feature 2, 4, 11, 19, 24, 26, 30, 39, 42, 44, 52, 64, 68, 71, 76,79, 84, 85, 86, 87, 99, 102, 103, 113, 117, 120, 125, 130,133, 134, 137, 138, 139, 141, 143, 149, 150, 152, 154, 164,166, 167, 168, 174, 182, 183, 192, 194, 195, 198, 208: n = A,T,C or G
  misc_feature 214, 224, 231, 237, 239, 249, 252, 257, 262, 266, 272, 279,283, 290, 292, 293, 301, 308, 309, 319, 334, 341, 342, 354,357, 363, 384, 396, 400, 408, 419, 426, 432, 440, 441, 447,448, 449, 451, 452, 453, 454, 475, 478, 500, 522, 568: n = A,T,C or G
  misc_feature 596, 597, 620, 629, 632, 650, 653, 695, 708, 720, 728, 733,762, 776, 796, 808, 809, 811, 812, 813, 820, 824, 828, 829,832, 841, 842, 847, 849, 860, 862, 899, 909, 918, 921: n = A,T,C or G
gncngaccctntgcaaacnactcngngctntttgcgggnggnanccccaacngaacccgccttnaagnggnggctnctnccaannnntaacccgggaanaanntttttttttnacangancgaanccaanggnnaannngngngaaagnntnantgggaaaagnannntaaaancaataacnntttaaatangnntgnaaaaaaaaantggggnggacaaattnttaaggncaaaantntgggcccaanaanttaancaaantggnaaattntcctggnggtnggggaantnncctcttanggaaatnncgcccaaggnttcctaacaaacggngccaagnnaaggggcgggcnggnaggctncatgggggacatggggggacntctggctcaagnctgnggacccgnaagggaagatnaggatgntggtcngggggcanntaattnnncnnnncggtttaatataattcaactnggngggaatacctaatgccaatggnaaaataagaactaattttttanaaaacttttacatgcttgggttaaaattcagaaagggaaaatagancaaagggaaatataaaatatttttcttnnaaaaacttaataaaaatgcgggntgacaaaanaancattttcatcttggcagnaanaaagttctcaagggacctaattatggggggggatactttttngaaaaagaaaaangctggaaaaatnaataaaangctangaatgtttctggcccattatgaaaagaangaaaataaaaggtnttcaaaaaataatgaaacanttttcccgtgcnnannnaaaaagnaaanttannaangaaaactcnnggccntntaaaaacaaanangggggggcggtataaacggtagatcccagaaaagganaaaagaaacncatgggaangan

SEQ ID NO: 7889 - DNA, 1127 bp, Homo sapiens
  misc_feature 3, 40, 69, 70, 79, 80, 81, 111, 112, 117, 126, 128, 129,130, 133, 134, 172, 181, 182, 188, 206, 210, 216, 217, 221,230, 233, 234, 238, 239, 243, 247, 249, 256, 259, 270, 271,276, 279, 283, 290, 291, 296, 306, 307, 312, 314, 322: n = A,T,C or G
  misc_feature 323, 330, 333, 335, 337, 339, 340, 356, 365, 370, 371, 376,377, 382, 385, 387, 388, 390, 391, 396, 397, 401, 410, 417,420, 430, 433, 436, 444, 447, 450, 457, 461, 463, 472, 474,475, 476, 477, 487, 488, 490, 491, 493, 506, 510, 520: n = A,T,C or G
  misc_feature 523, 528, 534, 538, 543, 547, 548, 553, 557, 568, 569, 573,574, 575, 577, 585, 586, 587, 592, 595, 600, 610, 616, 618,619, 624, 628, 633, 639, 655, 657, 659, 683, 686, 690, 693,704, 713, 717, 735, 745, 765, 772, 781, 789, 793, 809: n = A,T,C or G
  misc_feature 811, 813, 818, 819, 829, 839, 850, 851, 860, 861, 871, 881,882, 884, 885, 890, 892, 899, 900, 910, 911, 923, 924, 925,927, 933, 934, 936, 945, 951, 955, 958, 959, 965, 966, 968,970, 975, 979, 982, 986, 989, 992, 998, 1015, 1016: n = A,T,C or G
  misc_feature 1020, 1022, 1031, 1032, 1038, 1044, 1054, 1058, 1062, 1065,1068, 1070, 1072, 1076, 1078, 1081, 1085, 1089, 1090, 1091,1095, 1096, 1104, 1113, 1115, 1122: n = A,T,C or G
tanttcctttggaaacaatatgcaatgtgaagcggtcgcnctgtgagtttagtaaggctgtgtacactnncacctttgnnngcatgcatgtgcttgtgtgtgtgtgggggnnttttnttaggcatnannnacnnctcgccctccttgctctagtcctgggatgtggcatgcnagcagcggnnggcctnttttcagatcatggcatncaanagagcnnccanacatgtctnttnncatnntaanaaananaatcctnttntaactgcaatnnacttnaangtanctcagannttatnctctaactannccacntnaaatcatnnttcatgnacntntncnnattaaacaaaaaacantttgtaccnaattnncatcnncactnaancnnanncttcnnctanatctcatgncttaaantantattaatacnacntcnagtctatntgnacnaaactcntatncntccacctantnnnnctagattaannanntngctaatcacttantcantgacataatnttnttaanatatcnatgnctatnatanncatanaatnacaattgctcnnacannncncacatcannncactntanatatngatacgactnacacananntagtncatncgacntttacntcgttacctatcagancncnatatactacaccctacgaatcttnatntatntgnatatctattanaatatactnggangtcaagtactctcatgantcgagcttantacataatttctcataccanaaggtancatacatcnttttcaantacnccatatatttacatancncntacannacttataccncgtaagcatnaatattactgnntaccatatnncatatattantcgacgatcnngnncactncntcaatgnntctacatctnnctctcatctaannnanctcatnnanctcaacatncgatgntatnatnntatacnnananacctnttcntcntatngtnacngtcctnactattacttcttacannatanantattatatnnctactncatcangtatctcttnttcntaanatntantnantatnantanctanatcnnntagnnacactcgnttgcatctngntctgcantatcg

SEQ ID NO: 7890 - DNA, 791 bp, Homo sapiens
  misc_feature 3, 21, 25, 32, 33, 40, 44, 45, 51, 59, 62, 76, 77, 79, 300,430, 448, 458, 469, 473, 477, 559, 577, 586, 604, 610, 613,627, 629, 632, 638, 645, 651, 653, 673, 687, 697, 717, 732,737, 741, 743, 751, 757, 769, 773, 775, 784: n = A,T,C or G
agntacccgtagctcgagttngctntctgatnngtgggcncccnngcatgngcacatgnaanctagggaaagaatnnancttgagatcgtcaaagtgaggggaagaggggggtaagcaaaggagaaatgttatatggggttcggaggttttgtgtttgtaaatctggagtgatgggcatgttcaaatgcttctgggaaaggagctaataggagagaaacttagcccttcgaaaaacaggaagggatggatcctaggggagaggaggaaggattggctttagaggaaagatgtcctttacntgaggaaaaggaagaaaaggtgggtttagatctaaatctgtaggtttgctgttaggaaattaaggacttttcacctttatctctgaaatttctctggagttagcaaggcaaggtcatacacctgaataangagggatgaggcattgtnatatttgcanacatacaggtntgtnattnctttatgggaggaaaaggggagaagccactttttgtcaaaccggccctgtgggcttttgaaagccccttttggcctaccaantccattgaaggtgctcanaaggatganaaaagcttcaagggtaanaagcanttnttccaagcctgcgncnttnaaaaanaagtgcnaatacnanaaccagtgggaaaattgggnaaatttcccattcntttggaatcntctttagaaaagttaccttnaaaaaccttcccatnccctngaanangggactancaaaanttaaaattttanttangngggggaccncttttct

SEQ ID NO: 7891 - DNA, 715 bp, Homo sapiens
  misc_feature 11, 249, 403, 419, 421, 424, 431, 454, 547, 573, 585, 591,610, 628, 633, 653, 672, 675, 679, 698, 706, 710, 715: n = A,T,C or G
tacaagctttnattctttttgcaggatcccatcgattcgaattcggcacgaggtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcanggagggtggccaccatgggccgaggtctcacccaagaccccttgctctgctcctcaaccttgcagtcacggcagcactatggtggactgccatggccgtgtgactttgggggcaagtgggagggcgccctgaataatgattgcaaggacaacangcaaaagctaccctanancangacacanggtgtggtacttgacaaccctantgtcacctcaaatccatgtcccacacttttgggcatgggtgggacttgtgaaccttaccttgtcaggcggacaatggcccaagaaccattgangacagttgtgtgccacttggaaaaanaaacttttttgnaaaaanccttaaattaaggtagaanaaagccaaaaaaatcttnttggnccgtaaaacccgggcttttnttaatttattcggccaacnttnttgnggattgaaccttttgattnaaaccccnggcnttgcn

SEQ ID NO: 7892 - DNA, 1429 bp, Homo sapiens
  misc_feature 1, 2, 3, 6, 7, 8, 9, 10, 16, 19, 22, 23, 24, 27, 30, 33,36, 43, 54, 55, 59, 60, 64, 93, 94, 100, 101, 103, 108,112, 120, 128, 131, 149, 154, 166, 171, 173, 176, 187, 192,195, 207, 214, 219, 222, 227, 233, 240, 241, 242, 245, 247: n = A,T,C or G
  misc_feature 249, 254, 256, 261, 264, 270, 275, 281, 284, 286, 296, 297,298, 302, 307, 309, 317, 318, 332, 334, 336, 339, 340, 341,342, 345, 355, 356, 358, 360, 361, 368, 371, 376, 379, 381,382, 389, 390, 395, 397, 400, 402, 406, 415, 416, 419: n = A,T,C or G
  misc_feature 420, 428, 433, 434, 436, 454, 460, 464, 466, 473, 474, 476,482, 485, 486, 488, 492, 493, 496, 497, 512, 517, 519, 522,527, 545, 550, 557, 560, 561, 571, 573, 579, 584, 585, 590,597, 606, 608, 611, 619, 623, 625, 637, 640, 644, 657: n = A,T,C or G
  misc_feature 667, 685, 693, 695, 696, 703, 707, 717, 719, 725, 726, 732,733, 744, 747, 751, 752, 759, 771, 774, 780, 791, 795, 797,800, 802, 804, 808, 810, 812, 820, 834, 836, 837, 842, 843,848, 852, 853, 855, 865, 869, 870, 876, 881, 905, 911: n = A,T,C or G
  misc_feature 912, 913, 920, 922, 925, 933, 934, 943, 945, 947, 949, 954,956, 958, 959, 963, 964, 965, 966, 971, 973, 977, 983, 986,987, 988, 997, 999, 1002, 1007, 1021, 1037, 1042, 1053,1069, 1073, 1075, 1077, 1078, 1083, 1084, 1093, 1107, 1115: n = A,T,C or G
  misc_feature 1116, 1121, 1122, 1128, 1129, 1137, 1140, 1142, 1143, 1144,1149, 1151, 1154, 1160, 1163, 1170, 1174, 1175, 1186, 1187,1189, 1190, 1203, 1204, 1207, 1209, 1211, 1213, 1214, 1217,1218, 1219, 1222, 1223, 1228, 1230, 1245, 1252, 1254: n = A,T,C or G
nnncgnnnnngcgccncanctnnncgnacnctnccngtccacnctagggggggnnggcnntatntgaaccccccccccctccccccccccctnnttaagnncntcgantcgnacgggttnttatcctncgnccccgggaggggtactanacccnggcccccccggncgttngnggncttgggcctcnagggnggngggggcatttgntaagatnaccancgntcacntctagntctaagnnnggnantnatacntntacancanctagcngtggncccagnatngnctcaagcaannncacnctggnanccgcaccnnccgcgcccgcgccnanantcnnnnaangactatattnntntnnctagccnccnttacnttntnnctcaacnnggaangnagncngatncgaacaccnnggnnctccaacnaaacnngnttccacgacaagtatatncgcgcngcgnangataggnngnaaagcntcnntngcgnnatnntcttccaggccccgnctggnangtntgtcngtgcccaaggacatgacntgggngacaggntcnntccggcatanancccccngattnnccccncacaacnggggggccngncangggggcanaggncncccaatgtaaangcncccnctccccaacgctntgggagaaanaaggttctgggtcacaantcctattntnngggacanaagngggggcaacncnggggcnnaactanncttggggcgcnaancganngtggggngccgcccaccanagngcgacnagggggggaancagntncgngngncccnanancatgcctncaaaggaccgcgtntnnggtcnntcgtngaannanccgtcgtgtncaanngcgtanggtantcacgttaccgtcgtactgctctncgatcnnngcaccgnanccntgcgccannaacgcacgntngncnccgcnangnngtgnnnncgatncntacncacgtnacnnnccgcgtacntnccncacgncacgacctcgttcngtgcgggaacgcatcncaggncaccactctcnccctcggcatcagctncacngntnncaaannaccgaccgntcacgccggctctntccacatnnatctnnaggctnntgtgacangtntnnnctgcntnccncacgtncgntatctancgcnngtacacccacnncnnactgcgagcgtcnnccntntntnncgnnngcnncgctnangtgtcgctcgctacnccatctncngntcncnnnnancggcatcttaancccntctcacagtgncttcnnnganacgcgnnccctagcgctgcncgccgngtncgatcgngtcctacngncgagactcntgcncggnngctncnnntgtaagtcatnaacacacnncnacgcnctgtgcntntgtnacgcnncnntnncg

SEQ ID NO: 7893 - DNA, 850 bp, Homo sapiens
  misc_feature 3, 6, 7, 8, 9, 11, 14, 15, 20, 27, 29, 32, 40, 46, 49, 54,61, 64, 65, 71, 72, 82, 94, 95, 98, 99, 101, 107, 112, 113,116, 117, 121, 129, 134, 136, 138, 139, 140, 142, 145, 149,150, 155, 160, 164, 172, 173, 174, 180, 187, 197, 209: n = A,T,C or G
  misc_feature 216, 217, 225, 227, 229, 231, 234, 235, 236, 240, 242, 246,248, 249, 250, 253, 254, 256, 261, 268, 277, 278, 280, 281,283, 289, 290, 297, 298, 305, 309, 310, 313, 315, 328, 332,334, 335, 340, 345, 354, 358, 359, 362, 365, 369, 372: n = A,T,C or G
  misc_feature 373, 374, 387, 388, 390, 393, 394, 396, 403, 405, 408, 410,416, 419, 425, 433, 434, 437, 444, 446, 447, 450, 454, 455,456, 460, 464, 465, 468, 470, 473, 474, 477, 479, 480, 486,488, 489, 490, 494, 496, 497, 498, 500, 506, 510, 516: n = A,T,C or G
  misc_feature 521, 522, 537, 542, 549, 550, 553, 554, 556, 558, 562, 564,567, 568, 570, 571, 574, 577, 581, 583, 585, 586, 587, 590,592, 597, 598, 601, 603, 604, 605, 608, 609, 610, 612, 614,615, 621, 625, 629, 635, 640, 642, 649, 650, 652, 654: n = A,T,C or G
  misc_feature 655, 660, 661, 670, 674, 676, 677, 681, 683, 684, 685, 686,698, 700, 702, 707, 708, 715, 716, 728, 730, 734, 735, 738,743, 746, 749, 751, 756, 758, 761, 766, 767, 774, 779, 781,782, 787, 789, 792, 793, 795, 797, 802, 804, 810, 814: n = A,T,C or G
  misc_feature 817, 819, 824, 828, 834, 835, 838, 839, 847, 849: n = A,T,C or G
canctnnnntncannctggntaattgncncanactgtcantatganatnatcantgttgcnctnngggaannggtgggctgnttcatatggacnnccnntncattgnaacgnngannattntgaccagntcccncntnnnanttncttnntgganttgcncaantcaatttnnnctttcntgcgatncagacttccnccaattctattngaatgtnntgtataancntncntcnnntatnangaancnnnttnngncactnttcattnataaaacanntnnancatatnnttaatannacttatnatgnnatncntatagtttggtgntgtntnnggctnatcancctaggccntttnncanttntttntgnnngtagtgctcacanngnatnngntggaaantntcntnacgctntcnaaagancgctccgnnatngcgtccngnntcntccnnnttgntgannacntnctnnttntnncctaanannngccnannnanttagcnaatntgcctntatanngaagtggttatttcnttaantataaannttnntnancgangnttnnannggntangccnantnnnccntnatatnnctngnnnagnnngntnnaaacgnacancttnctcgancatcntngccctanngnanntgaanntcctaaagntggngnngaanannnntaaacacctgtntngnccgcnnttattcnnttcacccctatnanctannccnttctntcnatngnctctntnaantaaanncaaatanatatncnntcacncngtnntncnaaccntntagtanagcngtntnttatntgcntaaccnnatnnacatcacncng

SEQ ID NO: 7894 - DNA, 770 bp, Homo sapiens
  misc_feature 4, 6, 7, 9, 13, 19, 25, 32, 35, 64, 65, 85, 202, 208, 218,373, 396, 409, 410, 418, 426, 479, 510, 512, 550, 557, 587,590, 597, 601, 603, 621, 627, 644, 647, 650, 655, 671, 672,674, 726, 730, 735, 736, 739, 752, 760, 761, 769, 770: n = A,T,C or G
cccncnntntaantccgcncgaagnagaacangangcaccctacagggagctccagtttgaggnncgacaggcacttcggccaantccctgatggctttcgtccattacttcacaaaccgcttccacggctgctcctccacacgcaccgagccatgaggagctgcgcctctgagagcctcttcctgccctactacccgccanactcanaggccaggangccatgccctggggccacagggaggtgaggtgggctggatgccacacagatggtctccgtgctggctcactgaagagctgagcctgtggctggcctcagaatcaggctgggtgcagtggctcacacctgtaatcccagcattttgggaggctgantgagaggatcactttgagctcangagttcgagaccnncctggccnacatggcnacaccccatttctacaaaaaatttgtaaaattagccaggcatggtggcgcacnccctgtagtcccagctgcttgggaagctgangngggagaatcactttgagcccaggagttccaggctgcantgagccnggatcatgccactgcactccagcttgtccncanaaagacnactntnacccccctttccccccanaaaganatggcaacaagcttggncanccntgggngcttgaatgaaaccannanatgtttcgctttggattcccaacggcccttggcaccccctctacggaaaatnccancaaannaanaaattttttcccntttgcctnnaattgtgnn

SEQ ID NO: 7895 - DNA, 761 bp, Homo sapiens
  misc_feature 6, 34, 370, 401, 453, 477, 532, 575, 603, 611, 617, 622,623, 624, 638, 649, 661, 672, 673, 675, 676, 702, 710, 716,719, 734, 748, 749, 752, 753, 759, 760: n = A,T,C or G
cccccntctattcgcccgaggcgaagcaggcttnttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcangctatgagtttcagagggagttcaccacaangagtaaagcctgactggaccattgcacggattgaacactcaaaaactattangaataattttcttggaaaaatcancttatggactttaaccagttgcttgtgaaaaactaaggaagaaaaattttggggncatttgatccttcacttaatctaaagtctggggaattactttntatattatttttgaaacacttcttgccntatttttngccttnatacnnntcacaagcattttncacaaaattgntattcacccttntttttaaaagnnanntccaaaaattttaaaaaaataccatngcccccgnttggtnggngttcatattccaatnaacattttccatgnntcnntattanna

SEQ ID NO: 7896 - DNA, 758 bp, Homo sapiens
  misc_feature 1, 2, 4, 13, 23, 24, 40, 55, 68, 138, 231, 232, 280, 306,322, 326, 354, 359, 360, 377, 379, 391, 408, 411, 426, 428,448, 454, 455, 486, 494, 495, 512, 516, 520, 529, 541, 556,559, 560, 570, 571, 585, 592, 594, 607, 609, 618, 627: n = A,T,C or G
  misc_feature 630, 634, 636, 639, 641, 644, 645, 658, 663, 667, 674, 675,677, 679, 685, 688, 696, 698, 705, 716, 723, 729, 733, 734,735, 737, 755, 758: n = A,T,C or G
nncntccattcgnacgagggcgnntgaatgtagtctcacnctccgagtagctgcnactacaggcgagngcctccatgcccagctaattttttgtatttttagtggagacggggtttcaccatgttggccaggatggtnttgatctcctgaccttgtgatctgtccaccgtggcttcccaaggtgctgggattgcaggtgtgagccacagcgcccggccaaaaaaaggaatnnttaagaggaaaaagaatgctaccaacctaaccacatttctatgactgnttatatttttccctgttccacatacntacatttttacatagnacgntcattgcagcatgagttacttttcactnaatannttttaaacattttccancngggtgtggtggntcatgcctgtaatcccnacncttggagaggccaantnaggcttattgggtgagtcangtgttnnagactagcctagcaacatggcgaaactgcancctctacnnaaaataccaaaaattanccangtgngctggtgcncacctgtattcnggcttctcaagaacnctnntgtgggaccnntttgtttgaacccnacgaggnangaaggtcgccctntnccccctctnctccccccnttncctncnccntnctnngttctccaccccntaccnttanctttaanntnanctcaanatnccatcctnanccaccanccctgtttacntccctcnattaanccgnnncnacactttccctgcctctntcn

SEQ ID NO: 7897 - DNA, 735 bp, Homo sapiens
  misc_feature 7, 8, 20, 297, 411, 468, 476, 479, 556, 559, 572, 576, 582,621, 624, 626, 644, 671, 673, 677, 686, 688, 710, 712, 716,719, 725, 729, 730, 733: n = A,T,C or G
acctcgnnaattcggcccanaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccanatgttatgaatctcagccagtggtctttgcagcatgagatctcatgtaagctaagctgtagttgtatttcttggaacccttcaagctctcgtgctcattccccatgatcgccgnaggaagtgatgacagtagccccaacgcaatggccaaggttcagatttttgaatatantgaaaacnccnggaaatatgccaaagctgaaacttttatgacagtcactgatcctgtcatgatattgcattccctccaaatttgggangancttttccatattnttancaatancgaccaaagatgtgagaaattttacattaaaaccctgtnaangnaaagaactgactttcctntgggtgggccaaccaaagtttgaaatncntatngtggctcantncgataattattaattcccaagncngggnaangagttnggannatnaa

SEQ ID NO: 7898 - DNA, 792 bp, Homo sapiens
  misc_feature 8, 9, 12, 20, 21, 22, 201, 203, 254, 263, 278, 308, 309,310, 312, 326, 327, 329, 336, 343, 347, 368, 371, 402, 410,423, 425, 450, 463, 481, 517, 518, 519, 524, 531, 548, 551,557, 564, 568, 573, 579, 583, 586, 588, 592, 602, 610: n = A,T,C or G
  misc_feature 613, 624, 630, 639, 648, 650, 659, 660, 662, 668, 677, 679,680, 686, 687, 693, 698, 706, 707, 713, 725, 733, 736, 737,745, 757, 774, 779, 786, 789: n = A,T,C or G
cacccatnnaancgcccgannnccaccattatttaacactccccttaactgtctttgaactttctcttttaacaaaaatgtcaagtctttacagttgtaatatcaccatgtttcccatttctgttaatacttctatgaacccctaaagtattgaagggaactagctgccagtttcaaggattacaagtttgagcctcctantnttcaacatcattctgaaccctgaaataatattcttctctgttaaacaattnctatctgtntgccacctctgttgntagaggtggttgttaattgaccttactaannnanctgcctttgatgannanttattgntattggntccngaataaaacattaaccttttnaantcagaaggaacctcggtacttcttaaggttngtttgcgntttctaaaaccananaataaggaactgatttggctatcangtttaaccattanaattttctgtaagctttncccacaaaaaaaaccattggtgatttgaggatatannnaatgnttttaancctttttaaaaataatnagnggggtnattctcntggncttgnctaacnaatngtncntggnaaaacactgncgattttnaanaaatttttttnaaaaanttgggcttnttcttaaananttaaaaaanngnccccanatttaaggncnntatttnnctggancctcnaaaatttnnttgtgnaaacgccccttnggttcccnacnntggaattntttaaaccattnttctccctttttgaatnttcanaattttntgnaaa

SEQ ID NO: 7899 - DNA, 770 bp, Homo sapiens
  misc_feature 6, 7, 9, 12, 16, 19, 20, 21, 22, 24, 31, 32, 36, 37, 39,42, 43, 50, 60, 61, 62, 75, 78, 86, 88, 130, 142, 146, 148,149, 150, 152, 186, 187, 193, 201, 202, 237, 247, 250, 301,302, 316, 318, 326, 349, 357, 369, 375, 377, 380, 388: n = A,T,C or G
  misc_feature 397, 401, 419, 428, 429, 436, 443, 447, 449, 458, 463, 471,472, 483, 489, 494, 495, 509, 521, 555, 571, 578, 589, 602,613, 615, 617, 622, 631, 635, 644, 647, 653, 657, 671, 673,678, 682, 683, 688, 697, 709, 712, 715, 717, 723, 728: n = A,T,C or G
  misc_feature 734, 742, 768, 769, 770: n = A,T,C or G
accctnntnaancgcncannnntnaaactgnntctnnanttnncctcccnaattatggtnnnaaaacttaatganttnccaaggtnantgggaagcctggctttaacactcccaggctatattaatgagntcatgaggatgncatntnnntnatgcacttcaaagggtgttgtaagtattaactannttaatncaggtcanntgcatatattagcactcaatgcacggccattgatnaataaatgcnagnggtcctgatcactgagaatctaacctctgcttaaatacctttagtcataannagcttcactccctnantaacatgnttggatttcttgatcaaccatantttttacngaatttctttcnttactnanccntgaaatcngtctccttnaaantttctactttggtatggnctcttctgnntgctacnccaaatnaatntnatcctaatnctatntagcttannttccagcatanccacancaatnncattaaatgatttnttcatgtggcangactttaaactccgtcacccatcctatttgctcntctcaaagagcttccnccccganttgctccctgnggaaattgcccantttattaaatngnanaatgnttttttttnaatnctacagganctnccccgnttgntattggtgcaccantntctanaaannaggtnctcttgaanatttttctgganttntgntnttaccnaagtntccttngtggggcncttcccctttccctacgcctcttatnnn

SEQ ID NO: 7900 - DNA, 922 bp, Homo sapiens
  misc_feature 3, 5, 6, 7, 8, 9, 10, 13, 14, 15, 16, 17, 18, 19, 22, 23,24, 25, 30, 32, 39, 41, 49, 66, 68, 73, 74, 77, 79, 84,85, 97, 111, 112, 120, 126, 133, 145, 149, 162, 164, 167,170, 178, 179, 195, 201, 213, 216, 217, 234, 236, 241, 243: n = A,T,C or G
  misc_feature 245, 251, 257, 276, 292, 306, 312, 315, 319, 325, 347, 348,352, 355, 356, 367, 373, 378, 387, 390, 408, 410, 414, 421,429, 446, 458, 465, 481, 487, 488, 510, 513, 521, 541, 558,564, 568, 572, 585, 595, 624, 632, 653, 659, 666, 668: n = A,T,C or G
  misc_feature 669, 672, 689, 702, 705, 706, 717, 725, 730, 732, 735, 750,761, 766, 770, 779, 791, 830, 833, 834, 851, 856, 880, 891,921, 922: n = A,T,C or G
gcngnnnnnnagnnnnnnntgnnnncgctnantgaattntncaatgggnaactcttgcatgatatngnaccannggngnaaggnnccgttgctaggnggtacacaggatgnnggccctanccaatncatcaantgtatgacgacnattncgggagggacacntntantgnaccgcagnngcccccactatcaagncggttnctatggttacanacnntgtgttccattttgtcntnaaagncnanaattancatccngttcgcaattgaagaaaancccccattgaaccccnattaaaaaattgcncccgcnttnattnccccgnaccttaaaccggtcaatttaanngggnaannatggcccccancttttngggcntttttaacnttnttcccggtttccatttcncnaaangggtaanatttaaanaatggaaaatttttttnttgaaaagccanttttttntttaccaaaaattaanaacaannggtttgcccaaagctttaaacnggntggtcgcnattttttttatttttcccanttcctggcattcccatnggcctngganaatngttttccctcccntgaaagggcnttaatttgccttggggaaaaaccaaaaantcgtcccntttttttttctggaaaccccncaaaancccttancnnccnaaccttttttttttttnttttccctttaanttnncatccttaaantaaactgnttccntnggnggaaaaaaccattcntggccaaattnggaancttncccaaaacntggtccccctcntttttgtgcacttaaagccataaccgggggaccaaacanaanngggtgctttaaagggcnaaggnggcctttccaaatgggaaatcccnaattattttcntttaaccaagaaattggggcaccggggatnn

SEQ ID NO: 7901 - DNA, 922 bp, Homo sapiens
  misc_feature 7, 9, 13, 14, 15, 16, 20, 21, 22, 25, 27, 28, 30, 33, 34,37, 40, 41, 43, 48, 51, 56, 63, 68, 70, 71, 76, 79, 84,88, 89, 90, 91, 93, 94, 96, 98, 99, 101, 104, 107, 108,111, 112, 115, 122, 127, 138, 145, 151, 152, 153, 155, 164,173: n = A,T,C or G
  misc_feature 177, 192, 193, 200, 213, 216, 220, 229, 231, 243, 247, 252,261, 269, 281, 297, 299, 302, 309, 312, 319, 323, 330, 338,346, 357, 368, 370, 371, 374, 379, 392, 398, 406, 410, 414,420, 421, 425, 426, 428, 455, 456, 460, 464, 467, 470: n = A,T,C or G
  misc_feature 486, 487, 488, 489, 495, 500, 530, 537, 540, 551, 552, 554,556, 557, 579, 584, 595, 601, 608, 610, 619, 622, 629, 636,640, 642, 643, 663, 683, 687, 694, 723, 738, 741, 752, 755,760, 763, 766, 781, 783, 786, 796, 801, 802, 813, 814: n = A,T,C or G
  misc_feature 820, 832, 836, 837, 867, 875, 877, 878, 884, 886, 896, 897,908, 909, 910, 911, 914, 917, 918, 919, 922: n = A,T,C or G
accggangnccgnnnnaccnnnaanannanccnnaanacnnanacgancgngaggnccgaagnagganannacaangcncgggngagnnnncnngngnnangcnaanncannccncccggcngtagngaaaccccttnggcaacncgcgcnnnangcaaggaanccaacgaancccncacggcgacgagaannggaagcnaccaaaccagganganagtnttcagaccnangcaaaggaagcnggangggangaagaagcngaacaacnaggaaacccagnaacaggaggacaagcngnggnagaaaangangcccccngggngaagccnacggaaangccgaganctcaaccaaanagggagaagcngnnggnaaggnccccgggcaaaanacgggngagaaaangacngcanggggannaccnngnaaaaacggaaaacatcaaaacggcacnngacnaagnaanggncgaaaaaagaaggagnnnnccgganaccanagagaggaaacgaccaggtcaaactaactntggcacntgngggaccggganntntnnacaaaagccacaccactcgcancaacngggacacacangatggncgcagangnacccctagnggnagagaanaaaacgnggananngggacacttaaaaaccacangggcaaccaagaacgaggangaangaaggancctagggcattccaaaaagcaagaaaaanaaacctaagcccctnggnaaaccgggacnaangaagnccngcnaaaaaccggaagacntngtngagggcaccnaaaannggggacccccnnaaaganccgaaagggagnaaannaggggactccgggaaaaaaacaccccaaangacacacncnnaaaacncncgggcaaacnnggggaaaaaannnnaanaannnccn

SEQ ID NO: 7902 - DNA, 788 bp, Homo sapiens
  misc_feature 4, 10, 11, 13, 14, 15, 18, 19, 20, 21, 22, 23, 31, 35, 36,37, 38, 40, 41, 42, 52, 53, 54, 82, 113, 573, 595, 640,668, 733, 745, 768, 769, 770, 787, 788: n = A,T,C or G
ttancctttnnannnccnnnnnnttttgcangatnnnntnnnattcaattcnnnacgaggagtcaggaaggtaaggcggggnttgactgaataaactctgccttttaaattgntcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccaccctggtgacagaggagaccccgtctcaaaaattgattgatcaattcagcatctgagggctgcaagtacagaaggaatctattctcagcagggcatagggcacgcactggcttaacagtttaatatataaggctcaaatagtctatacctgaactgctataagcaagggcgatagggaagtggatagattgcttcaancaaaagtgaactgtgagatctncaagacagagggagaaagatctgatccaaatgagaacagattggntattgcaggtttcacagcctaaaaaaantatctttttgccaaaagaaatattaaatgattaacagtcctccacgtgtgttaatgttcaaactntattcataatgngtataaatgggtaacaaaaatgnnntacaataaatcttttgnn

SEQ ID NO: 7903 - DNA, 968 bp, Homo sapiens
  misc_feature 4, 5, 19, 20, 44, 47, 50, 53, 60, 67, 69, 75, 89, 104, 105,110, 113, 115, 118, 120, 122, 128, 130, 133, 138, 141, 147,154, 159, 168, 175, 182, 189, 190, 196, 198, 205, 245, 289,316, 332, 384, 385, 387, 390, 393, 437, 451, 482, 502: n = A,T,C or G
  misc_feature 519, 532, 541, 546, 552, 556, 568, 575, 631, 636, 686, 714,746, 792, 806, 807, 834, 851, 926, 935, 943, 966: n = A,T,C or G
ctcnnagccttgcaactcnngtctttttgcaggatcccatcgantcncantcngcacgangaccacngnaaggtncctgggcctttttngggggataactgggnngggcnaancnacnananatttgncnttnaaggnctncttcancagggancttanctggttctnaaatccngataccnagagaanntatccntnctatggnggatgggtttggaaaccaggtcagaaaaaaggttttggtntaccttggctttcaaaccgggaattgaacaagccgaagaaagtnaaaaggggttgccccaaatttagcctnggaatccagtggggcntgaaaatgttctttctttaatcaatccattgggtggaagaatggtccccctnntngantgnaccccatttattcaaaattttggggctttcaaagaaaatttttnggtggggggttagnccaaattaaaatccttaaaaccccttccttngccaagcccccaattggggntcaaggttttgggggtnaccccaagggccntaaccattnggggngggccnaaangggaatttcctngccttangtcccccaccggaataaaccaattcctttttaacccaaatgggcttcaagccttcnttttngggccttccggatttgggttaattttcccacccaaaaaaggaatggaatncaccaccgtttggaaagttttttaatantggaatggaccaaccccagccgttggttggangcccttggaaatgggtaccaatttcctatttatttccccaatgggnggcctggataaaanngggggcctggaaaagggaaatccgggnacttggggtggggtccntgccaaaaatcccccaaccttttggatgtgccgtggaaaattgtaaaataaccatcaggccgtttgaatgggatngggagaaanaaaccttngccaatgctttcaagttaccaanaa

SEQ ID NO: 7904 - DNA, 733 bp, Homo sapiens
  misc_feature 8, 9, 30, 513, 602, 641, 651, 653, 676, 689, 692, 717, 733: n = A,T,C or G
ccccgatnnctttggagaatttggtccttnaccttgaggaacacttcttcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatanaagcttactttttgctatatcagcatttgttacagccaatatttaaggacaaaatttagaaaatatatcatttcctggcccatcatcanaactaatacagcttaaccttgcaagctaccaacttttgnggcaagctananatctttaatttgatatctaaggngcaaggaccaacnatntatttaagaaaattgggagacatgnaaggcaaagcttttgn

SEQ ID NO: 7905 - DNA, 744 bp, Homo sapiens
  misc_feature 4, 5, 19, 24, 36, 38, 41, 46, 49, 52, 62, 65, 73, 77, 82,84, 91, 93, 97, 98, 104, 107, 111, 112, 118, 119, 123, 126,131, 137, 140, 141, 149, 153, 155, 163, 167, 171, 181, 182,185, 186, 212, 218, 238, 240, 244, 266, 288, 295, 298: n = A,T,C or G
  misc_feature 304, 310, 320, 328, 344, 345, 387, 402, 408, 410, 418, 424,425, 428, 430, 431, 434, 436, 442, 460, 480, 488, 496, 502,503, 505, 509, 518, 525, 529, 534, 537, 542, 543, 547, 550,553, 560, 562, 570, 571, 575, 576, 578, 583, 584, 589: n = A,T,C or G
  misc_feature 598, 599, 608, 626, 628, 633, 634, 638, 645, 649, 653, 655,656, 658, 662, 665, 674, 684, 690, 694, 696, 698, 700, 702,703, 709, 711, 714, 715, 717, 732, 735, 739, 741, 744: n = A,T,C or G
accnnccaatcgccgaagnttccnctgacaccaggntngangcatnggngcnatttcggctnacngaaagctnagcntaccngnttcacgncnttcnnctgtcngancctnntgagtnnctgngantacangccttngcnnaactaaantttngnattgtttntaanaganatggggtttnnccnntatagccaggatggtcgcgatattcntgaccntcctgaagcgcctggctgancntgcnaacgtgtgggattatagggtgnagagccactgcgcctggataanctattancanttttcngagacngcctggtggngtcaaccntgctggattgcactgnngtgatcttggcatcactggaacctcacgactcctgggtggcnaacgattctcctgtntcaacntncccaagtngcttgnnccnannggngnccaccnctataccccggtaatttntgtatttttactgacatacncgggtcanactgatantgtccnngngtgntgatacaantcctganctcnagatncanctganntganctntcnaaagtgntntgaataannagtnngntccannagccncctgcccanntattttaanaacgtaccattaataatngnctatnntcancctggcnttgntcanannanaacnttnccttattcnccctttctantagacngccntnanancnntttttntnttnngnggcccccaataaccnttncccncntcn

SEQ ID NO: 7906 - DNA, 794 bp, Homo sapiens
  misc_feature 3, 6, 9, 11, 12, 18, 23, 28, 31, 57, 58, 69, 70, 73, 81,89, 99, 114, 132, 164, 165, 191, 211, 215, 240, 408, 442,454, 464, 473, 517, 534, 578, 581, 582, 585, 592, 600, 617,624, 636, 638, 642, 651, 652, 663, 668, 673, 696, 703, 711: n = A,T,C or G
  misc_feature 715, 716, 719, 735, 743, 753, 754, 756, 760, 762, 764, 770,786, 787, 789: n = A,T,C or G
canccntcntnnttgctnaagtnccagnctngggacgggaattggttttgatcttgnncaaaatcttcnntanggttgctnttgctgcntgactgctgnctacattcggaaaantctattttgtgaattggnagctaaatcccttactaccctgacaccgtggnntctactgtatttcttttcaaggtgcnatttgcttcagagttccagncagntagattaagcaagaggctccagaanaaatgtttacttgaattttgcgcttcctttcttgatagtttcctatataaaatttgtcattgaacaagagcaaatgctgaagtattaatgaggcacaaatgactgtgccccattagcaagaattcaggaatcaatacagacagtattaaattaatagcttaagtgaanaaaaaaaaaacctagtgaaaatgtattagccccnattaaatggccnaaaggacttntaaaaggcnaggggccttaactttccagtcctgcaccaaataaaaaattcctnacgactctccacttttnccaagtgggaggtttggtcttaactggaccttgtcgtatttttnttnnttngaaaggncggaattngctggtaaaaacttttncctaccnttggaaatattngngacnccctaggcnnttttttaaggntctcnaaaanaggggaatggccttattgcccancttgttnacaaagtngtgnnaanaaaaagccccccctgngctgtcangaaaaggggnncntctnanancctctngggtttttccttttcnncnggccg

SEQ ID NO: 7907 - DNA, 739 bp, Homo sapiens
  misc_feature 9, 10, 496, 507, 557, 564, 659, 665, 684, 691, 695, 698,710, 715, 722, 729, 732, 736: n = A,T,C or G
tacccccgnntcgaattcggcacgaggagaaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccnaaagaattaanagaatacctagaacatatcctcagcaagaaacaaaacccaactggactcntcgtgcngaaaatgtagcccattaccacatgtagccttggagacccaggcaaggaccaagtacacgtgtactcacagagggagagaaagatgtgtcccaaangatatntataaatatttctatttanccattcntganatnaaggagccctgnttgcnttgatgnaaaacantgntatnatc

SEQ ID NO: 7908 - DNA, 922 bp, Homo sapiens
  misc_feature 5, 8, 18, 23, 27, 29, 30, 31, 32, 38, 48, 50, 52, 56, 66,67, 77, 83, 86, 102, 103, 109, 117, 118, 119, 123, 132,133, 134, 135, 136, 142, 145, 146, 151, 152, 153, 158, 159,160, 161, 163, 165, 167, 175, 178, 180, 185, 189, 191, 192: n = A,T,C or G
  misc_feature 201, 207, 212, 219, 221, 222, 223, 224, 227, 228, 234, 242,246, 255, 256, 258, 260, 263, 276, 280, 282, 286, 290, 300,307, 309, 310, 311, 317, 330, 332, 334, 337, 342, 344, 345,346, 348, 349, 350, 353, 355, 356, 358, 368, 375, 377: n = A,T,C or G
  misc_feature 379, 388, 392, 393, 399, 403, 407, 413, 419, 426, 427, 428,434, 439, 447, 448, 458, 460, 463, 476, 480, 491, 492, 506,511, 515, 523, 526, 533, 538, 543, 549, 550, 554, 558, 566,574, 583, 590, 599, 602, 611, 655, 657, 658, 660, 661: n = A,T,C or G
  misc_feature 668, 672, 686, 692, 693, 701, 709, 711, 713, 720, 722, 723,728, 737, 743, 746, 754, 757, 765, 766, 773, 788, 789, 799,802, 805, 811, 814, 847, 848, 865, 867, 873, 878, 882, 883,906, 908, 909, 915, 916, 918: n = A,T,C or G
acctngtntcgctcaagnatgtnggtncnnnntctgtnggaagtgagntntnctgnggcgtcggtnnttcgtgatancttgcntcngttgctcgatggtctnngcttanggtcttgnnncttntacccttgnnnnnacccgnccnnggcgnnnatatnnnntngntncgagggtnctntnttganaaanannacgtgtgcngggctntctanctggggngnnnngcnntcgtgncttatatntggnaggtcgtcnncntntgngtcttccaaaaantctntnttgnactnttctacacanaacagantnnnatcatnggctagatggatncngncanagccngnnncnnnatngnngntatttctganggtctgntntnaatatcacntccnngggagncacnggancatggntctggntaaaacnnntcatanccccncaatatgnncccctccctntncanccactttttcttntgcnatttttgcccnntttccccccctcancttcnacgnaacaatgnacntaggggnccctnttggnatgatnngggncttngacaaagnaagggganggggcctcngaaacgngattatcangcnccccccctnatcgcttggattgtcaaaatcattggtgtaccctcaaactgggngnngnngaaatcnttanctttttggcccccnccgtgnngttttcancccccaanananacccacntnncgccncctttgttntaactnccnaaatattntgntccccccnngcccttnggggatttcgcctcnngataaaaaanaanccntctttnttntttttccggacccaaaacccttttgtaaatttnnttttcttaggcaaaagncntatttnccccncttnntttcacctttctttgcccccttntnnaggaannanaaaa

SEQ ID NO: 7909 - DNA, 1188 bp, Homo sapiens
  misc_feature 6, 8, 15, 17, 23, 34, 53, 68, 71, 86, 92, 96, 105, 113, 119,120, 123, 128, 131, 135, 142, 150, 153, 163, 183, 184, 205,206, 229, 240, 248, 255, 257, 260, 277, 278, 304, 314, 328,361, 378, 380, 381, 382, 383, 413, 417, 428, 433: n = A,T,C or G
  misc_feature 442, 445, 449, 451, 452, 453, 454, 455, 456, 467, 481, 485,495, 499, 506, 514, 542, 543, 568, 571, 574, 581, 583, 588,589, 614, 647, 655, 675, 694, 695, 701, 705, 743, 748, 753,763, 768, 773, 778, 782, 787, 797, 803, 812, 817, 830: n = A,T,C or G
  misc_feature 840, 854, 882, 888, 892, 900, 904, 906, 908, 911, 935, 941,943, 976, 978, 991, 1008, 1023, 1025, 1052, 1057, 1066,1070, 1076, 1097, 1121, 1134, 1152, 1154, 1169, 1172, 1175,1182, 1187, 1188: n = A,T,C or G
cgacancnctttggnanctcccngtctttttgcnggatccctcgattcgaatncggcacgggagattngancgccacctggggcantttttncctngcccctggngggggtcnatctanncgnatgcntgngtangccctcntgctcccnttntcacccgtgnggaggaaatcacccagccanncgagggatggtccagaacccnntaggcccccatatcctgggaaanccatactcgtnccatggcnaatgggntnggnaaaattcctggaaaggnnggtggtaaaaatttcccccggggccntattttcctntacccacccgaaangggaggggaaaattttttcgggacccagggggnttggggggggcccattnannnncctttttcctccacccatttagccggaatnaatncccccattccnggggnttggaaaanaanaaantnnnnnncgctcccaagnaaatgggaaaaaancctnggggcccccnaggnaattttnaatttttnaggggggggaaaaaggggcccattaatnnatttgcaaacccccttcaagaaaanaanttnggcccananaaagnnaaaaaatgggtcccccccttgggtnaaaaattggaaaggaatttttaccccaaccctngggatggncctttccctaagggaaaaanaaatggtttcccccacccnnggcggngggnaattccctgagggggcctttttggggccccaaggggtnaaaanttttncccccgcccnccccntttgnacttntatnccaantttccaaaancccctnggccaaaanaaagncaagggacccccnccttgggggngaaaggggaaaggnaaaagaacctggggaaaaatgggaaggnaacatncctngggggggnaatnananggngggtctcgggggggtttcccaccnaaaggnangggtcggctttttgggcccccgctatttaaggnanaaaatacctgggnggaggccccgggggccnctgggggggggcctntnccaattggtgggcaacccccccaggcnccctntgggggacnggcntggganggggggggggggggaatcccnccccggaagggcccggggagggtnccttaggaacccnggcccggggccccaaccntngggggggaaaacccnccntcntcttacntaaann

SEQ ID NO: 7910 - DNA, 763 bp, Homo sapiens
  misc_feature 1, 3, 8, 9, 10, 11, 23, 88, 97, 99, 104, 115, 123, 335, 422,427, 560, 563, 579, 588, 593, 599, 600, 605, 610, 616, 621,623, 627, 630, 631, 651, 656, 667, 687, 689, 702, 704, 710,711, 716, 718, 720, 721, 726, 727, 728, 732, 737: n = A,T,C or G
  misc_feature 745, 746, 748, 761, 763: n = A,T,C or G
ntnagtcnnnncgaggaaggatntcactctttgccctgtggcctctcccttttccccccttctggttggaggagggagaagtgggaantagcttggnanctggnttgagcacatnaggccaangctgcagggagctgtggtcgcaccactgcactctagcctgggtgacagagcaagaccccatatcaaaaaaaaacggccgggcgtggtggctcacgcctgtcatcccagcactttgggaggctgaggcgggtggatcacaaggtcaggagatcgagaccatcctggctaacatgatgaaaccccgtctctactaaaagtacaaaaaaaattanctgggtgtggtggcgggcgcctgtagtcccagctactcaggaggctgaggcacgagaatggcgtgaacgcgggaggcggacttgcantgaanccaagatcgtgccactgcactccagcctgggcgacagagcaagaccccattatcaaaacaaacaaaactgtgatgataaaaaagccccataaacactaatatcaacccatgctacttctgccttaaatttttnaanattctttgcacgttgnttactttantaacnctgggnnaatcnctttncccccntgggngnttgnagnnaaataaactggttatccctngcctntgaaaaggtanaaattaaagtcaattttggncnaaaccaactctantncacttnnctccncncnnccctnnncccncaaanatttctcnncntttcttttccccncn

SEQ ID NO: 7911 - DNA, 947 bp, Homo sapiens
  misc_feature 18, 43, 60, 62, 64, 65, 67, 68, 77, 80, 83, 85, 116, 122,123, 127, 152, 158, 168, 170, 171, 180, 188, 200, 209, 230,237, 260, 261, 281, 289, 292, 296, 321, 324, 325, 329, 351,355, 361, 364, 377, 378, 379, 400, 407, 413, 425, 439: n = A,T,C or G
  misc_feature 440, 458, 473, 482, 486, 494, 504, 514, 553, 559, 569, 577,582, 585, 588, 618, 622, 639, 646, 656, 668, 691, 698, 724,770, 793, 800, 849, 863, 879, 884, 903, 905, 908, 911, 913,936: n = A,T,C or G
ctctatcctttcactccngtcttttgcaggatccctcgattcnaatcgcccggggggccntncnncnngaccccccngantgngngggggggcttttggggccgggagaccccttngttttnncttncgtgcccggagttgggggcctttanggggcncgggaaatantnngttttttancaaggganccttggttcccnctacccttnccggtgggtgggaggaggganaaatttngccccttggggcttgggatgggnnaatctctccccatgggaaanaaaccccnttncttngtaaaaacccgttttgggggaaatncgnncccnccttttccttaaagaaaagggnaaanaatttnccnttttaatcccccnnncaatattttggaaaaatcctnggggccntttttnggaaattaaaanttaaaaaagggccnncctcctgggccctttaanccagggaagaaaatngggcccccnaaanccctgggnccattggganccaaagccanttgggttttggggaaaaggtttccaaggaaaagcccaanttcccnggtggttaanccatggtncaccnttngtngcccttttaaaaaaattaaggccctggtantccncccatttttatttaccngggttantaaatttttngggaggttttantttttttcaaaaatccatggttnccttggncccccagaagttccttttaagggttnaaccacctaaggggacctggcggtcccatggtacctaagtattaancagcctttggggttttggttaanaaatttngggcccaccatttttggaattattaaatggacccaccttccatttttcnccatggttacctcnagttccccttaaatanggaanggggcctctttttggttgnanccnggnanttggattttttttttttttaacntttatttggat

SEQ ID NO: 7912 - DNA, 760 bp, Homo sapiens
  misc_feature 1, 9, 29, 36, 43, 47, 49, 61, 75, 79, 103, 145, 178, 388,669, 672, 680, 711, 714, 721, 723, 726, 750, 752, 754: n = A,T,C or G
nttattcgntctcagcttgcatgcctgcnggtcgantctcatngatncncaggggtgagcnaccacaccaggccnagcnttttctttcaaatacaaggaaatntttttctgatttaaaaaaaaaaaacgaactttttttctgatnatcaaagggaaagttgcaaagatgaaaataaangtcatctgtaatctcaggtaataccaggtaattaacattttgctgtatttcttaccactgaaaaaaatgcatagttttaagctgggtgtggtggtgagcatgtagtcccagttaagtgcccaaagggttcactttaccggctgctagacagagtcgatttaccaagacaggggaattgcaatggacaaagagtaattcacgcagagcccngctatgtgggaaaccagagttttattattacccaaatcagtctccctgagcatttggggatcagagttttcaaaagataattttgcgggtaggggcttgggaagtggggagtgctgattggtcaggttggagatggactcacagggggcggaagtgaatttttcttgctctcttctgttcctgggtgggatggcagaactggttgagccagattgccgtctgggtggtgtcagctgatccatcgagtgcagggtctgcacaatagctctgatccgtagggncanaaaatggngcatattattcccaagaaccaattagggatngantatactntntgnagccttatcttcttccccctaacngnanttccac

SEQ ID NO: 7913 - DNA, 940 bp, Homo sapiens
  misc_feature 1, 2, 4, 7, 8, 9, 10, 11, 14, 15, 17, 18, 24, 25, 29, 32,38, 39, 40, 43, 46, 49, 50, 51, 54, 55, 58, 62, 67, 73,75, 76, 77, 79, 83, 88, 89, 91, 94, 96, 99, 100, 108, 109,110, 112, 113, 114, 115, 116, 117, 133, 134, 136, 140, 143: n = A,T,C or G
  misc_feature 147, 149, 152, 153, 209, 450, 474, 491, 532, 533, 566, 576,587, 590, 592, 597, 609, 613, 636, 637, 639, 641, 649, 652,657, 658, 686, 703, 704, 724, 726, 734, 735, 736, 742, 745,746, 747, 752, 758, 765, 766, 774, 775, 783, 787, 788: n = A,T,C or G
  misc_feature 794, 795, 796, 797, 799, 802, 808, 813, 820, 832, 838, 847,851, 852, 856, 860, 866, 872, 888, 893, 894, 895, 896, 898,903, 914, 923: n = A,T,C or G
nncngannnnnganncnncttacnnttgnatnacccannnctnaanctnnnttnnatntatngaatnacggtngnnnangcgncttanntngantnaanntttctttnnncnnnnnngattttaaaccccttnngnctgnccncctnanaanntgccatgtactaactccgcttgctgatgactgaagtggcctggactaaagatgagnttaaaaagaagctctggatgatgtaacccttcctcggccttaaggccttcatacctcagctcctgtcacggctgcacattggaagcccttctcccatgggaaacataacaaagcaggctgcattaggaattatgcagatggttgaaggacaccctcattgaacatgctcataccaaacctctccttcaagtcagctggttcggtatagagaagttcagctccctgacagagggatggtttngtttatcagcagagaaaatgaagntcacaataacttgtggnatccgagatatactaccaaacaagacatgcaaaagcacctnngaagaatatgtttcttggagctcttctgtcaanattatctcgnaaccttgcttnaanancctgngcaccaagggangcangatgggggctatatacggacttnnancnggggcccncgntcgannctaaatgggcataacccgggccttgggnggattcatccaatccanntcggaaaaaaggccaccctnanctaccttnnnaaaggnaannngtggntaagcnccccccnnaaactatnncatggggnaaanncccccnnnnanggnaccatnaatanaatgaanggcccttccacnaaaaanaaatttcanggcnntaangcanctttcntggatncttccccccccccccnactgnnnntntttcntcccccccccnggctaaaantattgggggacccccct

SEQ ID NO: 7914 - DNA, 957 bp, Homo sapiens
  misc_feature 3, 7, 8, 9, 11, 12, 22, 30, 32, 36, 47, 48, 58, 60, 61, 63,65, 68, 74, 82, 84, 86, 92, 95, 98, 111, 113, 115, 116,120, 124, 125, 127, 131, 150, 161, 166, 171, 179, 186, 192,199, 206, 210, 214, 216, 219, 223, 231, 235, 239, 242: n = A,T,C or G
  misc_feature 243, 253, 254, 255, 257, 262, 263, 268, 269, 279, 280, 281,286, 288, 294, 295, 299, 307, 311, 313, 323, 329, 331, 333,336, 342, 344, 345, 347, 353, 363, 364, 367, 370, 371, 381,385, 387, 395, 396, 402, 403, 405, 407, 408, 412, 415: n = A,T,C or G
  misc_feature 416, 417, 420, 421, 433, 439, 441, 452, 459, 460, 461, 467,469, 470, 475, 487, 490, 493, 498, 514, 516, 521, 523, 531,541, 545, 546, 548, 550, 554, 561, 563, 565, 568, 570, 580,583, 585, 590, 593, 594, 600, 603, 604, 605, 606, 610: n = A,T,C or G
  misc_feature 613, 615, 617, 618, 627, 628, 631, 632, 634, 636, 639, 645,646, 649, 650, 651, 658, 665, 670, 671, 681, 682, 683, 685,688, 689, 704, 705, 709, 710, 716, 717, 721, 723, 724, 729,731, 736, 737, 739, 741, 745, 748, 751, 752, 753, 754: n = A,T,C or G
  misc_feature 756, 758, 760, 767, 769, 770, 775, 778, 779, 790, 794, 796,800, 804, 805, 816, 818, 822, 830, 832, 836, 838, 839, 840,842, 846, 854, 856, 858, 865, 868, 871, 878, 879, 882, 887,890, 893, 894, 895, 896, 898, 903, 906, 908, 911, 912: n = A,T,C or G
  misc_feature 913, 918, 920, 921, 922, 930, 932, 939, 945, 947, 955: n = A,T,C or G
tgncacnnngnnaagtgtgtgnaggcctgnantttngcatagcgtanntttgtgttgncnnanantcnctaganctatatancngntttggnctntgnaccatagagtgcncncnngctnaggnngngttnactccgagtgagaatggantggtttaggcngtttntttanctggggcnagaggcncgtgtnattttgncataagntcangtcncntanggcnccatgctncccngagncanngggtaactannncnctaannatccnngttatttcgnnngatananatcctnntggngatatggnccantntatgtacctnattgtncntnaantaattntnntntggttngtgacctatnntcnccnnatttattacncggngntagttcanncctganngngnngacnatnnngtnntcggctatttanaaccgntnctatattgggntctgtgnnncctacnannattgntacaacctactnttnttntttcntatcttcactaattgntnatgcncnactggttngaaagatcgnccanncnanttanatggtcntnanaantnaatggagagnacnantttgnctnnggcaanaannnngatnaangngnnccaaagtgnntcnngngnggnggcgtnncannnaataaanagggcgnggggnngaataatagnnntncanncttatggtatgaaannaacnnctgggnngtgngnnttaancnccaanngncnattnttntannnngngngntgctctnanngttgnctnnatagagtcccngctntntttnatanngccgcaaatancnaaangagtgttntnttcnannnanaaanaatactgncncnctatttnctntgngcattanncantcctnatncgnnnntntaaantcncnttnnnttatntnnngttcacanancatattnccgtantntgtatatnac

SEQ ID NO: 7915 - DNA, 972 bp, Homo sapiens
  misc_feature 2, 3, 5, 7, 8, 47, 91, 99, 115, 116, 117, 119, 121, 122,129, 153, 154, 165, 168, 172, 191, 194, 195, 200, 202, 214,215, 220, 223, 224, 257, 258, 260, 265, 268, 272, 273, 274,280, 281, 288, 293, 295, 298, 307, 308, 310, 311, 315: n = A,T,C or G
  misc_feature 317, 319, 321, 328, 336, 337, 339, 342, 343, 349, 360, 361,373, 376, 379, 382, 388, 391, 399, 400, 407, 409, 411, 412,413, 414, 438, 444, 445, 447, 451, 453, 457, 458, 460, 465,466, 471, 474, 475, 496, 508, 509, 512, 517, 521, 531: n = A,T,C or G
  misc_feature 533, 540, 542, 546, 555, 560, 567, 570, 575, 583, 584, 601,611, 615, 617, 619, 634, 640, 643, 646, 647, 650, 656, 660,669, 671, 672, 674, 677, 681, 684, 687, 690, 695, 701, 707,708, 710, 714, 718, 722, 730, 732, 738, 740, 742, 743: n = A,T,C or G
  misc_feature 749, 755, 758, 759, 763, 766, 768, 769, 780, 788, 789, 794,800, 815, 820, 822, 825, 833, 841, 846, 858, 860, 861, 863,867, 870, 878, 880, 890, 892, 898, 900, 904, 906, 916, 923,927, 930, 936, 937, 961: n = A,T,C or G
tnnantnncttcaactcttgttctttttgcaggaccctcgattcganacaagcgacactctagtggtgatgggaatagtaaattaaaaagngagtatcntggatttggacaacgnnnancnncaaaatntgagatggttgaatgaatggcccnntgtcatgatanatnaggncacttttggaaagggttgnggnncgaangngaaatattttcnngtggnttnngagctatttttcctttcaagtccctctcttttnncnttgcnatncccnnncttgtnntggatgnattgnancancatctcctnntnncctnanantnggaaatngttaaatnncntannggttcnccattcatttnnttaccaaacggntanccnttntttccnctncccttttnnccctcgntnannnnttctggttttttttcccccccctngggctnnanatantnggtnntnccatnntttcntanngggggaaaaccaaaatatctncccccatttttnnggntaacngggntaaaatctgntngctcggnantttncaataaaantttantctcccnccnactcncaatcgtnntatgtaaaccccccccnttttttttcncctncngngaaaatatatgggcntaaaanatnatnnatntaaaantttnttttcaccntnngncancttnganttntcncactnataatntctccnntncctnagangctncactttcnantttccnantnnctttcntattanctnnccanccnanncttaatattgnccattcgnncaacntgggcnccatttcctttttgngttantncanaaaattanccctttcnttgtnagcccccttttntnntntttnatntccctttngnctctttaacntnggtgancnaaanantattataccntcccaanaacnttntctttnncccctaaatttccctcttttaaanaccctttggtc

SEQ ID NO: 7916 - DNA, 724 bp, Homo sapiens
  misc_feature 13, 18, 21, 34, 59, 106, 116, 119, 128, 139, 147, 179, 205,206, 209, 214, 229, 255, 257, 263, 301, 319, 363, 365, 374,385, 391, 396, 425, 428, 444, 445, 446, 457, 463, 475, 492,496, 497, 510, 511, 513, 524, 540, 545, 560, 567, 568: n = A,T,C or G
  misc_feature 588, 609, 618, 644, 654, 669, 686, 696: n = A,T,C or G
agttacacgttcnttaanacngtgcactctgaantgtactcagtgaaaatctgttttgngtttcattaatgctatttcaccagttagacataattacttctaccgntgtgaatganacngatgccggnggagctaccanatctttcncactcaactgctaggtcaattagattgccatnttaaaacttggcggattctacaagannatntgacnaccaggaactacatnctatgatggaaaactatccatactgnanactccntgtgtaattatcatgctgctgctgctgtgctctggaantctcaatatgacatttanactctgcgcctactaaaggcatcttctggagtttttgggaggananaaactgganaattaaatcgnattttngccanaagactcttacttgcatgtgtctcaaggnctncaatttttctataagnnnccatatccaangttcanaattcatgtganatacttctttggggcanaagnncttcattcctggnntntattggatcgnaaatctgtagcaagangctgnttaaaattaccatantggtttnntatcttatactcagctctcnggctattgaacttcttttctngtttgaagntagcttcaaaatttgctcctatgctnaattacctgnaaatattctggatangaactacttcgaaatantaatttggtnaaagatatgacaaaatgaaatgccttaa

SEQ ID NO: 7917 - DNA, 1507 bp, Homo sapiens
  misc_feature 2, 4, 5, 6, 7, 8, 9, 10, 11, 12, 13, 14, 15, 16, 17, 18,19, 20, 21, 22, 23, 25, 27, 28, 29, 30, 31, 32, 33, 39,41, 42, 43, 44, 45, 46, 47, 48, 49, 50, 51, 52, 53, 54,55, 56, 57, 58, 59, 60, 62, 63, 65, 67, 70, 71, 72, 73,74, 75: n = A,T,C or G
  misc_feature 76, 77, 78, 79, 80, 81, 84, 85, 86, 87, 88, 89, 90, 91, 92,93, 94, 95, 96, 97, 98, 99, 100, 101, 102, 103, 104, 108,109, 110, 112, 113, 130, 137, 138, 139, 140, 141, 142, 143,153, 155, 156, 158, 160, 161, 162, 171, 181, 187, 188: n = A,T,C or G
  misc_feature 189, 191, 192, 193, 194, 196, 210, 211, 212, 213, 214, 219,232, 233, 235, 236, 237, 238, 239, 240, 241, 242, 243, 244,247, 248, 249, 250, 253, 256, 270, 276, 278, 280, 282, 283,285, 287, 288, 289, 290, 293, 295, 297, 298, 299, 304: n = A,T,C or G
  misc_feature 306, 308, 310, 311, 314, 319, 321, 323, 325, 326, 334, 336,339, 343, 346, 347, 353, 363, 367, 373, 374, 375, 384, 388,389, 392, 393, 409, 410, 412, 413, 416, 418, 423, 426, 427,434, 435, 437, 438, 443, 447, 449, 450, 451, 456, 457: n = A,T,C or G
  misc_feature 459, 460, 461, 464, 471, 473, 476, 481, 482, 486, 493, 497,500, 503, 506, 509, 513, 515, 517, 518, 524, 525, 526, 529,530, 531, 534, 542, 559, 566, 567, 570, 583, 584, 585, 586,587, 590, 591, 594, 596, 600, 601, 609, 612, 614, 616: n = A,T,C or G
  misc_feature 621, 629, 631, 635, 637, 638, 640, 643, 645, 647, 653, 657,658, 659, 661, 663, 678, 682, 683, 685, 689, 692, 694, 702,706, 713, 715, 728, 730, 732, 735, 738, 745, 747, 749, 755,756, 758, 763, 765, 770, 773, 778, 789, 790, 794, 799: n = A,T,C or G
gngnnnnnnnnnnnnnnnnnnnngngnnnnnnnaggggngnnnnnnnnnnnnnnnnnnnngnngngnggnnnnnnnnnnnnggnnnnnnnnnnnnnnnnnnnnnaggnnngnnacttttttgggaaaaanccccccnnnnnnntttttaattnannancnnngggggggcnccccgaatgngagggnnngnnnncnagataaggggcggnnnnnggggngttttttttttcnnannnnnnnnnnacnnnncanggngggggggggggggntttttngnangnncntnnnnccnantnnntctangngngnngcngcgtngngngnnggggagangnggngtgngcnngcgggngggtgaagcnaatngagggnnnatcgggtgngacnnggnngggaggcgggaatggnngnnggngngagtnggnntatgtgnngnngcgtnccgngnnnggggnncnnncgnggggggngngcngtacnngggngcgaggngtancgnggngcngcngtgngngnnctgggnnnagnnncgnaggtcgcnagggggagcgggcgggngggggcnnggngaatgtcggcggnnnnnggnnggngnccgnnagccgcgnggngntngctgnggcagggnantggngnngngtngntntagagnacgnnngngnagcacgtgcggcgtntagnngnaggnganangggcgatntggngactggngnggagggggggacntntnggngangtgtggngnanggacgnngntgcgngngcggntcnggggngactgaggggnntgcngatgnnagggngnngaanggggtcnngnggngngggtgngnangnntnnggngnnngnncngancgntnncnggggnngngggngtngtgngnngnnnngcgnagngnncnngngnnnntagnngngggnnnnngagagnnngggnnnnnatcgacngnngnnggtacnnggtgnnggtagncgananngatngggggnangngcgnntngnctngtncgnngngngttngngnaagacgtnngcgnnannctnggggngngganngagtnngggtgcggacngngaangggtangggggtacgnnnngtangngggnnagcgnagtngtagngcgngtggtgcgnncnggancnnnggnnacnnnggtgngatgggggcacgngaagacgagcgctngcgcacgnnggganganatagntgnggtaaganagagggnngcggnngnatgctgtcgacgtntncangtngncggtgngcgngctgtngcntgnagganggggggggggnnatgtgnatgngtnnnagcncanggngaggggcnnnattagcgtgnggcgcgggctnncgggggggncgnnngtcatngacgncnngtngcggagtnttgcgncngngcgagagnngnnngnggngggngtnggcgcgggtatgngnnaggagatgagtgcgngatgggagctcgctctnngtaggtnggggtcgatgcgccgn

SEQ ID NO: 7918 - DNA, 726 bp, Homo sapiens
  misc_feature 1, 190: n = A,T,C or G
ntttgaccccttatcgccgagtgaggaaagaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagngttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgcctttcaaacatttaattggccaggttatgattgacaaaaatccaggaatcacctcagcagtaaataaaataaataatattgacaatatgtaccgaaatttccaaatggaagtgctatctggagagcagaacatgatgacaaaggttcgagaaaacaactacacctatgaatttgatttttcaaaagtctattggaatcctcgtctgtctacagaacacagcccgtatcacagaacttctcaaacctgggggatgtcctatttgatgtttttgctggggttgggccctttgccattccagtagcaaagaaaaactgcactgtatttgccaatgatctcaatcctgatctcataaatggg

SEQ ID NO: 7919 - DNA, 746 bp, Homo sapiens
  misc_feature 1, 12, 13, 15, 35, 107, 138, 629, 638, 643, 664, 691, 693,744, 745: n = A,T,C or G
ngttacaccttnnantccgcacgaggagagtgctnccttaaaaatgcaaagttgaagaactgtaacctcagaggagcaactctggcaggaactgatttagaagaatngtgatctgtctgggtgtgatcttcaagaaanccaacctgagagggtccaacgtggaagggagctatatttgaagagatgctgacaccactgcacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcattttgagggattttaatttatgggaaagcccaacattatgccattatatttattggnattcctaanatgcngtatgggatatttaaaattgntaaaactttatgaaaacttgggaaaangntgttcaaggtttataaataacctttaatggatgccctcccctcttttaaannt

SEQ ID NO: 7920 - DNA, 1059 bp, Homo sapiens
  misc_feature 1, 2, 3, 4, 5, 6, 7, 8, 9, 11, 12, 15, 16, 17, 18, 22, 23,26, 28, 29, 30, 31, 32, 33, 34, 35, 36, 38, 40, 43, 44,45, 46, 47, 48, 49, 50, 51, 52, 53, 54, 55, 56, 57, 58,59, 60, 61, 62, 63, 64, 65, 66, 69, 70, 74, 84, 88, 90,91: n = A,T,C or G
  misc_feature 92, 97, 99, 102, 130, 131, 132, 133, 134, 142, 143, 144,146, 157, 158, 161, 163, 171, 173, 190, 191, 193, 194, 195,199, 201, 202, 206, 209, 210, 213, 215, 216, 217, 218, 219,220, 224, 225, 229, 230, 231, 232, 234, 236, 238, 244: n = A,T,C or G
  misc_feature 245, 260, 261, 263, 268, 270, 271, 274, 278, 280, 282, 287,288, 289, 291, 295, 299, 310, 315, 318, 319, 320, 325, 339,340, 341, 349, 350, 351, 357, 358, 368, 379, 382, 388, 391,392, 404, 406, 407, 418, 424, 429, 433, 443, 447, 451: n = A,T,C or G
  misc_feature 452, 456, 461, 463, 473, 474, 475, 479, 482, 485, 491, 495,503, 504, 513, 514, 516, 521, 522, 523, 524, 525, 533, 535,536, 537, 539, 551, 557, 559, 562, 563, 569, 575, 578, 584,593, 599, 601, 626, 642, 643, 644, 645, 646, 650, 653: n = A,T,C or G
  misc_feature 666, 670, 672, 673, 677, 678, 680, 681, 684, 687, 689, 695,699, 702, 706, 708, 711, 712, 713, 714, 717, 720, 725, 727,730, 731, 733, 736, 737, 739, 740, 743, 752, 754, 759, 769,771, 780, 783, 785, 787, 791, 792, 795, 797, 816, 819: n = A,T,C or G
  misc_feature 821, 822, 827, 835, 837, 838, 841, 842, 843, 844, 848, 853,854, 860, 862, 865, 870, 876, 877, 900, 908, 909, 915, 922,923, 924, 932, 937, 939, 945, 948, 955, 957, 959, 962, 963,964, 965, 969, 977, 980, 991, 996, 1007, 1008, 1009: n = A,T,C or G
nnnnnnnnngnnggnnnngggnnggngnnnnnnnnngngnggnnnnnnnnnnnnnnnnnnnnnnnngtnntgantcttggaaancccngnnnttttngnagnacccggggggccggattggggttgcggnnnnnagggggcnnnanctttttttttnnctngnggcccggngncgggggggggggggttnnannngggngnngccnccnntgntnnnnnngggnncgcnnnngngncngggcanngggtgagggggggtnngntgggncnnggngggntngncggtnnngncgcnaccngatggtggggntggtnggnnntgccngggggaacgtgggnnncggcgggnnngtgggnnaccgcggggngggggggcggnctnccaaanggnntgcggggggggncnntccgtgggggnggaggnctggncccnggggggaggngggnccgnngggncccgncngggccctgtnnncgcnccnggncggccnagcnggggccgnntgggggccnngngtgcnnnnngcccgggncnnngntgtcccccggcnagggangnggnnctgggncggggnggnctgtgntggggtgcngggggncnggggggaacgtgggggggggggggncccatggggggggggnnnnngtcnggnccgaggagggggnggcncnngggnngnntanggnanggggcngacngangggncnggnnnnggnggngaagncncgnngnggnngnngtngggcgggtntngcccnatcagattgngngaagggggnggngnangcgnngcngngggggggggggaccggggnggncnnggggngtgtgggntnnggnnnncggngcgtnngggggngnaanggggncggggnngcagggccgggtgcccggtgggngggggtgnnggtggntggccgnnngccggggnggctncngggcgngangggggtnangnccnnnngggngggggggncancggagggggcntttangagccggatgnnngnggggnnggnggncggggccnnnacaattgggangnnnnggngtgancn

SEQ ID NO: 7921 - DNA, 739 bp, Homo sapiens
  misc_feature 1, 2, 7, 10, 15, 24, 29, 33, 35, 46, 48, 49, 52, 54, 57,62, 65, 70, 73, 77, 90, 96, 101, 105, 116, 121, 144, 682,710: n = A,T,C or G
nnttacncgntcgantcgcacgantggangaancnacaaggaaaancnngcncntgnaaaangtncaggntcnaatncggatggtcctcncctatntgttngctnagttgagcctntggtntcggggtgtccacggggggctcntcgtgctgggatccgccaacgtggatgagaagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagcccttgaggacaacaggtttgatcttgcgaccatttcttgtacaacacaaactggccttggcaagttttcggtgcataanaaaatcaggtgctacagcttcgagcctnttaaaactatagtgagtcgtattacctaa

SEQ ID NO: 7922 - DNA, 1373 bp, Homo sapiens
  misc_feature 2, 3, 4, 5, 6, 7, 8, 9, 10, 11, 12, 13, 14, 15, 16, 17, 18,19, 20, 21, 22, 23, 24, 25, 26, 27, 28, 29, 30, 32, 33,34, 35, 36, 37, 38, 39, 40, 41, 42, 43, 44, 49, 50, 51,53, 54, 55, 56, 57, 58, 59, 60, 61, 62, 63, 64, 65, 66,67: n = A,T,C or G
  misc_feature 68, 69, 70, 71, 72, 73, 74, 75, 76, 77, 78, 79, 81, 82, 83,84, 85, 86, 87, 88, 89, 90, 91, 92, 93, 94, 95, 96, 97,99, 107, 108, 109, 110, 111, 112, 113, 114, 115, 116, 117,118, 119, 120, 121, 122, 123, 124, 125, 127, 128, 129, 130: n = A,T,C or G
  misc_feature 136, 137, 139, 146, 161, 168, 169, 170, 171, 172, 173, 174,175, 176, 178, 181, 182, 184, 185, 186, 188, 190, 193, 194,196, 197, 198, 205, 211, 212, 219, 228, 229, 230, 231, 232,233, 235, 236, 237, 238, 239, 240, 242, 254, 256, 258: n = A,T,C or G
  misc_feature 259, 260, 261, 265, 267, 279, 280, 281, 282, 283, 284, 285,286, 287, 289, 290, 291, 292, 293, 295, 297, 301, 302, 303,304, 308, 319, 321, 325, 326, 331, 332, 334, 335, 336, 337,340, 342, 343, 344, 346, 347, 355, 357, 358, 364, 374: n = A,T,C or G
  misc_feature 375, 376, 377, 378, 379, 380, 385, 386, 388, 390, 396, 397,400, 407, 410, 411, 414, 415, 417, 418, 419, 424, 426, 427,428, 433, 437, 438, 440, 445, 446, 447, 449, 450, 453, 454,455, 457, 461, 463, 464, 465, 467, 469, 475, 478, 480: n = A,T,C or G
  misc_feature 486, 487, 488, 492, 494, 495, 501, 507, 510, 512, 513, 516,521, 523, 526, 527, 529, 531, 533, 542, 546, 547, 553, 559,561, 564, 566, 567, 569, 570, 571, 572, 573, 574, 579, 582,583, 585, 588, 590, 594, 597, 598, 601, 604, 611, 614: n = A,T,C or G
annnnnnnnnnnnnnnnnnnnnnnnnnnnngnnnnnnnnnnnnnggggnnngnnnnnnnnnnnnnnnnnnnnnnnnnnngnnnnnnnnnnnnnnnnncncggggggnnnnnnnnnnnnnnnnnnnannnnaggagnntngaaactnctttggggaaaaaanccccccnnnnnnnnntnttnnannngnanccnncnnnggggggngcgccnncctttgnggggggggnnnnnngnnnnnnangggggggggggngngnnnnaaanancttttttttttnnnnnnnnnannnnnangnagcnnnnaggnggggggggggntntttnnagagnnannnngtntnnngnnttttttancnnaggagngcagggggannnnnnnggacnnangngggggnnagnaaggggngannagnnannngggangnnngaggnatcnngnaagannnanncgnnngngggnannngngngcgggnagngngagagnnnagcncnngagggngggganggngnngangtgtnanganngngngnaggggagancagnngggggngaaaangnggngnnannnnnnggaanggnngnaanangagnggnnagngtngcgggcnganggcannangnngcngnnnagngngnncggngnnnnanngacagngggtangnggnnnnanggnnancagaagnnntagnagtgatanagngaggcgaangncananggcgnggnngannggngngnaangnngcgnganngnnnnangcaganggnntnagngngnnanggcngnngggngnagngaannangagnnnngnnnngnnggnagnnnnnnnnnaagnnnnngcnagntnnnngnngngcgnnagcgnnaagnntgnganggtggnaanngnacgtnnangngnncgggngngngnaangnanngcngtgngngnggnagngnnnagnantggngngtgcnaggnngnngnagganngnnnnnannnnanngnnacggagcnncanggnngngnannganagangggngnaancangncncgngnanagcangnaggcnnngnnanntcgnnantntnnagagnatatcannngnannnatgtnnganagngaggacngngngagaannnncgngnacgnnagcgangngnngntangaccangnangtnnnngcacngnnnntatgcgganngncggnataagcngaccgnatnagngggacnnnananagatnnggnagngggngcgctnnngngannanatcnntnngagaggngnagccgntaggncngnngacagngnananataangaagnntcagnnancacgganannnaanaangnngnggggtngacgacggnngnacgcgn

SEQ ID NO: 7923 - DNA, 737 bp, Homo sapiens
  misc_feature 2, 8, 9, 12, 24, 59, 184, 305, 332, 352, 372, 422, 475, 541,658, 666, 704, 732: n = A,T,C or G
cnttttgnntcntattatatacangctacttgttctttttgcaggatcccatcgattcnaattcggcacgagtggaggaaagcagcagggtaaaacctggcgctgcaaaatgtgcaggctcgaatacggatggtcctcgcctatctgtttgctcagttgagcctctggtctcggggtgtccacngtgggctcctcgtgctgggatccgccaacgtggatgagagtctcctgggctacctgaccaagtacgactgctccagtgcggacatcaaccccataggcgggatcagcaagacggacctcanggccttcgtccagttctgcattcagcncttccagcttcctgccctgnagagcattctgttggcgccngccacccgcagaactggagcccttggctgatggacaggtgtcccagaccnacgaggaagatatggggatgacatatgcggagctctcggtctatgggaaactnaggaaggtggccaagatggggccctacagcatgttctgcaaactcctcggcatgtggagacacatntgcaccccgagacaggtcgctgacaaagtgaagcggtttttctccaagtactccattaacagacacaagatgaccacgctcacacccgcgtaccacgccgagaactacagccctgangacaacangtttgatctgcgaccatttctgtaccaacacaaactgnccttggcagattcggtgcataaaaaatnagtgt

SEQ ID NO: 7924 - DNA, 754 bp, Homo sapiens
  misc_feature 4, 76, 78, 87, 89, 91, 97, 108, 124, 151, 168, 545, 575,604, 646, 681, 742, 754: n = A,T,C or G
tatncgttacaactacttgttctttttgcaggatcccatcgattcgaattcggcacgagaccgggaccaaaacatnanccgcttggncntncaaaanaatcaacctgnaggatctcaggtttcntctggtctgtggggagggcaaaaaggntcgggtgatggccaccnttggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgcttgtcggcctatgagcctaatgaccacagcaggtatacaagctctggcccaagctctggtcctgggggcccggggtaccccccgagaccgtggctggcgtctccccaacaacaagctgggttccggggatgacatctctgtcttcgtcatccccctgggagggccangcagttactcctgaggggctgaacaccatncttccactacctcttcatacttactcctntacagcccaaattctgaagttgtctcctgacccttcttttantggcaacttaactgaagaagggatgtccgtttatncaaaattacactattggcaaataaccaagatggataaaaaaaaaaaaaaaaacccctttanaactatatgagn

SEQ ID NO: 7925 - DNA, 725 bp, Homo sapiens
  misc_feature 8, 11, 16: n = A,T,C or G
tttaaccnctntcgantcggcacgatggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgctttaggagtcctcacccctcagactgctgcaggacattgccaggcctctctccacttccttcctcagcatacagacttcatgctatcttccaattccggggagtcttagctattagggcagtttctgcttctccattttggggacaaaggccttgcccagtacaaatctagccccttgtcccacagacttctggatggtataaacctagtggcaatgtagcaaccataggctagaaccaaacccaagatttgggtcagtgccctgttaagggttttaggattggtaaggacaccacagctaaatctgacatgtaaaaggataccctttccctgtcccactacgggtggaggctaaggaccttctcagaacccacagatggctggtgacattgggcacaaggctg

SEQ ID NO: 7926 - DNA, 756 bp, Homo sapiens
  misc_feature 2, 3, 4, 5, 6, 7, 15, 19, 514, 640, 667, 756: n = A,T,C or G
annnnnntttttacntcgntcgaattccgtgctgtcgaattggtttggcacctactacaggatgatccagaccaacttcattgacatgggagaaacatggtttggacttggctgaaagaggagacagaagtggaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcangctgcaggcatccatgatgccattatggctttccctgaagggtacaggacacaggtgggcgagcggggactgaagctgagcggcggggagaagcagcgcgtcgccattgcccgcaccatcctcaangctccgggcatcattctgctggatgangcaaccgtcagcgctggatacatctaatgagaaggccatccaggcttctctggccaaagtctgtgccaaccgcaccaccatcgtagtgn

SEQ ID NO: 7927 - DNA, 742 bp, Homo sapiens
  misc_feature 1, 2, 6, 10, 13, 14, 16, 21, 27, 34, 41, 46, 111, 150, 151,273, 411, 691, 713: n = A,T,C or G
nncccntttntcnncnccganttccgntgctgtngctgganaatanctacgaagctgcccgatggccaggtcatcaccattggcaatgagcggttccggtgtccggaggcnctgttccagccttccttcctgggtatggaatcttgcggnntccacgagaccaccttcaactccatcatgaagtgtgacgtggacatccgcaaagacctgtacgccaacacggtgctgtcgggcggcaccaccatgtacccgggcattgccgacaggatgcanaaggagatcaccgccctggcgcccagcaccatgaagatcaagatcatcgcacccccagagcgcaagtactcggtgtggatcggtggctccatcctggcctcactgtccaccttccagcagatgtggattagcaagcangagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttcccttggtattaacgtgtcagggctgantgttctggggatttctctagangctggcaagaaccagttgttttgtcttgc

SEQ ID NO: 7928 - DNA, 742 bp, Homo sapiens
  misc_feature 1, 2, 3, 4, 16, 18, 27, 539, 552, 741: n = A,T,C or G
nnnnttttgaactccntntgagaaganaccgcagatctggtcagccatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaatctgagttgtcttcttggagctgtaggtcttgaagcancaacgtctttcangggttggagacagaaacccattctccaatctcagtagttttttcgaaaggctgtgatcatttattgatcgtgatatgacttggtactagggtactgaaaaaaatgtctaaggcctttaccagaaacatttttagtaatgaggatgagaactttttcaaatagcaaatatatattggcttaaagcatgang

SEQ ID NO: 7929 - DNA, 1073 bp, Homo sapiens
  misc_feature 5, 6, 9, 13, 14, 18, 19, 21, 23, 24, 26, 27, 29, 30, 31,32, 33, 37, 38, 40, 42, 43, 44, 48, 49, 52, 53, 55, 57,58, 59, 62, 64, 65, 66, 77, 78, 80, 81, 83, 87, 89, 91,93, 96, 98, 101, 102, 105, 109, 110, 111, 112, 113, 118,119: n = A,T,C or G
  misc_feature 120, 121, 122, 127, 129, 131, 133, 135, 137, 143, 150, 151,157, 165, 166, 171, 173, 181, 183, 188, 190, 192, 193, 204,211, 213, 214, 218, 220, 222, 226, 227, 232, 234, 235, 236,237, 239, 240, 264, 267, 277, 278, 288, 297, 299, 303: n = A,T,C or G
  misc_feature 304, 311, 322, 324, 328, 329, 332, 333, 340, 347, 354, 358,374, 384, 393, 398, 414, 415, 424, 441, 443, 445, 466, 472,475, 476, 482, 484, 492, 495, 497, 500, 522, 526, 537, 542,548, 549, 552, 554, 555, 560, 600, 606, 609, 611, 619: n = A,T,C or G
  misc_feature 623, 625, 643, 660, 665, 674, 682, 685, 688, 707, 711, 713,714, 750, 751, 757, 764, 777, 778, 796, 798, 803, 812, 814,816, 818, 819, 833, 834, 843, 853, 857, 866, 872, 873, 880,893, 898, 900, 903, 911, 916, 922, 926, 930, 933, 940: n = A,T,C or G
  misc_feature 941, 942, 948, 949, 952, 954, 960, 963, 966, 969, 972, 973,974, 978, 979, 981, 983, 987, 989, 990, 991, 994, 998, 1002,1003, 1004, 1007, 1008, 1010, 1017, 1019, 1021, 1037, 1038,1041, 1044, 1045, 1049, 1050, 1054, 1055, 1065, 1067: n = A,T,C or G
  misc_feature 1073: n = A,T,C or G
caacnncancccnncccnncnanncnncnnnnnacannancnnnaccnnaannangnnnccncnnncatactacatnncnncncacncncncnccnanacnngancacnnnnncacannnnncgacncncncncncnccaacncactccnnctcacnccagaacnnctccnancacacacnanatatnangnnactcacctcanctctatncnnacgncncnacannccccnannnngnncctttttgaaacccctttcgaaanccncgtggccggnnaaataagcanactggacgncngtannatgtctnttcggcaaagnantatnnctnnaccaaanctagctngtgactnatcncgcagtcataagacantcctaacatngtgactgtnaaagncttggagatggccgcnnggctcctgnatcgactccgtcattantncncatgcaacaaaatacgagccngagttnatnntaaaangngaaaagcnacncnaangaaactcactccattacgtggngaanataaggaagtnatcanagcatnnccnannatcanataagtaacccatcaatgagcaatgccaaagaatactatntgaacngcncnctctctcngctntnaatttggaaatgaggccntgctacgaaaacaactnccaanaaacaacanacctcaangcnaancccaagagggcaagacttnatcnannatagcacccccagagaaaaaccacctaacgactacnnggtacngaagaanttcccttgcggcnnggaaaaacagatgaacangnttgcngaaaaggcncnancnnatgtattaagccannctcagccantaccgagagntacnagaaggacnactcgnncgccccnaagtacctggtanactgncncanccgaaccnggctnaaacanacantccnatngctcccnnncccacnntcncncccccnggnccngcnctnnncccnnanancacnannncangatncccnnntcnntnccctacncncnacccggcccccactanncanccnnctgnnctcnnccccccgacncnctaccn

SEQ ID NO: 7930 - DNA, 749 bp, Homo sapiens
  misc_feature 1, 2, 3, 5, 6, 7, 8, 9, 14, 657, 749: n = A,T,C or G
nnntnnnnntttgnaacccctttcgaatccgttgctgtcgctgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatantatggctaatgaagattaagccctctataaagacttcctgttgaggtgaattctcatactgaaatgtacttacctacaatatttactagagn

SEQ ID NO: 7931 - DNA, 752 bp, Homo sapiens
  misc_feature 1, 3, 4, 5, 6, 18, 584, 587, 592, 593, 594, 595, 598, 599,609, 613, 614, 619, 631, 632, 634, 635, 639, 640, 643, 646,647, 660, 661, 664, 680, 681, 684, 690, 691, 693, 694, 695,696, 697, 698, 699, 700, 701, 702, 703, 704, 705, 706: n = A,T,C or G
  misc_feature 707, 708, 709, 710, 711, 712, 713, 714, 715, 716, 717, 718,720, 721, 722, 723, 724, 725, 726, 727, 729, 730, 732, 733,734, 735, 736, 737, 738, 739, 740, 741, 742, 743, 744, 746,747, 748, 749, 750: n = A,T,C or G
ncnnnnttttaacctcgntcgaattccttgctgtcgttaattgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaanaanaaaannnnaannaaaaaaaaantttnnggggnccttttttcccnnanncccnnccnttnnaaaaaccctttgnnaantttgggaaaccccccnnttnaaaatnntnnnnnnnnnnnnnnnnnnnnnnnnnntnnnnnnnntnntnnnnnnnnnnnnntnnnnncc

SEQ ID NO: 7932 - DNA, 750 bp, Homo sapiens
  misc_feature 1, 2, 3, 4, 5, 6, 7, 19, 736, 739, 749, 750: n = A,T,C or G
nnnnnnntttgaaaccccncgtgagagcctgagcagcaaatctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttcaaaaaaaaaaaaaaaaaaatttcntgnggcccttttnn

SEQ ID NO: 7933 - DNA, 749 bp, Homo sapiens
  misc_feature 1, 2, 3, 4, 5, 6, 603, 643, 657, 708, 736, 744: n = A,T,C or G
nnnnnnctttgaaccctttcgaattccgttgctgtcgtgcctccaagatggtgagtcttcttgcgtggtgagggtgggggttcgggtgcagactctgggattgtggggaagtgagagcctggagcacggctgaggggtggaccgagtgtacatttcatttgctctgggggtcggcgggatttgcggagaaacaggagatccgagcggcgccttcctggaggctgccggtgcggcttgtggccggaaagggactgaggctgggtgagttgcgccgttttcctaacagttttcccatcctgtcgcagacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatggtaagtgggtcaccggcgcgaactgtgtgaggatcccagtatcttaaagccttcgcccaacttcgcccttttggaggctctgttcgttggagcctctcaggcaatttccacgtatttaangttgttactggtagaagagaattctcttgtttgccgtttngattcttttctggncagaaggtgacttttgtgatagagtgcacaagcctttactctgaggtaaanggttgctgtttcggttattaagattgcnaaaactanaaacc

SEQ ID NO: 7934 - DNA, 770 bp, Homo sapiens
  misc_feature 13, 293, 618, 688, 695, 712, 736, 739, 746, 752: n = A,T,C or G
tttaatcaataantgctacttgttctttttgcaggatcccatcgattcgaattccgttgctgtcgccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacanacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggccttcccacaacagcaattttgggtactcgtatgccaagaggatgatcgacgtgcagaacagggcctacttccagcagtacngctgcaccttaccggtgtcattcccaccaacgtctttgggccccacgaacaactttaacatcgaaggatnggccacntgcttgcctgggcttcntccacaaggtgcaccttgggcaanaancaacggnttcggnccttgacggtgttggggg

SEQ ID NO: 7935 - DNA, 753 bp, Homo sapiens
  misc_feature 8, 92, 710, 726: n = A,T,C or G
tttgaaanccctttgctacttgctctttttgcaggatcccatcgattcgaattccgttgctgtcgctttgaaatgtaacaaatggtactacnaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcagttgatccacccaccttggcctcccaaagtgctagtattatgggcgtgaaccaccatgcccagcccgaaaagcttttgaggggctgacttcaatccatgtaggaaagtaaaatggaaggaaattgggtgcatttctaggacttttctaacatatgtctataatatagtgttaaggtcttttttttttcaggaatcatttggaaaatcaaaacaattggcaaactttggattaatgnggttaaagtgcagganacattggtattctgggcaccttcctaa

SEQ ID NO: 7936 - DNA, 755 bp, Homo sapiens
  misc_feature 4, 9, 17, 30, 38, 40, 41, 43, 45, 48, 57, 68, 74, 161, 168,178, 191, 246, 283, 366, 389, 390, 410, 418, 424, 431, 446,452, 474, 492, 499, 507, 529, 537, 567, 575, 576, 577, 580,583, 587, 593, 598, 603, 608, 615, 617, 621, 627, 637: n = A,T,C or G
  misc_feature 638, 641, 654, 661, 672, 678, 681, 701, 708, 709, 710, 720,723, 732, 741, 744: n = A,T,C or G
aacntcggntcaacccntgctggtgtttanatgtaacntnngntnctncacccaatnccagtcttctntttttnacaacatggccccaaaaagcaaccagggctatttgtacagttgaaggggtgaacagaatgggcggctgtgctgggagttggaagacngggcagnaccgctattnagagccatccctnactcagctggcagggacaagccaacgccaggtagcatgtggccacccttgcccantgtctgtggcctggcaagtggccacgccctgtgtcanaccatctgggaattaagctccagacagacttacagatgccttccttaggagttcttgcttcttgcgttgatactttgccccanaaaggcctgggattcattctggnncttatcagggtgtgtccacnctctgctnacaggnggatccnccggctttcagtgcngacagnccagatgcttcctgcagcccangccccgggcaccttctgnaaccatnttgggctnaagacctgaagccggtttcctnggtccccntttccaacaagccttcaccaacaaagcttnggccaaannnttnccnttcnggttgnttttnacccngcttngggcctncnagcnttgaancttggaaaannaantttttcccgaaanttgtttntgggaaacccnagggcnaanggtttttaagggaaggtccnaaaaggnnnttccggggcnggnaaaccaagnccccaaggnttntaaacaaggcc

SEQ ID NO: 7937 - DNA, 838 bp, Homo sapiens
  misc_feature 12, 52, 57, 64, 66, 75, 78, 91, 94, 98, 101, 105, 107, 112,115, 119, 133, 135, 139, 144, 145, 147, 151, 156, 169, 172,174, 180, 184, 193, 197, 202, 208, 210, 215, 227, 231, 239,250, 259, 266, 268, 272, 280, 284, 312, 325, 343, 423: n = A,T,C or G
  misc_feature 528, 532, 564, 576, 585, 592, 641, 690, 695, 710, 711, 720,721, 722, 723, 724, 725, 726, 727, 728, 729, 752, 764, 765,766, 770, 776, 787, 791, 800, 809, 824, 827, 828, 829, 830,831, 832: n = A,T,C or G
tactcgatcgantcgtgctgtcgtcacggtactttgcccaagtcaccccgangtcangcgttanancaggaattnganccccaaagcttanctnttanccntttngntaacnggntgtntttccaggcccccntnaccntttcnntnaccntcccntgccccaggggcntcntntcaaanggcngttcccccntcgnttgcntcagcntntccantttaaagcttcntggntctcctcntgttgaagtcntgggatggntttcccntntcanaaactgcncaanaaacaaccttggagttttgaacaaaggntattcaaggagtnttcaagaatgaatcttcntaatcgtggtcatgagacatgagaaaaaaggtgtctaccacgtcttgtctctactcataaagacattggccaggtgcggnggctcacgcctgtaatcccagcactttgagagggcaaggtgggcggatcacctgaggtcagaagttcaagaaccagcctggccaatgtgacaaaaccccatcttntatnaaaatacaaaagttaactgggtgtggtggcangtgcctgtaatnccaacttcnttgggangcgaaggcaggaagaattgctttgaaccccgggaggcggagccttgcantgagctgaaaatcacacttactggactttcaacctgggggtaccaaaanggganggcttttgctttaannaaaaaaaannnnnnnnnnaaaaatttccttggggggccggnttttttttcggnnnaatnccccanctttgtaaaanaaancctttgggnggaggtttnggggaaaaaaacccnccnnnnnntttttt

SEQ ID NO: 7938 - DNA, 753 bp, Homo sapiens
  misc_feature 1, 2, 3, 4, 6, 19, 24, 27, 289, 498, 534, 573, 616, 619,623, 647, 648, 666, 684, 690, 692, 697, 717, 720, 722, 727,728, 732, 736, 744, 748, 753: n = A,T,C or G
nnnntnttgtttgaacccntttcnatnccgtgctgtcggtcacggtactttgcccaaagtcaccccgatgtcaagcgttagagcaagaatttgaaccccagagcttaactcttaaccattttgctaactggctgtctctccaggcccccatcaccctttccatcaccctcccctgccccaggggcatcctatcaaatggcagttcccccctcgcttgcctcagcatctccaatttagagcttcatggatctcctcctgttgaagtcatgggatggatttcccatctcanaaactgcacaagaaacaaccttggagttttgaacaaaggatattcaaggagtattcaagaatgaatcttcataatcgtggtcatgagacatgagaaaaaaggtgtctaccacgtcttgtctctactcataaagaacattggccacgtgcggtggctcacgcctgtaatcccagcacttttgagagggcaaggtgggcggatcacctgangtcagaagttcaagaccagcctggccaatgtgacanaaccccatctctataaaaatacaaaagttagcctgggtntggtggcaggtgcctgtaatcccagcttccttgggaggcgaangcngganaattgcttgaaccccggtaggcgnngctttgcattgagcttanaatcacactactgcactncaatcntngggtncaaaagggaggctttgctanacnanaatcnntaanaaanttccgggncccnctttn

SEQ ID NO: 7939 - DNA, 748 bp, Homo sapiens
  misc_feature 1, 2, 3, 4, 5, 6, 7, 8, 9, 14, 15, 23: n = A,T,C or G
nnnnnnnnnttttnnaccttcgnttcgaattccgttgctgtcggacatcacagcccctatgaagaaagtagccacaatctcaaataacaaaagggaatgttctaaaactttttcttccttaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgtttcccgtctaggttct

SEQ ID NO: 7940 - DNA, 843 bp, Homo sapiens
  misc_feature 1, 483, 615, 650, 654, 672, 680, 683, 684, 711, 723, 724,733, 743, 751, 753, 758, 761, 762, 765, 766, 777, 779, 783,790, 794, 795, 799, 802, 814, 829, 841: n = A,T,C or G
nttcgattccgtgctgtcgggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagccccaagagggctgtncaaaagggaaacacatgtggactaaaaaagatgctgggaaaaaagttgttccatgtagacatgactggcatcagactggaggtgaagttaccatttcagtatatgctaaaaactcactttccagaaccttancccgagttgaagccaaatttgcccatttggttaantggngcattatttggaattttngaaagggncannaaagggaatttttggatccaaaaaatngtggaaaatttnnttggggggnttgtggaatntggaatgntnaaaanccnnaanntttttgttaancntatntgacctnggcnnaccnaangtatttgggaanttccccttttttgtnaataaaaaaagnct

SEQ ID NO: 7941 - DNA, 815 bp, Homo sapiens
  misc_feature 8, 18, 20, 578, 689, 754, 778, 787, 792: n = A,T,C or G
ttactttnaacccttgcnantccgggctgtcgggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggntgaagttccattcagtatatgctaaaaactcactttcagaacttacccgagtagaacaaatagcacattggtaaatgtgcatattgttttggaaggagagaaaggaatttnatcaaaatggtgaaaattatttggggtgtggattggatgttaaaagccgaaagttttgttacctnttgactggcaaccaaaagaattgnaatcacttntgagnaaaagcttgaacccgatgccagt

SEQ ID NO: 7942 - DNA, 801 bp, Homo sapiens
  misc_feature 2, 3, 6, 7, 11, 14, 20, 688, 735, 763: n = A,T,C or G
gnnttnnaccncgnatcganttccgttgctgtcgctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttaaatacaaaagttaacttgggtgtggtggcaaaagcctgtaatccagcttccttgggaagctgaaggcnggaaaaaatgcttggaccccggggaccgaggttacaagtgagccganatcgcacttggtgtacccaagcctgggncccagtgcaagaatccttttcaaaaaaaaaaaaaaaaa

SEQ ID NO: 7943 - DNA, 788 bp, Homo sapiens
  misc_feature 2, 3, 4, 5, 6, 7, 8, 9, 10, 11, 12, 13, 14, 15, 20, 21, 28,51, 696, 725, 763: n = A,T,C or G
gnnnnnnnnnnnnnnttttnnaactcgntcgaattccgtgcttgtcgctgncggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatcaaaagttaaatcaaaagttagctgggtgtggtggcaaaaggcctgtaatcccagcttccttgggaagctgangcgggagaattgcttgaaccccggggacngaggttacagtgagcccagatcgcactgttgtacccanctggggccacagtgcaagaattcat

SEQ ID NO: 7944 - DNA, 764 bp, Homo sapiens
  misc_feature 4, 6, 9, 10, 16, 25, 26, 28, 217, 226, 237, 242, 243, 330,422, 426, 475, 477, 483, 504, 521, 733: n = A,T,C or G
actngntcnnatccgntgctgtcgnngnttagagttaaaagtcaataagcattacaaaaattgccattttgacatcagcaaatcaaatttctctatctaattaaaggaaaaccctttctcttatttctcttctcttttcctcttctcttcctcctcctctatttcccctctccttatccccttgtctccctcttctgctctttctctacttcctctntctcttttnctgatgtatgnctatnntatattttcagaaataattcagtggcatctcatgtagatgtaccactttcttattgcaactcagagtgcaattgtgatgaaagtcantgggaaccagtctgtgggaacaatggaataacttacctgtcaccttgtctagcaggatgcaaatcctcaagtggtattaaaaagcatacagngttngatactgtagttgtgtggaagtaactggctccagaacagaaatactcancncacttngggtgaatgcccaagagatantacttgtaccaaggaanttttcatctatgttgcaattcaagtcataaacctctttgttctctgcaacaggaggtaccacatttatcttgttgactgtgaagattgttcaacctgaattgaaagcacttgcaatggggttttccagtcaatggttataagaacactagggaggaatctagctccaatatattttgggggctctgattgataaaaccatgtatgaagtggnccaccaacagctgtggagcccaaggagcttt

SEQ ID NO: 7945 - DNA, 871 bp, Homo sapiens
  misc_feature 5, 116, 117, 126, 139, 165, 166, 172, 176, 184, 198, 215,218, 225, 236, 287, 307, 312, 328, 332, 380, 416, 449, 458,463, 473, 497, 502, 557, 576, 588, 611, 635, 649, 670, 690,729, 733, 734, 736, 741, 744, 745, 746, 758, 768, 800: n = A,T,C or G
  misc_feature 805, 806, 807, 810, 823, 826, 827, 829, 842, 845, 847, 853,854, 855, 864, 869, 870: n = A,T,C or G
ctcgntcgattccgtgctgtcggagctagatggactaggagagacttgattttggtgctaaagttccccagttcatatgtgacatctttttaaaaaaaataacaacaaaaaaaaanngagagaaangctaaaaaaaaangtagggggtgaccagttaagggtttnnattccncatncaatatcngggtaaaacgattncctgtaaaagtagcttnaanggttttngctctaaaatnccgtaggtctatccttagagcactcacgccatgctttcttccctgggtttnaaacttcatataactttcanaaatnggagagcaaaaatttngctngtcactgcacatcaatttaaaaaagcttatttaacttatcaaaacgtntttattgccaaactatgctttttttggtaaatttgnccatattaatcgggatgacaaatccatagaatntatcctttnatgtnaaattatganctcatattaatcttaaaattttgngacgngtcttttccctttttttccacagtttaaatatataattcttaaccgacatttttnggaacctttacactttttngggtaatttaanttttaaaaaaaaattgaaaaaanttaaattttaaaaaaaaatggccnaaaaaaccctggtngggaattaatttaaatttttnaaaaaaattttccccccccnttttgggggtttggggaacctggccaaaaattgggaagntttnncnttttnccnnntttttaaagggncccttttttncaccaaacctttgggggaccctgggaaaaaantgggnnnttnggtaaaaaaaagnttnncntggggggaacccnggntncccccnnnaaagggggnaaaannc

SEQ ID NO: 7946 - DNA, 936 bp, Homo sapiens
  misc_feature 4, 6, 8, 96, 284, 368, 375, 382, 388, 435, 462, 470, 474,477, 486, 489, 504, 508, 511, 517, 524, 541, 548, 552, 553,556, 566, 569, 588, 590, 591, 593, 603, 604, 612, 615, 621,627, 660, 666, 668, 672, 687, 696, 735, 745, 748, 751: n = A,T,C or G
  misc_feature 758, 762, 775, 776, 787, 790, 792, 797, 808, 821, 832, 836,837, 845, 846, 852, 858, 866, 872, 879, 891, 892, 917, 922,926, 932: n = A,T,C or G
ttgnancnctttcgaatccgtgctgtcgcgggtgagtgagagagttggttggtgttgggccggaggaaagcgggaagactcatcggagcgtgtggntttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgntgaatttgaagatccccgagatgcagctgatgcagtccgagagctagatggaagaacactatgtggctgccgtgtaagagtggnactgtcnaatggtnaaaatngaagtttgaaatcgtggcccaccttcctcttgggggtcgtcgccctngagatgattatccgtatgaggagtccntccacctngttncanatctccaanaanggagaaagctttttnttcncancccggnagccaangtccccctttttctagnagaattnggannaantaattagtangantcctctttgttttcggggnannanaaaaaattcnnccaaaganccngttccnccggantcccttttcttcctaaggggtctttccggtaanttccgnantccntatgggctccaaaanttggaaatnggggtaattttatgcaactctaccaagtttttggtcaanctaaaaaaanttnggntttgtcncccnggggaaaaatttnncttttaatttnttnancccgngaactttttgnttcccctgaaaanttttccaaagntttnnggtttttnnaaaaanttttanttaaaacntttggncccccantttttttaaaannatgtttttaaaatcctgtgttctcnaaaantctngttttngcct

SEQ ID NO: 7947 - DNA, 756 bp, Homo sapiens
  misc_feature 3, 5, 6, 10, 11, 14, 22, 29, 31, 37, 49, 57, 72, 76, 78,107, 110, 116, 131, 135, 571, 579, 581, 591, 599, 609, 624,669, 682, 726, 745: n = A,T,C or G
gtnanncctnngangcggcagnctgcttntngccaancagtcctattgngaggtctnggctatcaggccagntgtnanaccactccatgcactgggtgtgctctgtnggncagggnctgggagggaaactncctntccttcccttaaccaagcatgaattatgtttgttagcaaacctctctgggaatatatgtcaagccacattcctcctggggcagctgcaacttcagggcttcacaataaacagttctgaaaaccagatattatctgcaatttagcatacagcatggaattatgatacataattcactatgcttcagagaatagggctgcaagaagataaaataagggttttaattcccagctatctctctcaaattttaagagagatgttatggactgtgctctccccacaacccggcccataagtcgcatgttgaagttcttacctctagtaccttggactgtgactatatttggaaacagggcctttaaagagacagttaagtgaaaaggaggcctttagtatgggcctagtgtaatctgccagcccttatcagattaataaagntaaatacncngaaagatccngagatgcnttagcgcaangaaagacatgtgacncaccaagagaagcagccatagcaaccaaaacagtggccttagaanaatcaaccctgcngtccttgtcttggactttcacttccaaatgtaagaaagaactcngatgttaagcatcctctgngaatttgttgg

SEQ ID NO: 7948 - DNA, 762 bp, Homo sapiens
  misc_feature 10, 631, 635, 651, 758, 761, 762: n = A,T,C or G
tcgtctgaancgggcagcactgtcattcatagccaaacagtcctattgagaggtcttggactatcaggccagctgtcagaccactccatgcactgggtgtgctctgttggtcagggactgggagggaaactacctctccttcccttaaccaagcatgaattatgtttgttagcaaacctctctgggaatatatgtcaagccacattcctcctggggcagctgcaacttcagggcttcacaataaacagttctgaaaaccagatattatctgcaatttagcatacagcatggaattatgatacataattcactatgcttcagagaatagggctgcaagaagataaaataagggttttaattcccagctatctctctcaaattttaagagagatgttatggactgtgctctccccacaacccggcccataagtcgcatgttgaagttcttacctctagtaccttggactgtgactatatttggaaacagggcctttaaagagacagttaagtgaaaaggaggcctttagtatgggcctagtgtaatctgaccagcccttatcagattaataaagttaaatacacagaaagataccagagatgcattagcgcaaaggaaagaccatgtgagccncacnaagagaaggcagcctnggcaagcccaagaacagtggccttagaagaaatcaacccctgccagtacccttgatcttggaccttccagctttccaaaattgtaggaaaaggaactcctgaggttnaann

SEQ ID NO: 7949 - DNA, 788 bp, Homo sapiens
  misc_feature 10, 11, 17, 640, 707, 714, 726, 728, 743: n = A,T,C or G
tactcgatcnnattcgnaaccgtgctgtcgcattaactttcagtttccccatgttacttttgtaacagggatttgagaccttaaactgttcatcaaagtaagccctaatagaaaggcagagcaataagagcacatgctgatgtaattctcctttgcaaggagaatttcatttagttccattgtcatatagaccagtgtcaccccttttccctgattcctactgttaacaactatttttcagtgcctttgaagatactgacccttctacctgcccagctgtttttaaacagctggagcgtgatgatggtcataaaatatataagtgttttagcatgtacagtaaaactaggttgtttagttaaacatagagttttgcctactttttcaattcgtttgactgcaggtgtggtcatttagttgcaaaccatttccatagtctgcttccactgtccagttaatctgtttttttccccttctatcatctgagcattcatctgtcatttccttcttttttatttatttatttatttatttatttatttattttggagatggagtctcactctgtcgttcaggctggagtgcagtggtgcagtctcagctcactgcaatctctgccttccaagttgaagcaattctnctccctcagcccttcctagtagctggggattacaggtgtggtatcaccatccttggctaatattgtnttttaanaagagatggggngncactatgttggtcangctggccttgaactcctgacctcaggggaatcttcctccttggcc

SEQ ID NO: 7950 - DNA, 994 bp, Homo sapiens
  misc_feature 2, 4, 6, 11, 20, 33, 36, 43, 59, 62, 67, 82, 119, 125, 126,145, 148, 166, 173, 175, 189, 193, 195, 197, 200, 209, 211,212, 215, 219, 223, 225, 226, 233, 234, 235, 237, 244, 245,246, 247, 248, 249, 250, 252, 256, 257, 260, 261, 265: n = A,T,C or G
  misc_feature 266, 273, 274, 277, 279, 285, 293, 294, 298, 307, 309, 312,313, 314, 315, 317, 321, 322, 327, 328, 329, 332, 334, 335,336, 337, 338, 346, 358, 359, 364, 372, 376, 380, 381, 383,384, 386, 388, 389, 395, 396, 401, 405, 407, 412, 415: n = A,T,C or G
  misc_feature 416, 417, 418, 421, 422, 431, 447, 452, 454, 458, 463, 468,469, 472, 474, 480, 482, 489, 495, 502, 507, 509, 511, 512,514, 516, 518, 524, 526, 527, 528, 542, 551, 554, 563, 566,577, 586, 587, 590, 591, 592, 594, 595, 596, 598, 606: n = A,T,C or G
  misc_feature 609, 610, 619, 623, 636, 644, 652, 656, 665, 695, 701, 705,716, 729, 731, 736, 738, 742, 761, 763, 768, 771, 774, 775,776, 778, 789, 793, 795, 797, 802, 808, 818, 826, 832, 849,853, 858, 866, 870, 871, 872, 875, 876, 881, 884, 885: n = A,T,C or G
  misc_feature 888, 891, 895, 896, 899, 921, 922, 930, 931, 935, 937, 938,939, 941, 943, 944, 945, 948, 949, 953, 956, 962, 965, 969,970, 974, 975, 977, 988, 993, 994: n = A,T,C or G
tngntngacgntgagagacngtgtaaggcgtgntanagcgagnctatttcattacgtgncanccctnttatcagtaataccnaacgacttgccatggagtcacagcgctgtgctacganccaggnnatcagccctaggagggccnctnaggggagaactaggtgtncagaaancngtatgtggtgaaantctngngnganggtgtgggntnngantacntagngnntatcctnnnancacttannnnnnncntttnnccnngggnntgaaatnncanangccttngacaaatnngagngccaaagtntnggnnnnanctgnnccttnnnaanannnnncttgtgtncttaccaaacgnnatttnattgcccnactnatcnntnnancnntgttanntttcngacnantttcntgnnnntcnncaacacccntcttaaatattacctnccttntnatgntgaantttannganancccccntntcattanaccccnatacaanaattntntnncncntncatcgntnnnttatatcccccctnatttctttncgncccctcctnatntgcttgacaanacattgtgnntcnnnannntnttttaaancgnnccttctctntctntactcgggaaaanactctttntcacacantctnttttacttntttgggggggcataaatctcctaaaatctntctccncaanacgaacaacanagcgttctcaaantnggcantntaanactcttctcttacaaaaantnttcgngcnccnnnanatcaatctccntgcncncnggganttttcncttcatctantttcttgngggatnaaaaatttcaccccccncttntcttngcgtcttngctnnntannctcanatnnggnggnttgnnttntctcctcctctttacgggctcnntccccaanntttngnnncntnnnaanntttntcnttaaanctncttnngccnncntcccaaacagnaaaann

SEQ ID NO: 7951 - DNA, 914 bp, Homo sapiens
  misc_feature 59, 97, 215, 261, 301, 347, 356, 365, 366, 369, 396, 405,414, 439, 451, 472, 474, 476, 492, 494, 513, 515, 517, 524,528, 539, 540, 541, 545, 547, 559, 576, 581, 586, 595, 615,624, 626, 629, 635, 640, 641, 643, 646, 647, 653, 656: n = A,T,C or G
  misc_feature 662, 663, 670, 672, 676, 682, 687, 690, 693, 701, 703, 720,726, 731, 738, 739, 745, 747, 754, 760, 765, 766, 768, 776,780, 793, 794, 795, 799, 808, 823, 825, 828, 829, 831, 858,859, 863, 865, 884, 890, 897, 909: n = A,T,C or G
ttctgcggacgctcccgcggagcggaaacctcattgtggtggagagcgtgctcatggcngtggccttcctgggccatgctgatggtgctgggtttgngcggagccgcttaccggcccacggaggagatcgatctgcgcagcgtgggctggggcaacatcttccagctgcccttcaagcacgtgcgtgactaccgtctgcgccacctcgtgccttnctttatctacagcggcttcgaggtgctctttgcctgcactggtatngcctttgggctatggcgtgtgctcggtggggctggagccngctgccttaccctcctcgttgcttacagcctgggccgcctcatccncctcactcntgggcctgnntgngcctgtggctgccacgcccggtgcccnggtggctgnagcaagggnttgcacctgctagctcacccttcantcctcttttttnctggggcccccctgcgccctntngngtccctgcaacacaancntggaatccttcatatgttngnantcatggncccntttcggaggcnnngggncnagtcgtccctgnaacaaagaactttgggncttcnatcancaatcttcnatgggggaaaaatctttggntatccaaananccnttcggnaacannanctnnggcaanctntcacanncttcttnanccantctctntaacncanacnttggtttngnacaaaggtatcttagtntgggcncaaantatttcnnacccgngncgttcancccctnggggnncntttctctnaatncccttgtctctannncttnaataaaggngccctctaaaacacncntgnncntcacatctctcacatctagtttctacnnatgnanactgcactctctgttctcnggactngcgtccnttcacttctttnttcct

SEQ ID NO: 7952 - DNA, 804 bp, Homo sapiens
  misc_feature 1, 6, 10, 13, 631, 666, 671, 687, 760, 804: n = A,T,C or G
nattcnaccncgntcggcccgggacctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggctggagcaggggtgcacctgctgctcaccttcatcctctttttctgggcccctgtgcctcgggtcctgcaacacagctggatcctctatgtggcagctgcccttttggggttgtgggcagtgccctgaacaaagactggactcagcacaactcctgggaatcttgtacgaaaaccaaggaagaaacanggacttcatcttcaccatctaccacttggtggcangctgngggcatctttaaccgngtacctgggcttcgaaccttgcacatgaaggctaaacttggcggtgcttgctggtgaacctggtggcgggccnctatctacgtaaaatcccaaacttgataagaaacctttgatgan

SEQ ID NO: 7953 - DNA, 803 bp, Homo sapiens
  misc_feature 2, 7, 11, 14, 19, 23, 603, 606, 622, 696, 720, 727, 730,757, 763, 769, 782, 783: n = A,T,C or G
tnattcnaccncgntcgantccntgctgtcgaataaaagcaaacagaacactccaacttagaagcaataacggctgccgcagcagccagggaaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccctgagaancangcgggttgggtgggangaggaagaaagggaagaattaggtttgaattgcttttttaaaaaaaaagaaaagaaaaaagaccgcctctcctnttgttgcccaagctcatctttganaaaccangcngtttgggtggggaggagggaaaaaaangggaanaattanggtttggaattgnntttttaaaaaaaaaaaaaat

SEQ ID NO: 7954 - DNA, 739 bp, Homo sapiens
  misc_feature 4, 9, 10, 28, 518, 673, 679, 710, 730: n = A,T,C or G
tcgntcagnnccgtgctgtcgaataaancaaacagacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttangaagtaaatggtgtcttgtagatatgtgcaaggtagcatgatgagcaacttgagtttgttgccactgagaagcagccggttgggtgggaagaggaagaaagggaagaattaggttgaatgctttttaaaaaaaaaggaaaggaaaagacagcatnttactntgttgccaaggctcatcttgagaaacagccngttgggttgggaggaggaanaaagggaat

SEQ ID NO: 7955 - DNA, 786 bp, Homo sapiens
  misc_feature 10, 11, 12, 13, 14, 24, 588, 649, 652, 695, 715, 761: n = A,T,C or G
tactcgtacnnnnnccgattccgngctgtcggaagaacataaacaggatgctgagagattgggtctctccacattgccccggctgctctccacccctgagttcaagtgattcacctcccttggcctcccaaagtactgggattacaggcgtgagccaccgtgcctggctgagaagatggatttaagacatattttggaggtaacattgtcaggacttcctgaaggattagatgtggaagggaaggataagaaacagaccaaggataactttcaaatgtatgcttaagcaactggatggataatgatgccattgagtgagtgaaaaacttgatggaagtggaagattcagagttcatttctatctaggttaatttgagacataccagagcataagttaagtaagtaattgaatattggagtggagacttatttgtctaccgaattattgttttctttgtcggacatacacctacactgcattcctcaaagtaaaatttaagtgtggctctgtgcctatgctctccccagcggaaagtgaccagaagaggtgtgcagtttccaggcctggcccatacagacctccaacangtgctcccctgtgctgttactccttctgccactggaagcagatggtgaccagctctggaanaangcaaggcctgaagatgggagattcctaagtggaggagaactgngcccttctgacctaaatatncactcatattggtatgtgaagaataaataaaccttgtgttgacccnttaaaaaaaaaaaaaaaaaaaaaat

SEQ ID NO: 7956 - DNA, 1431 bp, Homo sapiens
  misc_feature 3, 4, 9, 10, 11, 13, 15, 16, 17, 18, 19, 21, 22, 29, 30,32, 33, 34, 35, 36, 38, 39, 40, 41, 42, 43, 44, 45, 46,47, 48, 49, 50, 51, 52, 53, 54, 55, 57, 59, 64, 66, 68,69, 70, 71, 72, 74, 75, 76, 77, 78, 79, 80, 81, 82, 83,84, 85: n = A,T,C or G
  misc_feature 86, 87, 91, 95, 96, 97, 98, 100, 102, 103, 107, 108, 110,111, 112, 113, 114, 121, 124, 133, 134, 135, 136, 140, 149,151, 152, 153, 157, 163, 166, 167, 171, 175, 176, 177, 179,180, 181, 182, 183, 184, 186, 187, 188, 189, 190, 191: n = A,T,C or G
  misc_feature 192, 195, 196, 198, 207, 208, 221, 222, 228, 230, 257, 258,263, 277, 283, 286, 289, 306, 317, 318, 331, 337, 338, 339,342, 352, 355, 361, 362, 366, 371, 373, 377, 378, 380, 381,383, 389, 393, 399, 400, 402, 403, 405, 413, 417, 418: n = A,T,C or G
  misc_feature 420, 425, 426, 430, 432, 438, 440, 441, 442, 443, 447, 456,457, 458, 459, 461, 462, 465, 471, 475, 477, 481, 484, 486,494, 496, 497, 499, 500, 504, 506, 507, 509, 513, 521, 524,525, 528, 529, 531, 535, 540, 547, 550, 559, 561, 562: n = A,T,C or G
  misc_feature 563, 564, 567, 570, 572, 573, 576, 577, 578, 582, 584, 588,592, 596, 597, 602, 607, 608, 618, 622, 623, 625, 628, 631,636, 640, 643, 646, 657, 659, 662, 664, 670, 676, 677, 679,684, 687, 688, 690, 696, 698, 701, 702, 705, 706, 707: n = A,T,C or G
  misc_feature 709, 710, 711, 712, 713, 714, 717, 734, 736, 737, 743, 754,763, 764, 765, 766, 772, 781, 784, 789, 790, 792, 797, 799,800, 803, 805, 815, 820, 828, 830, 839, 842, 843, 848, 853,860, 862, 868, 869, 870, 877, 879, 884, 886, 889, 890: n = A,T,C or G
cgnnggccnnngngnnnnnanngaaaagnnannnnnannnnnnnnnnnnnnnnnngnanagaanangnnnnncnnnnnnnnnnnnnnaagnagannnngnanncaanngnnnnnagagaanggngcacgagannnnaccnggcgagaanannncggngagagnaanngtcnaggnnnannnnnnannnnnnnggnngntatgacgtnnaaacccttcgggnnagacangnccgccagtatggccaggctgggggacnnaactnggcggactacgggnagaccnggncgnttttggcctcttttttntgcgcgggaannagaggcggagganccacgnnnacngggccgaaancanggcccnngtcnataangncgcnnannancgcgcnggangggcgnncnngnaagatgancggnnangcgcnnaganangaggcnannnnggcngggcaagcnnnnannggnagcagngtgngnaganaangnccgaggcngnngnncgananngnggantcgggagncannggnnangagngaganacaaaanggnaatgggcgnannnncgnggngnncgnnnagcnanggangccngagnncgggngacanncagcaagagncacnncnganggnagacntccngcncgnagggaaagccnanaanangcgcgnctggcnnangcggnggnngnaagagngnagnncgnnngnnnnnnggngggtgcgacgacgaggncnnggcagnaggcaaggcanggcgcgggnnnnagaggnaaagcgcgnaancacgnngnggagngnnggnanggatagcggngaaanacgacggnanggggacagnagnngaggnagcgnagcggcnanacgcgnnngcggacnangcggnanganngnanggcacgngggaangnggnggnagagagngggaangnggngnangnngcngcnnagaggggacacgngggnggggggagnaaagnngnnggaggancgnggnnatngnaatnanngggnannaacgggnanangggngcgangcnnannncaagggangngcgancgganggggnanacgctaaaagcgnaaagtgganngaggggaanngcggatannnngnantnntangagaaganaagcgancgagggntggcgngcgaaanananacgggaggannacaaagcgnncangggggggcncgagnggggngggacngggnnnngaagggggggacggnccnnnaggggcgcncgangnggcanaaaatgaagagggnggggagggnggacntggtctgnggcgaagaaaagnggcnggcacgnaggacaagaaanngggggggnnggganaanangacagggngggggggaaggtngaaaanggnggaanaaggggaganannnncccnggggnncgtaannagnannannnngc

SEQ ID NO: 7957 - DNA, 756 bp, Homo sapiens
  misc_feature 1, 5, 6, 7, 9, 91, 633, 688, 756: n = A,T,C or G
ngtcnnnancccttccgcagcgcagacggaaccgcgatggtggcacctttattagtgatgcagacgacgtcgtgagtgccatgatcgtcangatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagaagacctggaaaaggtgctgacagggagaagagaaggctcttagacctgggagatnctggatttgtgccccgtgccaagggtcccaatgccttcaaacaaggactatgttntcaggcccaatggaatgtggaaatggagtcatccaggtttcagcgacctccaaaaaggtatcaatccn

SEQ ID NO: 7958 - DNA, 778 bp, Homo sapiens
  misc_feature 2, 6, 22, 27, 32, 95, 129, 152, 471, 538, 677, 679, 686,710, 712, 774: n = A,T,C or G
tnacantgaactctttggaaanccccngctgncgggaagctcgatgtcccaatattggagagtgttggggaggtggagaatatgccaccgttttnccacgatcatgttgatgggtgacacatgtacaanaggttgcagattttgttctgttnatactgcaagaaatcctcctccactggatgccagtgagccctacaatactgcaaaggcaattgcagagtggggtctggattatgttgtcctgacatctgtggatcgagatgatatgcctgatgggggagctgaacacattgcaaagaccgtatcatatttaaaggaaaggaatccaaaaatccttgtggagtgtctttactcctgattttcgaggtgatctcaaagcaatagaaaaagttgctctgtcagggattagatgtgtatgcacataatgtagaaacaagtcccggaattacagagtaaggttcgtgatcctcnggccaattttgatcagtccctacgtgtactgaaacatgccaagaaggtcagcctgatgttatttctnaaacatctataatggtgggtttaagcgaagaatgatgaagcaagtatatgcaacaatgaaaagccccttcgtgaggcagatgtagactgctttgacttttaggacaatatattgcagcccacaaggcgtcacctttaangntggaagnaatattattacctccctgaaaaantncaaatactggggaaaaaagtagggaaatggaccttggaattcaattataactgcaaagtggnccct

SEQ ID NO: 7959 - DNA, 1574 bp, Homo sapiens
  misc_feature 2, 7, 12, 14, 18, 19, 24, 25, 26, 27, 31, 32, 33, 40, 49,54, 55, 56, 57, 58, 60, 61, 66, 67, 68, 69, 70, 74, 75,76, 77, 80, 81, 85, 87, 88, 89, 96, 101, 102, 104, 108,110, 111, 113, 115, 117, 120, 122, 123, 129, 131, 136, 138,140: n = A,T,C or G
  misc_feature 142, 150, 154, 155, 156, 159, 160, 163, 167, 169, 170, 171,175, 185, 186, 188, 193, 194, 195, 198, 200, 201, 204, 207,212, 214, 217, 218, 219, 237, 238, 240, 241, 249, 250, 251,252, 253, 254, 255, 256, 258, 259, 260, 261, 262, 264: n = A,T,C or G
  misc_feature 265, 266, 275, 283, 295, 299, 300, 302, 316, 333, 335, 338,341, 346, 349, 358, 360, 366, 370, 375, 379, 381, 385, 388,391, 393, 402, 403, 411, 415, 429, 433, 436, 448, 457, 460,463, 470, 471, 481, 484, 493, 497, 499, 508, 513, 520: n = A,T,C or G
  misc_feature 526, 533, 534, 539, 548, 558, 566, 572, 577, 585, 588, 591,595, 603, 605, 613, 615, 619, 622, 624, 629, 632, 633, 634,636, 641, 651, 658, 662, 664, 667, 669, 678, 680, 687, 692,694, 695, 698, 700, 702, 707, 709, 712, 713, 716, 719: n = A,T,C or G
  misc_feature 724, 735, 747, 763, 768, 772, 775, 776, 781, 785, 791, 796,803, 808, 814, 818, 819, 821, 831, 836, 838, 843, 845, 846,847, 849, 853, 858, 866, 867, 874, 878, 882, 884, 885, 894,900, 901, 909, 915, 922, 935, 939, 945, 951, 954, 957: n = A,T,C or G
  misc_feature 959, 965, 972, 986, 992, 999, 1000, 1002, 1009, 1014, 1017,1020, 1024, 1027, 1033, 1037, 1047, 1057, 1061, 1062, 1066,1070, 1071, 1080, 1090, 1096, 1098, 1109, 1111, 1123, 1129,1130, 1132, 1137, 1143, 1148, 1150, 1156, 1158, 1166: n = A,T,C or G
cngaacnacggngnacannggggnnnngccnnnaaggggnagaaggggngaaannnnnannggggnnnnngggnnnnaannggangnnngggaaanccgannanggcngnnangncnaangnnagcggngncaagncngnancgggaccnggannngcnnggngggnannncaangcggaacggnnangcgannnggngnngcnaangggananggnnngcagcacgacacagaagnnanngcaaggannnnnnnncnnnnngnnntcgggaatnccggaaanccccttttgggngaanngnaccgcacgcaaganacgcagggacggggacncnccnacngactnggngacgccggncngctccnacgngcacngcangncggnacngangnagacaccanngcacgaangaanggcgccgggcaggngagnggnctggcgggggcngcgaagacnggnggncccacanngaagcagggngcnatgaccgancctnangcaggcgcncgaangggaccntcgacncgcatgnnggagnaaggagggnagacgagaancgtacccngcaggnaagantgcagggnggnggncgcngcaggcgncntggggcgncnggcncangngcgancannngnctcgncagaaggagnagcccgnaccnanatngngagacgccnangccacgnaggcncnncgngnangaggnangcnncanccnaggcncaaaggggacncgggcgcagagncggacaccacgaggangggcnaganggnnggggngcanggaagnccggngatgcgncgagngggaangagnngnccagggaggncgacnanggccncnnngngcgngggcncagaacannctacgangaancggngnncgaggggcncacagnngtgcccgncatggngggcagnaaaggccgagcgnccgnaggcancgcggngcncanantagganaggggcngcatctaaggggcncacaanaaagggnngngaagcgncaggnacnaangggnggncagggnacgngggcccccgnccgaaaccanacgnnagcnaacnngggggcganacgccgaggngggcananacggcgccccnancgaggagggtcncccacnngnggggnaacgcncagangngagcangntaaacacngcgggagcgaanngggggnnncacagcgaacgncgtcgntntangcgggaggggggaagggnaggaaaaanncaanncncncgagngngaaancnacgggganggcaancntangcgncnngnaccnccctcgggnggtcggggggagccncacgggggngcagcaacgnganaaaantantaacgtacnnanggaaagggggnggcngcngccgnancgaatngacangggncanacgngaaggngacngaaggggggggngnggcgacannaaaggggncangacgggacngnnggggnggggggacggacgncacgngncgcnnntgcnggggggncgganngcggngaagggangcgnnnccnggacgnaaacnaacgcnngngagcgcacgcggggnagagcg

SEQ ID NO: 7960 - DNA, 747 bp, Homo sapiens
  misc_feature 2, 14, 19, 588, 653, 660, 663, 702, 704, 707, 716, 724: n = A,T,C or G
tnttgtaccccctntcganttccgttgctgtcggcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctccctctnttcttccctctgcactttgtttacttgttttgcacagacgtgggcctgggccttctaacagccgncttctanttnggggctagtcgctgatctgccggttccgccacctgtgtngnaangaggccacnggcactangggaaccgaattctacaatcccg

SEQ ID NO: 7961 - DNA, 858 bp, Homo sapiens
  misc_feature 7, 22, 49, 62, 78, 90, 99, 108, 120, 122, 137, 142, 155,195, 211, 266, 268, 280, 285, 297, 344, 404, 408, 415, 420,444, 463, 497, 524, 531, 587, 611, 615, 635, 638, 643, 648,650, 659, 672, 678, 683, 687, 710, 723, 755, 770, 798: n = A,T,C or G
  misc_feature 806, 808, 811, 843: n = A,T,C or G
atttctnaaaccccttttcgantccgttgctgtcggatatggcaatgcncctgccccggctnaaccaccggcggtgcncgccagctgtanggttttccnctcccagtngcctgcaggtgncnacaagaaagaaggcncaggncgctcaaaacagntaaccagccttcacttgaggactggtgtgaaggtgcttgntactgggggaagtgantctgagggaggggccttaccacaagttaccttggaatttgggaatgatcccaaantnccaaagacgtanaactnggattgctcggnttccaaaactccgctgcaggaatgcttgtcctggtgctgcccatctngccttctgggctgcgtctttctgcctactacatctgtgttgcagatgaggatgaatacanggantttttcnacctngatcatgcccacacccttcttgangggactatcaaccagaaangaaaggcattggccatgggatcaatttgcttttnccaaaagcctttccttaatggatgggntgaatgnaaaaaatattgaagaaagaaccatttatttaaaaaagtgggaagaatcaaaaaccntttttacaaaatttcattggaaanccgnaaatttgcttggctttggtncanggaancccanantttttgganggttatttccctnggagtnggganaagnccccctctttttttgaaccttgncctttacaatttnaaaaaagtcaaccggagccttccccaaccctngcaacccaagttgtngggaagggcccaaaaggattttttggangtttcaancnttntgcccaccccctgggtcaacattggttcaaanaaatggcttaatttt

SEQ ID NO: 7962 - DNA, 1298 bp, Homo sapiens
  misc_feature 2, 5, 6, 11, 12, 13, 14, 15, 16, 17, 18, 20, 21, 22, 23,24, 25, 26, 27, 28, 29, 30, 31, 32, 33, 36, 37, 41, 42,43, 44, 45, 47, 48, 49, 50, 52, 55, 56, 59, 60, 61, 62,64, 65, 66, 67, 70, 71, 72, 73, 74, 76, 77, 82, 83, 84,85, 86: n = A,T,C or G
  misc_feature 87, 89, 90, 91, 93, 94, 95, 96, 97, 98, 100, 101, 102, 103,104, 105, 106, 109, 110, 111, 113, 116, 121, 122, 123, 126,127, 129, 130, 133, 134, 135, 140, 144, 145, 146, 149, 150,153, 155, 157, 158, 159, 160, 162, 163, 165, 166, 169: n = A,T,C or G
  misc_feature 170, 171, 173, 174, 175, 176, 179, 180, 183, 184, 185, 188,189, 191, 192, 194, 195, 196, 198, 203, 206, 208, 212, 213,214, 215, 216, 217, 218, 219, 220, 221, 222, 223, 224, 225,226, 227, 244, 255, 258, 260, 264, 267, 273, 276, 279: n = A,T,C or G
  misc_feature 280, 287, 288, 289, 293, 302, 305, 306, 308, 314, 339, 346,382, 418, 423, 427, 439, 442, 447, 462, 463, 464, 465, 473,486, 499, 500, 503, 509, 514, 518, 521, 522, 530, 539, 542,546, 551, 555, 556, 557, 558, 564, 569, 580, 588, 592: n = A,T,C or G
  misc_feature 596, 597, 604, 618, 631, 632, 640, 642, 645, 652, 657, 667,673, 688, 693, 698, 705, 718, 727, 739, 742, 748, 769, 771,772, 781, 785, 786, 791, 794, 799, 804, 805, 806, 807, 823,824, 832, 841, 844, 846, 851, 853, 869, 894, 895, 900: n = A,T,C or G
  misc_feature 901, 906, 907, 919, 920, 921, 924, 930, 945, 946, 951, 956,962, 966, 967, 989, 997, 1025, 1033, 1046, 1048, 1062, 1073,1077, 1086, 1103, 1113, 1114, 1118, 1127, 1136, 1139, 1150,1161, 1165, 1175, 1180, 1184, 1191, 1194, 1211, 1221: n = A,T,C or G
cnccnncaccnnnnnnnngnnnnnnnnnnnnnngannaaannnnnannnngnaanngcnnnngnnnnaannnnnanngcaannnnnnannngnnnnnncnnnnnnnaannnangangcgannngcnnanngannncggangcgnnnacnnccnanannnnanngnnacnnnannnnagnngannnacnngnnannnangaagngangnaacnnnnnnnnnnnnnnnntagaaacggaaaccccnttggcgaaagnccngngganggncgagcncgnccnngcggggnnngccngaggaaccnggnngnccggcnggaaagcggggggcgggggggcatnggcaaancgaaaaggcgggaccggggccgggggggggccaggncctagacggccaaagcccggggaggggggccccaangaaangcgnaccccggggccncanccgancccaaaaaaagggannnngggggcgnaggaccccagganaaaaaaaaaaggnngtnaagaanccggnaaanttnnggaaaaanaaaaagccnggnccanggggnaaannnntccttntccanggggcaagccngggagaangaancagnnaggcccngggggaacaaggancccccgacctggnnccgaaaantnttncggcctnaccanggggcgaacnaaaaanaaaggggcccggggngccanccccnaagcccnaaaaggaggaagnggggggganacccgggaaccnggnaccccnccccagggaaggggcccaagngnnagggccgangaannaagtnaanccagnaaggnnnnaaaaaaggaaaaaatnncccaccanaaaagggantanangggananggccacgccccaaaanggaaaaaaaggggggccatgggggnnccccnnggganngacccaaaaacnnnccnaaaganaaaggggggggaaannaccgnggacnccaaangggnnacccccccaaaacccaaagggntcttcccnccccaagggaaccagggcccaaaaaaanggggggtnggggggaaaaaantnggggaaaaaccggnaaagaaaccanatcnagggcgcanaaaagggaaaaggaaangaaaagcccnntatnccaaccctntgggggacnagnggataaagggnacccccggganaaanaggggggaanaactngganggaaatnaanaaggggaacaaagaagnaaagggcccngnacgggaattaanggggcccgccaacaanaannaanggganccanagccagnaaaggccngncanaaaaaaaaang

SEQ ID NO: 7963 - DNA, 755 bp, Homo sapiens
  misc_feature 17, 567, 607, 649, 669, 673, 734, 751: n = A,T,C or G
tactgaccccttgcgantccgtgctgtcgccaaacaaacattgcagggttgatcctagtcttgaaagttcgggcctttcctcttggcctgtttctggaggaaatgctcatgaggtgggtgagaggcggatgacatcctgtcgctctggcctcaccctggggatgccacatgacagcaccgcagcattttcaataggtgacccacctgcgaggaggaaggaaaaatgtgcccaaggccattatggagaacaaacacctatgcagttggagaatgctgaagacacccaagggtgttgtcctctccctcctgagagaagctaagaagatccaggcttagagtgctacagaaatagagatttaggatagaaaaaaaggaaggatttcctaactaccaccagggctatgaggcactgatatgacttacttgtgaacacagttgtatagaattgttatgtggcaaagacgaaagatcacgctggaatgtcttttcacgtatcccttggtggcagcagtgggcagcataaaagtacaagatggcaggtggaatctttaaccttgtggtctggangccgcatgatagggttgcagtgtattttccttctctacangcttgggccctcattctgttttctcacattcctccatcctantattctttgaatcctgtctncctncccttgagatctggctctaacttaagcccaatattcagaccaactttaccttgtctttttnaccaatcacaggccgantttt

SEQ ID NO: 7964 - DNA, 758 bp, Homo sapiens
  misc_feature 2, 5, 9, 733, 747, 757: n = A,T,C or G
tnttngaancccttttcgaattccgttgctgtcgggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagtgtaaaactgtatccaaatttcagaaaagacagcttcagcttgcaaattctatcctctaaacttatctgggcattcttcccccccacccccattatataagggctattttagatgctttaaccctccccacaaataatttggccaggtgttccaatgagaacttatcatgttnggtggtgttaaggnaaatcgggcnt

SEQ ID NO: 7965 - DNA, 764 bp, Homo sapiens
  misc_feature 1, 16, 85, 87, 91, 95, 111, 119, 134, 138, 143, 147, 150,153, 157, 168, 174, 178, 181, 193, 202, 589, 629, 671, 696,706, 750: n = A,T,C or G
ntatctttagaccttngtgctgtcgcctaaactcggagcagtgggaccctgaagatgtggaacctcgaaggcagcaaagaaaatntnggancctnttgggatcccgggtgnccccaggntttgggggggccagncccnctggntggngangantaanaccttctggancccagntcancancttaaaacccanggtcagggnttcgttcaataacgccagcgggaatcaatctgcactggcaccgcggcaggaactgaaactgcctggcaagtgaggaaccaggagccgcactgagtgtggctgggctacatcatagctcatcacggagctacgactttgggtactgcggacagacctggataggcccagcattcgttctgaagatcacagttcacagaagtttttgcttcgtaaagataatccaaaggatctcagaccccgctcttccttttcccttcattcccttgagagtcagccatgaacggaatacctgctaggttccaggaatgagctcacctaacagatagcaaatgtgtctggttagatctcaacagagcccattctgcaagacctggctgaccagatganagggtgggccctgtgctggggggccttgggtcacacacangaaccgagacctggcttccacccccagtcacccactttgggntatcttgctgggaagttatcgatanggactgtgtnggccaaccaagtgctttgggaagatcactggcacttgcaaaacnaaacaaaattgctt

SEQ ID NO: 7966 - DNA, 750 bp, Homo sapiens
  misc_feature 1, 3, 4, 15, 92, 94, 109, 193, 230, 344, 357, 361, 395, 398,542, 558, 590, 600, 628, 641, 657, 675, 690, 694, 698, 749: n = A,T,C or G
ngnntgtaagccttngggctgtcggtaggattataaatgggtttaaaatacgtattctcaaacctcattttcagcatataaatttttaagantnagtgttttaaaggtnccgtgaaaaccatttgctagatttttgtcctagttttttttttttaatttaaaaatcttaagttttttttagtaagcttaagancccagtagtttatttgccgaccgcatttttaaaaagngaatagatgtttaactgaagttaaatacaaatttatgtctgggtaactcttggtaagatataacaaaacctagacatctaaattttttggaaatttttattttaaaagttggtngggaggtaaaatngggngactttccttctggttaatagttttatagttaanaanaaagccagcgaagtttacttgatctcagttgcactcaagaataggggatttaagttccactttggttattttcacttctaccctaaattcataggccctgatacttaagcttacccttggcttccagttttcattgcagcgagnaaatggggagtagcanagcctttgttaatgtaaattgacaaaaaggtntgtccttttntacaggagcagataaactgataatggtnttaaaaaatgtanaaaatgatttttgtanacaggatgatctgtctanattggagcaaatgangggncatnttccaacaaaggtgggccccttcatttaataaacacccccaacaacaaaang

SEQ ID NO: 7967 - DNA, 750 bp, Homo sapiens
  misc_feature 4, 6, 13, 93, 516, 561, 643, 662, 684, 693, 700, 706, 710,729, 730, 732, 736, 737, 740: n = A,T,C or G
ctancntttcgancccgtgctgtcgctggaattttctttactcctgtatctgatgtctgggctgcgatgactcaaaggctgatttcagctganactgtagaccacgtgcctacttgtggcctccccttttgccttgggtttctcacagaatgtggctggttctggagaatgagacttccaatgaaatcaggtggaaatgacatctcgccgctttcagcatgctctattggttggaacagttatggacttagctagattcaaaggaagggaacaaagaccccctcctctcagagagtggggcataatgagagaatttagggccatgttatccaaccaccacaaatgccttctgaatttgaggttctgcctcaaaagttcatagttcctttgactgaaggacttctatatatccaagcatcgtcagccccaggtatattgttccatgtaagtgaccaggactaccttagtatttcgtatagggaaagtgacctgaataaatttgagaaaagaatcttncttctctccagtaagcactgaggtaagcattgagccatattatangtttatgactttgagactcagaaatttaaattcttggccaggccaatggctcaccctgtaccccacacttttgggaggccangcagcagatcactttgagncaggagtttgaaaccacctggnccaagtggngaaactncttctntacnaaaaaaacaaaaattaccnngngtgnnggnggcccctgta

SEQ ID NO: 7968 - DNA, 758 bp, Homo sapiens
  misc_feature 5, 12, 18, 578, 650, 672, 679, 712, 737, 745: n = A,T,C or G
tattntaccccnttcgantccttgctgtcgattcattttgtataatcatgtatcctcttgtgtgctggtagagattttaatcctgatttttccataaaacatgagtattaagaaataattcctgggtttggagaaactggagaaaatcacccttttaaggaagaaacactggaaatttctgctaacaccaagatatttaagagtgtcatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggcccgaatttggcccagtctgtttttgtatggtgcaaactaaaaatgatttttacatttttaaagagttataaaagaaaaaaatatgtggtctgtgaaatctaaaatatttactacctggcctgttggaggaaangtttgccaatctctggtttataccattaactatgagattaaccaaaaacttttacctttgtgcagaaaggtnaaaaaaaaaacatggttaaggnaaagganacatgttacctttcatacactccttttaactgngggatttgcaaaaaaataaaaatancccctttnaaaaaaaaaaaat

SEQ ID NO: 7969 - DNA, 758 bp, Homo sapiens
  misc_feature 3, 5, 9, 19, 28, 29, 34, 40, 41, 53, 55, 57, 67, 69, 74,77, 80, 81, 86, 107, 112, 119, 131, 134, 139, 143, 145,152, 164, 165, 166, 173, 174, 176, 190, 197, 214, 215, 219,220, 221, 228, 237, 258, 259, 282, 288, 295, 310, 320, 347: n = A,T,C or G
  misc_feature 358, 360, 417, 418, 426, 433, 436, 453, 455, 476, 504, 515,524, 529, 533, 543, 557, 578, 603, 608, 612, 625, 634, 653,683, 705, 739, 744: n = A,T,C or G
ttntnttanccctttcgantccgtgctnncgcangaatgnngttcctcttggnancncccgggtggncngtttnttnttnngcccnggttccggcccggggcccctnggggngtttacntcaattgggggnttnaaaanggcntnttgtaangggaaacctttnnntgaaatnntncaggaaaggaaccnatgggangggaccaggaggggaannccgnnntaaaccncttaaaaanttttgttgaccgggtttccanncggaattcctttggggagggggngctggngaaaatnctgcttgggagatcncattaggganctccccgttttgaagaagaagactcantgggaagacanangaagaagaagatgaattcttttggccctcaaaacccccccaccaaatggtctttggnnaagaaaanagtttcntcncacaaaatatgaaaacnanggaaaggaaaaaatggatgcnttgcttagaggtgaaaagaaagagagcnccgaaccgttnggaacgacntttgngaanaacaggatanaacctccccgggantgggaaaagacaggaagaaangggaaatggcaagggagcattccangaaanaaanggacccttggacnattaaaaangaactggagcgggacccangatcccggagcacacaaggaccacgggacnaaagaccctaccgccggccgangaccgccaggacggaggccccaggaatgtttgcntaccnacgtgagagggctc

SEQ ID NO: 7970 - DNA, 1001 bp, Homo sapiens
  misc_feature 5, 9, 10, 12, 13, 17, 18, 20, 21, 22, 23, 24, 26, 27, 28,29, 30, 31, 32, 33, 34, 36, 39, 42, 43, 44, 50, 51, 53,55, 56, 57, 59, 62, 66, 68, 71, 77, 80, 81, 83, 86, 94,97, 98, 99, 100, 103, 105, 106, 107, 108, 109, 110, 111,112: n = A,T,C or G
  misc_feature 113, 114, 115, 116, 121, 122, 127, 128, 131, 136, 140, 143,144, 146, 147, 154, 173, 174, 179, 181, 189, 193, 197, 202,203, 206, 207, 234, 247, 252, 253, 259, 264, 270, 271, 296,298, 301, 348, 352, 357, 360, 364, 374, 381, 385, 387: n = A,T,C or G
  misc_feature 388, 398, 399, 402, 411, 418, 431, 438, 439, 444, 448, 455,458, 460, 472, 482, 487, 497, 498, 501, 507, 508, 516, 524,546, 547, 556, 562, 565, 566, 568, 571, 575, 586, 589, 599,605, 611, 618, 626, 640, 649, 650, 653, 659, 662, 669: n = A,T,C or G
  misc_feature 673, 675, 676, 681, 686, 688, 689, 692, 693, 697, 698, 699,702, 704, 711, 712, 714, 716, 720, 723, 732, 737, 752, 756,758, 762, 764, 770, 773, 776, 782, 787, 802, 810, 812, 813,815, 816, 821, 822, 828, 833, 838, 839, 847, 853, 866: n = A,T,C or G
  misc_feature 872, 878, 881, 886, 887, 896, 899, 902, 918, 920, 947, 953,960, 965, 966, 967, 969, 973, 979, 980, 981, 982, 983, 992: n = A,T,C or G
cgccngacnngnncgannannnnncnnnnnnnnngngangannnccacgnngnannnanacnaggngncgncggcgnacnncnagnagacgacncannnnacnannnnnnnnnnnnggaannaccgnngcnatccngaancgnngnngacgcanccgaccccaccggcccggnnccaangngagcgggnagcnggcngtttnnganngccgcaccccaagaaaacaggggcagnccgacagacccanagggnnccacangagangggacnnggggccacagagccggacaagaccngnagnacacagaggggaggggaggaacgacgacaacaggccaggcggccaangacnggggnccnggcnacacaccagngcacccngacncnngaaaagcccnngcngaacccccncgaaagngggggagacacancccgggnnaaaanggcnacagacnccncnggggacagaagnagagagcggnaaacngggagggagnnggnaggcanngcacaggngaaggganagcccgaacgccctaggggcgnnacaggcgancacagnaannanggnagcnggggagagccnggnacacacacanacccgngaaacnggggcgnagagaccngcggcagcacgcangacccggcnnggnaagaanccnggacagnggcngnngaacnaaganannacnngggnnnagncnacccccnnancngacncgngggccaganacccncaacccccggagggncagnangggncnaaccangancgnaggggnggcgngcgcaccaaagacanccccgggncnngnnggagnnacaggngaccnggagnnagccggcncggccnggggagagaaacncaaagncggagncanccgcnnacgcccggnagncangacaacggagagcggngngaggggaggcaagcgaccggacggcancccccngggagcngggannngncacncggggnnnnnagcgaaccngcccacccg

SEQ ID NO: 7971 - DNA, 1447 bp, Homo sapiens
  misc_feature 8, 9, 11, 12, 16, 23, 29, 33, 35, 36, 37, 38, 39, 41, 42,47, 49, 50, 51, 54, 55, 58, 60, 63, 72, 77, 78, 84, 89,91, 92, 94, 97, 98, 99, 100, 101, 102, 103, 108, 113, 118,125, 128, 130, 131, 142, 151, 163, 173, 188, 194, 195, 196: n = A,T,C or G
  misc_feature 198, 199, 204, 205, 208, 210, 217, 219, 226, 227, 228, 235,237, 240, 241, 244, 246, 251, 252, 255, 263, 264, 266, 281,284, 285, 289, 292, 301, 303, 304, 309, 314, 318, 319, 323,328, 330, 333, 335, 340, 344, 355, 358, 368, 369, 370: n = A,T,C or G
  misc_feature 371, 373, 375, 376, 378, 380, 382, 384, 385, 389, 392, 397,399, 400, 406, 412, 417, 422, 431, 438, 439, 441, 448, 450,454, 462, 464, 468, 470, 472, 473, 474, 477, 483, 487, 494,507, 508, 520, 523, 526, 530, 534, 535, 539, 542, 547: n = A,T,C or G
  misc_feature 548, 553, 556, 558, 564, 566, 567, 571, 577, 579, 586, 599,606, 611, 612, 613, 620, 621, 629, 635, 637, 641, 643, 644,645, 647, 648, 652, 655, 656, 658, 659, 661, 663, 665, 675,676, 678, 690, 696, 700, 701, 706, 710, 712, 716, 732: n = A,T,C or G
  misc_feature 734, 736, 745, 747, 749, 758, 759, 761, 762, 765, 768, 780,786, 787, 791, 798, 801, 808, 812, 819, 829, 832, 841, 843,849, 863, 866, 867, 868, 872, 874, 876, 879, 881, 894, 904,906, 914, 915, 920, 925, 929, 931, 934, 936, 938, 939: n = A,T,C or G
  misc_feature 944, 947, 953, 960, 962, 965, 967, 969, 978, 979, 980, 981,983, 985, 987, 989, 997, 999, 1000, 1015, 1016, 1019, 1020,1023, 1027, 1033, 1035, 1041, 1043, 1048, 1060, 1062, 1079,1080, 1084, 1085, 1088, 1101, 1109, 1110, 1119, 1124: n = A,T,C or G
cccccccnncnnccgnccaccanccacgngaanannnnnanngccgngnnncgnncangnggncggccacgngcacnngaacgnacacncnncncgnnnnnnncccgncgttngaacncatcganccncnnggcccccgagnccccacggnccccatgggccnggggggcagnggggggggggggggngttttnnncnnttccnnccncnagcgacngngggggannnggggaangnctnnggncncgctnntcncccccacnncnaccagagggagcgtnacnncgcncgngaggggcgngnngcccncggcnccgnnagcnccctncntcncnacccnggcngcggcgagggncgngcatcagatnnnngnanncncngngnngccnccngcgcncnngctgcntcgccnagcancggcnagacggacngagcggnncncagccancnacgncggtccgnancgcntntnnngtncgtcgncgtncggccgncgcacgagccgannctcgcgcactgnccncgngcgncgtnncggncgntgtcnncacgntcngntggcangnncggnacgcgnancggccgnacgcgatgaatgngcgcgcnggcgnnntccggcnncgcgcgcngcaggngnggcntnnnanngggnacnnanngncncngtgcgcgagnncncgaccagactcncggccnacgnnacgcncgcngngggngacacgtgctgcatgngnancggcgcggnangnggatgggcnngnncgnganacgcatacgccncggtanngcgntcgcgtnacncgaccgntagngtcgccnctcgcggagngangccggcgcnanggtacngaaaccgcacgcanacnnncgancncngtncncacgggcgccagncgacgcacgncnccgcgagnnaacgncggancggngntcngngnngctcntcncgcacngacgcgntncgngnanacggcgcgnnnntncncncnggaggcangnngcccgacggatctgnncgnncanacgngcgggngncacgcngncaccncacccgcgcacngncggcacgcgcgctcggnngcgnncgnagtgaccacgatncgacgcgnncggtcgcgnactcncgnaatgcagacgtgcncgaacgcaaacngcgcgnacgnncnggcagaggacgncgtaacggagacgngtngcgaacgaccgcgcacgngnagnnctncgcacggctacgnngctgcgnacgngnaagngnnagcgggnnngcncncgtgatccnncncgggatcgcnannncacacgtangcnagcgntggcgccacgcgcncgcgatcacgnnnnnnacgcgcggggacnggnggagcgnngncataggaaacncgcanccgactagnaatnngctncncgcatngntngccgctagggcangcnannccanacgngtgcc

SEQ ID NO: 7972 - DNA, 735 bp, Homo sapiens
  misc_feature 3, 4, 45, 64, 82, 416, 670, 680, 695, 716: n = A,T,C or G
atnncgttcaactacttgttctttttgcaggatcccatcgattcnaattccgttgctgtcgcantgagcgggtctgggcggntgctggcagcgccatggagacggtacagctgaggaacccgccgcgccggcagctgaaaaagttggatgaagatagtttaaccaaacaaccagaagaagtatttgatgtcttagagaaacttggagaaggattactgtagatgcagtatatggaatcaggaatcttaacttcatgtgagctattggagttttccttgctatcaggatgcatagggaggtcctatggcagcgtatacaaagctattcataaagagaccggccagattgttgctattaagcaagttcctgtggaatcagacctccaggagataatcaaagaaatctctataatgcancaatgtgacagccctcatgtagtcaaatattatggcagttattttaagaacacagacttatggatcgttatggagtactgtggggctggttctgtatctgatatcattcgattaccaaataaaacgttaacagaagatgaaatagctacaatattacaatcaactcttaagggacttgaataccttcattttatgagaaaaatcaccgagatatcaaggcaggaaatattttgcttaatacagaaggacatgcnaaacttgcanattttggggtagcangtcaacttacagatccatggncaagcggaatacatgatag

SEQ ID NO: 7973 - DNA, 735 bp, Homo sapiens
  misc_feature 2, 3, 10, 12, 83, 433, 609, 620: n = A,T,C or G
annccttatncngatcagctcttgttctttttgcaggatcccatcgattcgaattccgttgctgtcggtggaggggccgttcnaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgntctatgaaggactcaagatagcccgagagagcctgctgcgtaagtcacaagtcagcattcgctacaattccatgcctgtcccaggaccaaatggaaccattcttatggagacacacaaaactgttgggcaacagatgctgagctttcctcacctcctgcaaacagtgctgcacatnatccaggtggncataagctacttcctcatgctcatcttcatgacctacaacgggtacctctgcattgcagtagccacaaggggcccggtacaggatactttctcttcactggaaagaaggcagtgg

SEQ ID NO: 7974 - DNA, 978 bp, Homo sapiens
  misc_feature 7, 61, 62, 66, 99, 100, 115, 121, 123, 146, 205, 211, 267,285, 297, 327, 345, 386, 414, 429, 445, 451, 464, 475, 486,510, 518, 533, 540, 546, 560, 573, 589, 606, 609, 652, 677,684, 686, 693, 745, 756, 781, 795, 802, 803, 812, 815: n = A,T,C or G
  misc_feature 835, 843, 847, 850, 863, 864, 891, 909, 917, 935, 936, 939,946, 962, 968: n = A,T,C or G
ggacctntgctcttgttctttttgcaggatcccatcgattcgaattccgttgctgtcggtnntgtnagatcactgggatattttccacaacttcctctnntctagcacacacatntgttgntnggaaatatttgagggtttttccnctaccaaatgggagcttcatggtcctggtgtcaaacactataaccttgaccactgactntgatgntggcacatatctgagtcctgtgtgcacagtaatattctgggtcaaggaaaatccangtctttcaagttttaaanggatttttgganaaattcgggccttctttttaagaccgaatnccattggccccaaatttncacaaaggctttgggtggaacaagttgggaattaaccaaanttttggtggttggggccaaaaaagtttncccaaagggtttggnttaaccaaccttgggnggcccntttttaaaaaaanccaaaaaaaanccttttaaaanccctgggccatttggggaaaattngggttttnaaacccttttaaggnaaggaancccccnttgggaaagaaatnccttaaatttttnaattccaaaggggaancccccgggggaaaaggnaanttcccacccaacctttttcaaaggggtcccccattttggccanaccctgggaccttttttttggtccntttgggngngaatccnttcaaaaaccccttgggtttgggaagccccctgggggaaaagggggggcccnttccaaccaantttcttggtgggccttttggaatanttaagccccccaantttcttnnaccaagccnccnttaccaaaggccccccattnaatttggncccncanggaaaaacccccnnggaatggggaaaaaattgcccagttancccccatgccactggaanaccttaanaaaaatcgttccttactnnggngaaaaangtattatggatgccantaaagngcccactggg

SEQ ID NO: 7975 - DNA, 694 bp, Homo sapiens
  misc_feature 6, 257, 259, 437, 457, 493, 500, 518, 520, 526, 541, 559,596, 602, 608, 610, 615, 625, 627, 629, 638, 641, 654, 660,676, 691, 694: n = A,T,C or G
attcgntacaagctcttgttctttttgcaggatcccatcgattcgaattccgttgctgtcgatgtgtctctggtacagaatagttgatattaacagaaaaaaaaaaatctgtagcttcatgaatatgccactctgttaatttcttgttccagacattttaatagagattgcttgaccatgttgtttgaattgctgccaatagcagaccatatccctatcatgttgttggctcaactgtttttttttttccctaatananatggagtatcgctgtgttgctcaagctggcttgaactcctgggctcaagctatccttctgcctcggcctccaaagtactgggattataggtgtgagctactgtcccaccttaacctgtttcacagtgaatatacttcatgctggtttcaacatgggattattaaaggattaaaagttngggtggatgcctgtaatccnacatttttggaagcccagggggcggtcaccaggcangaaatcnaaacattggactaccaangnaacccnctttataaaataccnaaaaataacccgcgtggngggggcgcctttattccccttctttggaacttaggcnggaaangggtgnanccctnagcccaaaangncnttgcttcanctngggaaaaaaggantttttntaaaaaaaaaaaaatngggggaaaaaaattngan

SEQ ID NO: 7976 - DNA, 711 bp, Homo sapiens
  misc_feature 1, 2, 3, 5, 8, 9, 10, 11, 12, 13, 14, 16, 18, 19, 26, 33,34, 40, 45, 49, 70, 110, 112, 120, 121, 125, 134, 144, 151,153, 155, 168, 170, 172, 177, 180, 184, 188, 203, 213, 219,220, 228, 229, 251, 252, 257, 263, 265, 270, 271, 275: n = A,T,C or G
  misc_feature 277, 279, 280, 281, 289, 293, 294, 295, 299, 302, 303, 304,308, 313, 314, 316, 319, 322, 328, 330, 338, 339, 345, 348,350, 357, 365, 366, 367, 369, 371, 377, 379, 382, 390, 398,406, 411, 417, 423, 425, 432, 435, 438, 439, 455, 459: n = A,T,C or G
  misc_feature 471, 472, 486, 490, 493, 502, 507, 518, 520, 521, 524, 539,540, 551, 570, 571, 573, 578, 581, 582, 587, 588, 592, 597,598, 599, 601, 607, 608, 614, 626, 627, 633, 640, 641, 642,644, 655, 662, 664, 667, 671, 673, 686, 696, 701, 705: n = A,T,C or G
  misc_feature 706: n = A,T,C or G
nnngnttnnnnnnngncnntttgatnccatacnncgaatngatanacanctacttgttctttttgcagancccatcgatcgaattccgttgctgtcgggggaaaggtacntnaaaccatnngctntatgttagngactaggagngattganananccctggagattgntnanatganctncagngccnacggcccattctttnatagttggtnctgtgnnggagaggnncaggctgtgagcctccaaacannatttnagaccnantgganngagncntnnnactggacnggtnnnatanccnnngtgnagganngngcnaantcactngnacggctannatggcnagngnacgacancagttccnnngntngcgcantngcntacccggnaatcctancgttttgncgacngaggcnaaggangnttgcccnagngtnnaaccagcgctgagaantacngtgaacccctgnntctgaaaggcaganggtnacngggtggggngaccncccctagacgntnntantctaaggctgggagnnaagattgtttnatcccggaatgttgatgcnnantggancannaattnncccnatggnnncnaatctnngcgaanaaaaaggggaannttggcngaaaaannnanctaatgggtgnaaaaaangnggntgantnaacaaaaaaattnaacgcgaaantttancagnncgttt

SEQ ID NO: 7977 - DNA, 672 bp, Homo sapiens
  misc_feature 1, 3, 4, 5, 6, 7, 8, 9, 10, 11, 16, 18, 22, 27, 640, 641: n = A,T,C or G
ngnnnnnnnnnaatananatanacaanctacttgttctttttgcaggatcccatcgattcgaattccgttgctgtcggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactcctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagagctgagctcgaaaaagtcgctcgacagtggcttcaaggacacgctctgctgtcagtgcacggccggtgattcagagatcttcgctnnaaacaatgaaagcggtgagaggaaagccagg

SEQ ID NO: 7978 - DNA, 718 bp, Homo sapiens
  misc_feature 1, 2, 6, 34, 602: n = A,T,C or G
nnaccncgagcgaattccgtgctgtcgagaaatntgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaanggatataaactttcccccctttctgtccgtgacagataaaaagccacagaaagggacaaccccttgaaaatcatgtaaccgttggtccatttcaataatttggtaccttgttttaa

SEQ ID NO: 7979 - DNA, 712 bp, Homo sapiens
  misc_feature 18, 34, 38, 578, 608, 642, 648, 654, 679, 688: n = A,T,C or G
aattccgttgctgtcganaccaagtgctctacanggcnacctgtgagcccagactggatcctggaccagaaaaaggacactagtgagacaactggcagaatttgcataagaagcacggcctcggcctcgggtggtggagtcactgctgagcccatgacgttctgcttatattccatccctgcatttggaagtcgttctttgccaggaggaaagtgaggaaaaaccagcaataacaaaacagcagctctactgacggaggaggaggagcccaggaggcggctggtcagggcccaggtgtggagggaggccaggcataggcaccccgacttctctggaactactgacattttctcgcaagcagagaggaagatggaaaggtcagggaggagaatgagggaggggtctgccgcggggagccacaaactccgtggggcacagaaagtgcaaccgtctcccattgaggaaattctccccaccgggcggcttgcctctaaacaggatattgcttcgatttctttgatttcccttctctctctctctctctctctctcgcaaaaaaagtcttgattctaataacngcttagaatatttaaaataataatggtttnaatggtattgggttctttgtttcccacccaaagnttcttnttcttntttctttttggccaataaaatttgnaaaaattgnggaccttcaacttttgttcttgtc

SEQ ID NO: 7980 - DNA, 661 bp, Homo sapiens
  misc_feature 1, 6, 20, 44, 133: n = A,T,C or G
nctcgntcgcctaggccccntggacctggtctttcagacacatntagccgtgtttccccatctgctgcccgtgatccctatgatcagtctccaatgactccaagatctcagtctgactcttttggaacaagtnaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtgggaccctatcctcttgatgttgctagtatggggatgagacctcatggatttagattggatttccagggaggtagtcatggtaccatg

SEQ ID NO: 7981 - DNA, 661 bp, Homo sapiens
  misc_feature 6, 660, 661: n = A,T,C or G
gggggncggctgagacacataagtacagaatcatgaccttaatggtttgacagtttggaagcaccctggcaacaagccatttcagtggaatggtagaaatggaaaccacgctgggttgagaagtgagtggatgtgaaaatatggggcctctgaatggaggtaacccttgaaaaattccactgtggagaagaaaggagagagagagggctggaatttggaatgaaaggagatatttgggattattttagtaagaaaacagaggtgtcatgacctcagtgtaaccctattagctgcaaaaaattcttcatgggcttgagatggagttagccatattcattattgaaaactatgttctgcacttatacattgttggttggagtgtaaattagttcaaccgctgtggaagacagggtgggtgtttcctcaaaaacctaaagacagaaataccatttgacccagcaatcccataactgggtatgtacccaaaggaatataaattgttctactataaaaacacatgcacacacatgttcactgcaacactatttacaatagcaaagacactggatcagtctaaatgcccatcattgatagaatggataaagaaaatgtggtagaggtacaccatggaatactatgcaccataaaaaagaatgagann

SEQ ID NO: 7982 - DNA, 1009 bp, Homo sapiens
  misc_feature 2, 3, 5, 6, 17, 18, 20, 27, 32, 33, 36, 38, 52, 54, 55, 58,64, 65, 66, 68, 75, 77, 79, 85, 86, 87, 88, 96, 97, 100,101, 103, 105, 107, 109, 111, 112, 116, 118, 125, 126, 127,128, 130, 132, 133, 135, 139, 140, 141, 144, 152, 153: n = A,T,C or G
  misc_feature 154, 155, 158, 163, 164, 171, 179, 185, 190, 205, 210, 213,220, 225, 228, 229, 230, 233, 239, 243, 244, 250, 255, 263,264, 266, 271, 278, 282, 285, 288, 289, 291, 294, 295, 299,300, 318, 320, 329, 330, 335, 337, 345, 348, 364, 375: n = A,T,C or G
  misc_feature 377, 379, 387, 388, 389, 390, 402, 405, 406, 407, 412, 414,419, 420, 422, 426, 427, 440, 441, 442, 444, 447, 452, 459,461, 468, 469, 474, 480, 484, 498, 500, 504, 514, 515, 516,521, 525, 530, 534, 536, 542, 543, 544, 554, 558, 561: n = A,T,C or G
  misc_feature 563, 564, 567, 569, 579, 581, 582, 586, 588, 597, 599, 601,605, 607, 610, 613, 615, 616, 617, 619, 620, 622, 626, 629,634, 636, 642, 650, 653, 660, 664, 668, 670, 672, 673, 677,679, 690, 691, 696, 698, 706, 708, 714, 722, 723, 727: n = A,T,C or G
  misc_feature 734, 736, 737, 739, 740, 744, 745, 747, 748, 749, 752, 756,758, 759, 761, 763, 770, 782, 792, 794, 796, 800, 803, 804,806, 807, 809, 815, 817, 821, 830, 836, 838, 850, 860, 870,871, 875, 887, 897, 900, 902, 911, 918, 919, 920, 922: n = A,T,C or G
  misc_feature 923, 926, 937, 939, 940, 956, 958, 959, 960, 962, 987, 992,993, 1002, 1009: n = A,T,C or G
anngnnagaatttaaanntnaattggnatatnnagngntgggggggggattntnntanactatnnntnttatttntnangaaatnnnnttaggtanntannantnantntnnagtntnggggggnnnntnannanatgnnnatntttttggnnnngantggannccgaaanaatggatncaattnggggngaaaatatatatatntattngtnagagagnattangcnnntanttattntatnntaattntaaantaactagnntnttagngtgcacnattntcntanngnatnnagannatcggtattatacacaantnactaatatnncgttntngttataantgntcatattagattaatncatacattatnantncactgtannnntttattataganagnnntatancnatttnntnattnntgattatttatannntnatnataantcttaantnattttannatatntattgnaatnctgttataaaacgnanatgnattgatagtnnnctttnaatnaaaanaaantntctcannntgttaaaaanatanatntnnacnanattttgattntnnttancnagtttcaancncnaagngnacnttncnnntnntntacnagntgatngnataatnagtgaaanaancttaatngatnatgntnannatcntnaatataataannattantntataaaantnaataanattttttnntaanatgactnannannaatnnannnganagcntnnantntataatntatttttaatantgatacatgntntnagantanntnncnttttantncttntaataactntgaaanangatctgaatacnacattagcangacattgtanntacntatacttaaacnatttatatcncgncngattatagnttatatnnntnnatnataatgtatantnntttatatatatataanannntntcatattactgttgatatgtctatnatttnntgagtatanttatagn

SEQ ID NO: 7983 - DNA, 1035 bp, Homo sapiens
  misc_feature 4, 12, 13, 17, 18, 22, 25, 29, 31, 37, 38, 42, 44, 46, 47,49, 50, 52, 56, 60, 61, 70, 71, 74, 81, 82, 85, 87, 88,92, 94, 97, 98, 99, 101, 117, 119, 128, 146, 147, 152, 154,156, 158, 159, 163, 164, 178, 180, 184, 187, 188, 194, 201: n = A,T,C or G
  misc_feature 206, 209, 215, 221, 222, 223, 224, 226, 227, 229, 232, 237,242, 252, 262, 263, 273, 281, 282, 285, 290, 293, 297, 298,299, 302, 309, 311, 313, 328, 339, 343, 352, 353, 357, 359,362, 366, 373, 374, 388, 389, 396, 398, 400, 401, 403: n = A,T,C or G
  misc_feature 415, 417, 419, 421, 425, 432, 434, 436, 439, 440, 441, 447,448, 465, 467, 468, 474, 475, 481, 488, 491, 492, 502, 503,507, 509, 512, 514, 515, 519, 529, 532, 536, 538, 540, 542,554, 555, 561, 562, 568, 569, 572, 577, 578, 582, 585: n = A,T,C or G
  misc_feature 593, 600, 602, 605, 606, 607, 614, 627, 629, 634, 635, 637,638, 643, 646, 654, 658, 660, 665, 666, 667, 669, 670, 674,675, 676, 677, 684, 686, 692, 697, 703, 707, 708, 710, 715,719, 720, 723, 725, 727, 731, 738, 740, 741, 745, 746: n = A,T,C or G
  misc_feature 749, 750, 752, 760, 764, 767, 768, 770, 771, 774, 775, 782,783, 784, 795, 799, 802, 804, 805, 806, 808, 811, 817, 818,824, 835, 842, 846, 847, 849, 851, 853, 855, 857, 859, 862,863, 869, 870, 872, 873, 882, 886, 887, 891, 893, 894: n = A,T,C or G
  misc_feature 898, 900, 901, 902, 903, 905, 906, 908, 909, 912, 915, 916,919, 920, 925, 928, 929, 931, 933, 935, 947, 951, 956, 957,961, 970, 972, 973, 977, 980, 981, 985, 988, 990, 991, 993,995, 999, 1002, 1004, 1008, 1015, 1016, 1020, 1023: n = A,T,C or G
atgnccagtatnntagnngggnttnttcnanttttcnnaaancncnntnnantagntatnnggggctaanngcnggttcannacngnngcangntgnnncntcggggatcattaagncnttgcttacntccacctataatcttacnntctcncnananntagnnatatattcactagnanagtntanntattantccgtgnaaatntanattctntctctnnnncnngngancgttnaggancgtttggatnctcttacatnntcctcggganatattcannagnagtcnctnagannntgnctaagtnantnaacgacatgacactntcattctcgtnaatngatatgtcnnatgnanaanaacntttttcnncttccatcgatatnnccttatntncnncnatatgtagtctntntncncgtntttacanananttnnngaatannttgggttctgtaatctntnncatctnnatgacnattcccntannctaacatatnntcgntntangnngcanagtattatanttnttanangncnctctacttcacnnattatnncgtgtnntantatanncatnttnctttagtnattcacntngannntgattcntcatctattcatncntactnngnnttctntanacttattntgcntnttatnnngnntacnnnnaattccngnattcgntaatnatggancctnntnatacnttcnntgnantntgancaatgtnannatcnnganntntcctgcgnattntanntnnctnnttatacnnngtcgattattntagntcntnnncnacntacttnntcattnatatctgtctncattgantcannantnancnantnatnnaatttnntnntatactatntctnngttntnntaantnnnntnntnntcntcnntanntactnggnntnangntatataatatanattngcatnnattncatgaatgntnntaangtnnatcnacnannanangatnctnantctntgagatnntctnctnantcganccncn

SEQ ID NO: 7984 - DNA, 867 bp, Homo sapiens
  misc_feature 5, 7, 9, 10, 12, 14, 16, 26, 30, 34, 37, 40, 42, 43, 44,49, 52, 53, 59, 60, 64, 66, 77, 78, 80, 86, 89, 93, 99,101, 106, 107, 109, 112, 114, 116, 121, 135, 136, 137, 139,160, 168, 175, 177, 183, 191, 200, 213, 219, 221, 225, 226: n = A,T,C or G
  misc_feature 230, 235, 236, 240, 243, 244, 245, 247, 258, 260, 270, 274,278, 279, 290, 293, 294, 297, 303, 309, 310, 315, 322, 333,345, 350, 351, 352, 353, 357, 359, 368, 375, 379, 386, 392,393, 396, 399, 404, 410, 419, 427, 432, 441, 442, 443: n = A,T,C or G
  misc_feature 447, 449, 456, 457, 463, 466, 468, 472, 483, 491, 495, 497,499, 504, 505, 510, 511, 518, 521, 523, 524, 541, 546, 548,553, 564, 565, 568, 576, 577, 580, 581, 583, 584, 585, 594,597, 601, 603, 606, 614, 615, 620, 623, 625, 628, 634: n = A,T,C or G
  misc_feature 645, 654, 655, 656, 661, 662, 676, 679, 680, 681, 686, 690,695, 699, 709, 715, 721, 736, 737, 745, 748, 756, 758, 762,764, 778, 784, 787, 788, 798, 804, 809, 814, 815, 816, 817,821, 822, 827, 835, 841, 844, 850, 854, 855, 866, 867: n = A,T,C or G
tgttntntnntntnantagcggggtntatntttnttntangnnnttaanctnnattagnngggncntgttgcatttnnangggggngancttnactggntnagaanngntgngngntatancttttatctgtatnnnanaagagggggaaaacttggagntctctccntggtaantnatgcantaaggctnatggcttanatatagcttaccngttacntnattnncgtntactnnatcnttnnntntgttctacctnanttggagcttnttgngaannggggcatgacnctnnacnagtggntgggannctgtncacggtngttggatgcanaacatatactgnattgnnnncctntntagcatacnctttaanttcnataatcnagtgcnnganctntaatnactccntgcctcaangtaatctntgttntatatgtannnagtntnttttacnntaaacnttnantgcnctttatagagnagaaatcntttnananaaaanntatgnncctcatnaanannagttcattttttttaantccantntattngtggtgcggannaanagaagccnncanncnnncaaaaatgncgntctntnatntatgaagnnctatngcntncangtaaanagccttatttntacatcttnnntcctnntggctgaaccttgncannnctttnatantcatnttanggaactatgntttatngggggntcttattaggtaacnntgtttatnatnaccacatngntctntngtactcataatttnaggttnagnntcagatcacnccttanatttnggggnnnnaggnntaacngacggtcnttatantgngggagnaagnncaaactaaacnn

SEQ ID NO: 7985 - DNA, 617 bp, Homo sapiens
  misc_feature 8, 11, 463, 525, 546, 591, 616, 617: n = A,T,C or G
gttgactncgntactcagcttgctgcctgcaggtcgactctagaggatccccgggtaccgagctcgaattcgccctatagtgagtcgtattacaattcactggccgtcgttttacaacgtcgtgactggggaaaaccctggcgttacccaacttaatcgccttgcagcacatccccctttcgccagctggcgtaatagcgaagaggcccgcaccgatcgcccttcccaacagttgcgcagcctgaatggcgaatggacgcgcctgtagcggcgcattaagcgcggcggtgtggtggtaccccagcgtgaccgtacacttgcagcgcctacgcccgtcttcgtttcttccttcttctcgcacgtcgccgcttcccgcaagtctaatcggggtccttaggtcgattatgcttacggactcgacccaaaaactgatagggtgatggtcacgatgggcatcgcctgnaacggtttcgccttgcgtgagcacgtcttatagtgatttgtcaatgacacatacctattcgncatcttgattataggattgcnttcgctatgtaaaatactgttacaaattaccgattacaatatacntacattctgtcgattctctacttgnn

SEQ ID NO: 7986 - DNA, 742 bp, Homo sapiens
  misc_feature 3, 9, 28, 30, 32, 38, 42, 46, 685, 741: n = A,T,C or G
ttnattcgntctcacgcttgctgcctgngnangatccntcgnttcnaattcggcacgaggtacattgtcctgacactggaaaagacatttggaatttactttttgacctggctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagtttgagcaaacagaagtgttcctctgcatttcaaaaccttcttcctttctatagccctgtggtggaagatttattaaaatcctacgtgaagttgataaggcgcttgctgatgacttggaaaaaaacttcccaagtttgaaggtcagacttaaaacctgaattggaattacttctgtacaagaaataaactttatttttctcctgacnaaaaaaaaaaaaaaaaactcgagcccttaaaactatagtgagtcgtattaccgtana

SEQ ID NO: 7987 - DNA, 1005 bp, Homo sapiens
  misc_feature 2, 3, 5, 7, 8, 9, 10, 12, 14, 16, 18, 19, 22, 25, 38, 45,47, 53, 58, 59, 62, 64, 65, 67, 68, 71, 72, 80, 81, 88,90, 91, 93, 97, 105, 112, 113, 114, 121, 122, 126, 128,132, 133, 135, 136, 138, 140, 141, 143, 144, 146, 148, 152,154: n = A,T,C or G
  misc_feature 163, 164, 170, 172, 173, 179, 185, 195, 200, 204, 209, 214,218, 219, 222, 225, 226, 227, 233, 239, 240, 242, 243, 249,251, 252, 253, 267, 270, 271, 273, 274, 275, 277, 284, 288,292, 304, 310, 312, 314, 321, 324, 326, 339, 340, 341: n = A,T,C or G
  misc_feature 345, 353, 355, 360, 365, 368, 370, 375, 377, 383, 384, 388,390, 395, 396, 398, 399, 405, 406, 407, 409, 411, 419, 420,421, 422, 426, 428, 434, 435, 437, 452, 455, 456, 460, 462,466, 468, 469, 470, 471, 473, 481, 482, 483, 488, 491: n = A,T,C or G
  misc_feature 494, 499, 503, 504, 505, 506, 509, 512, 519, 532, 533, 538,539, 548, 549, 559, 562, 563, 568, 570, 571, 579, 581, 584,587, 593, 603, 608, 609, 614, 619, 623, 626, 631, 632, 639,641, 646, 647, 649, 654, 655, 662, 665, 666, 673, 677: n = A,T,C or G
  misc_feature 682, 690, 693, 699, 705, 708, 711, 712, 720, 727, 730, 738,747, 750, 751, 755, 759, 764, 768, 770, 772, 776, 782, 791,795, 799, 801, 803, 804, 808, 811, 819, 820, 823, 824, 827,829, 832, 833, 837, 839, 840, 845, 848, 850, 854, 860: n = A,T,C or G
  misc_feature 880, 883, 884, 886, 891, 894, 903, 906, 912, 915, 919, 928,939, 948, 956, 961, 978, 980, 986, 987, 988, 998, 1002,1005: n = A,T,C or G
tnntnannnntnancntnntanttnaaatgtaatggtnggggggncnctttantcgtnnctncnntnnatnnaacccccnngataatncnntnaaanctgcgttngggggannntcatcannatantntggnnanncncnnanncncnattntntgttactcnnagtctntnngatganaggttntcttcgagtnctccnggtnctacntgtantatnncgngannncttcangtactnntnnataatncnnnagaccatgtactcnganntnnnantccatcntggntctntccctcgcacgnagtgtntngnatcaaancgnantttgctctgaccnnngatngtactggntnttatncacanaantnacatntnttaganncttnantactnnannttggtnnngntnatctgatnnnnagananggactnntngaggattctaatggnaannaagncngcgntnnnntntgttgaannntgatnatncgntctancttnnnncantgncgaatcngcatggatggcgnnttatnnaataggctnnattgttttgngannttgcnanngttcaacnanttncancgacanttaagcatcncctannattcngtttngggnatnacatnnccatcgncngtgtnngnaccgnngaaaacngtnntttaatngttngaacntggttagntangttacnttttcntcnagnnaaaatcgncattctngcnttctaccnaatttgtanatnnaatnatcntatancatncngnctcntgtcanacttaatcngtancgtntnanncganatngatatatnnganncgntnctnnaaantnngctangantngtcntacccnctagactatatttcctctantcnntnttatncgngttaatcancgnctgtgngantgtngagtagagncatctatatcntacctcctnttgccacnatttntatcacaaatccccttntnctagcnnntgtatctacntgcncgn

SEQ ID NO: 7988 - DNA, 1159 bp, Homo sapiens
  misc_feature 1, 3, 4, 6, 7, 8, 10, 17, 18, 20, 22, 23, 24, 28, 30, 32,33, 36, 39, 45, 49, 51, 52, 55, 63, 65, 66, 73, 75, 79,80, 81, 84, 88, 90, 91, 95, 103, 118, 120, 126, 128, 138,141, 144, 152, 155, 157, 159, 160, 167, 177, 189, 191, 197: n = A,T,C or G
  misc_feature 199, 201, 203, 213, 214, 218, 221, 224, 227, 228, 230, 231,232, 238, 242, 243, 244, 246, 253, 263, 267, 268, 270, 271,286, 289, 296, 300, 304, 305, 311, 319, 323, 324, 328, 330,337, 338, 339, 341, 347, 352, 357, 359, 367, 370, 375: n = A,T,C or G
  misc_feature 377, 387, 392, 394, 403, 423, 425, 428, 430, 432, 433, 438,445, 446, 447, 451, 463, 466, 468, 472, 473, 478, 481, 492,505, 518, 521, 522, 526, 536, 537, 541, 546, 547, 552, 554,568, 570, 572, 585, 589, 613, 619, 627, 630, 632, 642: n = A,T,C or G
  misc_feature 644, 651, 652, 657, 659, 665, 667, 682, 688, 689, 691, 695,699, 701, 717, 719, 726, 728, 733, 734, 737, 739, 742, 744,747, 758, 765, 778, 782, 787, 790, 798, 804, 807, 814, 822,823, 825, 827, 829, 831, 837, 841, 849, 850, 852, 861: n = A,T,C or G
  misc_feature 871, 873, 877, 882, 884, 889, 891, 894, 898, 899, 902, 911,913, 914, 925, 931, 938, 943, 947, 949, 951, 953, 959, 960,965, 969, 973, 974, 983, 994, 995, 998, 1002, 1005, 1007,1009, 1018, 1029, 1031, 1039, 1041, 1045, 1048, 1052: n = A,T,C or G
  misc_feature 1060, 1061, 1063, 1067, 1072, 1093, 1094, 1096, 1097, 1099,1102, 1103, 1104, 1105, 1109, 1113, 1115, 1118, 1120, 1121,1126, 1127, 1132, 1138, 1140, 1141, 1146, 1148, 1151, 1155,1156, 1157, 1159: n = A,T,C or G
ntnntnnntngagaggnntnannntttntncnnttnttnagaggngggnannaanggttgganannagccctntntctnnncgngaantnnaatntactaagngcccggggggggggntngtggtntnttaatctttnaanatnattctttnttntntnncggaggntaacactcangaggagtgtttntntatgtngnantnttattatttnnatantgncgncgnntnnntaatanttannnanatatgtntaattctaantagnntnnattaatattatgcgntanccatctnttgnctgnntattancgtatatnttannttantntccttcnnntntatctntatgnttatntnaccatcancgnatatncngaatgatagnatgantntgtttattntctccatacgaaatgagtgntnatncncnncgatnttgtatnnnttanaatatgactgtnttntnatannactanatntatgtatgctnatgctaaactatnaatacatattgtnacnntctnttacatcgtnnaaantgttnntcacncntttgagaaggaggnananagacgtttgattntttngtgaattatatgtcgatttctgtntgttgngtgaaatnatncngttaattgananacattgnnatatntncatacngnagaataaatacgatngcgatnntnatcnatantnttatctattgtatatntncatatangnttaanntantngtntntanacctatacttnttatgtntccgtatctactnctgnttcanttnaatctagnctattntanttagtangttacganntnantncncgcttnattngtgtgcgnntncacttattntacagtatgncncatntattntngtatntntantgtnnatnattttacgntnngagtaatatgnatatanataatgnacttncacncngnanattatnnatttntttnctgnnattatattntagtttacganntantaanttntntnctactttcnttcgtaatttnangtttatgntnaganaanttcnttaatgtnngntttnaatcncataaatagtatatgcacagnntnncnatnnnnatanatgntnagntnngattnnaattnattatnanngcctngnatntaannncn

SEQ ID NO: 7989 - DNA, 662 bp, Homo sapiens
  misc_feature 1, 385, 522, 576, 611, 614, 658, 661, 662: n = A,T,C or G
nttgttcctgcctcacctcctgatagctgggattacaggcgtgcaccaccatgcctggctaatttttgtatttttagtagagatggggtttcacaatgttgcccaggttggtctcgaaccgctgaccttaagcgatccgcctgccttggcctccccaaggtgctggaattacaggcatgagccaccgcgcccggctgacttttttttttctttctttctttttgagacagagttttgctcagtctcccaggctggagtgcaatggcaacaacatggctcgctgcagcctcaatctgctgtgctcaggtattcctcctgcctcagcctcctgagtagctgggactacaggcgcatgccaccacacctggctattgtggattttaanaaattttttttgtagagacagggtcttactatgtttgcccaggttgttcttgaactcttgggctccagagagcctcccatctcagcctcccaaagtgctgagattataggcgtgagccaccacacttagcctattgngactttttagagtttctaatactttcttttagggcactaaaaacttaatcttanatccagttggttattcatttgggtgaatgaagtgntanggacctaccttaattttttccaggtttttgtgattgaataaatntcnn

SEQ ID NO: 7990 - DNA, 723 bp, Homo sapiens
  misc_feature 331, 340, 389, 439, 455, 462, 465, 480, 484, 492, 496, 501,503, 511, 519, 520, 524, 531, 538, 540, 544, 553, 560, 565,567, 572, 575, 578, 581, 614, 630, 638, 643, 648, 652, 653,654, 655, 658, 662, 668, 671, 682, 690, 699, 711, 712: n = A,T,C or G
  misc_feature 714, 721, 722: n = A,T,C or G
aggtgacctctgtgtttctataactatgttaatgtgacctgtaaaacagttcacttctcaacaagtcagcttcctcatatttaaaatgagaagttgtcttgagttttctaaagatgtttaggctgcattgtcttgggcctgctcaggattttgacctctgagataaaagctggatttaaaaagccaatccaagccaaacacctggcattattagcattgttattccatcagatctgtttgtttgataaagaagctgggggtggaattggtggtgccttaaataccctagcttggtgcagaggtaagatactctgtctgggcacggtggctnatgcctgtnatcccagcacttcgagaaccaaggcaggcaagtcgtgagtcaagagatngagaccatcctggccaacatggtgaaaccccgtctcttactaaaaattancaaaaaattaacctgnggcggtnggnggccaccccgccctnttanttcccccnatanctccnanaaggcttnaatgccanngaanaaatatnactttgnancccngggacgccnataaggnttgcnantggtnacncanaanaattcatttctcacttgggcctcccagcccctngggggccccaaagggnggaggaanttccnccctncccnnnnatnttcnggtatnaanaaaattctccntaaaaaanataaattgngcgcccaggaanntnttaaaannt

SEQ ID NO: 7991 - DNA, 1007 bp, Homo sapiens
  misc_feature 6, 8, 12, 19, 24, 27, 33, 36, 39, 44, 49, 50, 52, 55, 69,70, 73, 80, 83, 89, 90, 93, 96, 98, 99, 100, 101, 102, 103,106, 119, 120, 128, 130, 133, 135, 141, 142, 151, 152, 153,159, 164, 165, 168, 169, 174, 178, 181, 192, 206, 211: n = A,T,C or G
  misc_feature 212, 214, 217, 220, 221, 223, 224, 225, 226, 227, 228, 229,231, 237, 238, 248, 254, 255, 257, 263, 268, 271, 275, 279,281, 282, 287, 289, 300, 304, 313, 316, 320, 328, 331, 333,336, 341, 342, 343, 350, 356, 358, 366, 372, 378, 381: n = A,T,C or G
  misc_feature 382, 383, 384, 387, 388, 393, 395, 397, 399, 400, 402, 418,423, 427, 431, 434, 435, 436, 438, 439, 448, 453, 454, 456,462, 469, 471, 472, 484, 487, 488, 490, 495, 497, 502, 508,511, 514, 523, 538, 543, 546, 552, 561, 564, 572, 573: n = A,T,C or G
  misc_feature 576, 583, 584, 585, 593, 595, 605, 608, 610, 612, 613, 620,625, 626, 627, 628, 631, 633, 635, 640, 641, 644, 654, 655,657, 661, 666, 674, 683, 690, 695, 705, 709, 710, 716, 726,729, 735, 736, 741, 747, 761, 773, 774, 777, 790, 793: n = A,T,C or G
  misc_feature 797, 800, 806, 808, 812, 817, 821, 823, 827, 828, 831, 833,834, 837, 840, 842, 845, 849, 851, 859, 864, 873, 879, 883,884, 891, 907, 915, 919, 923, 927, 928, 931, 933, 939, 940,944, 949, 950, 954, 955, 956, 961, 963, 967, 969, 1002: n = A,T,C or G
  misc_feature 1003, 1005, 1007: n = A,T,C or G
tttctnantaanagcgggnacatngtntctttnaanctntactntatanngnggnatcttttttttccnnccnacacccnctntcctcnnaantcnannnnnngantatatcccttcannggaaaaantnaananggatgnntttatctgnnnggatcnattgnntcnncacgnaatnccncttggacaatnatcaatcggtcttntaccnntnatnttnntnnnnnnnancctagnntcgaatgtcnacctgnnantggacntctantanatcntctnannaaccntnaaactattatnactnggttacatnttntaanatattctnacnanaancattnnncatttcntctacntnattattcnaataanctcccntannnngcnntattncnanannantcattcgtaataatanattcnattntcantannntnntttcctgtnatctnntnattatntcgagtncnntatggctagcanttnnanctttnantactnaactantancantagcaaaangagacggtaatttanttctngtnacaatnaaaataaantcncgtaattnnagnacctatnnngacatctntncattcttgcntanantnnattgttntttannnnttncnanaatcnnaanattatgcctnngnactnatacnagatatantcagtatantatccgnatctnaattctggangctnnataagnatactacctnttnacgttnnatatngtatanatcccttattttanctattccatatnntcnaatccatactctntantgtnaanttaaancntaanttcanctantnttcnntananntantcncntcngctntnacttcgtnatcanattaatacntattgncttnnctcaccnaactacgctcgtatancatctatnaatntcanactnntantntatctnntatntaaannatcnnnataantnatantnatattatctttcctgtctacaaattttatcatnntncn

SEQ ID NO: 7992 - DNA, 674 bp, Homo sapiens
  misc_feature 4, 5, 578, 674: n = A,T,C or G
cctnnccccaattcggcacgagaaacaactgaaggtcaaaaacttatatgcctttttatgtgtacatttaataaaacaattttattgatttcttaccgtaagttactgtgatgagtgataaatacttcactattcagatactttcgtaagagatacatttcagtggaacactttgcataaatattttctcaaaaatgtgcaatttctgggaaaaaaggaatgatggaaagaaggttattgcagttttcctagaaattttgtcagattggcatgcatttttattgactaagaatcccaattttagcatgaagaccattagatatgaatacataaggccataacatttcaaattaagcacatggagtgatttgtaattttgtgttaatttctccctaagatgttttgttaaaatgattttgtatataataaatttctaagttgaggaaggaaggtaaaaaaaattcctgataaccttttctttatgaagtctgctaataacaatacctagtatatacttagaagaaccagccaagaaaaattacctttcagcaaccactctttacttatttctcttttgnaataatacccaattttatgacccaggattccccagtttttaacggaagtaagattaaagaccaaagcccaaaaaccctctgttccttgcaatatan

SEQ ID NO: 7993 - DNA, 673 bp, Homo sapiens
  misc_feature 673: n = A,T,C or G
cccctctcgaattcggcacgagaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatctttttgactatttcaagtctaataaattcttaattaacn

SEQ ID NO: 7994 - DNA, 782 bp, Homo sapiens
  misc_feature 5, 11, 12, 578, 581, 588, 605, 628, 661, 756, 762, 776, 779: n = A,T,C or G
gtttnactacnnaaacaagctacttgttctttttgcaggatcccatcgattcgccaaagcacacaaatggcctaccatcttttattcttccttctagcttctggagagagaaatgattgttccagtttagaatgccaggagtttactgggtgtttgtattttttatctgtgccttaaaaaaattagattataatgaacaagacatctttatgttttacagggaaggaaaaagcagtgaaagtatgcattttcgaaagaaaagtgtgttgggaaaagagagagagggtggaaacccaaaggagaaataaaaattttaagtccttgttgcagtagctggaggaagtgagcttggaaatctctccagcgcaatggttgctggctgggaagaaagatctgacttagacacagaataagctgcttgtgctgggtgtgtttgtgagctgggtgaggttttctgtgtcgctgggcacgtgagggaagttacctggctggggggtggggtggggggcattagaagggagtatgggtgtctgtggcgctcgcgtgtgcctgtatgtgtgtgtgtgtgtgtgaaaaanaanagagaangtaaaattaacctttgncctatatggttggtttctctgcntagaagtcttaaaggaaccttgccagcttgcanttttttattgggtttcaaattaccagcatttctcttctaaggattggttgggtggttattttggggttgatgaattgaaagccaagggattaaanaaccanaacctgggaccaantgnaat

SEQ ID NO: 7995 - DNA, 825 bp, Homo sapiens
  misc_feature 36, 87, 124, 439, 468, 488, 495, 498, 511, 590, 600, 614,617, 637, 657, 680, 703, 720, 726, 729, 747, 762, 766, 821,823: n = A,T,C or G
gtttgaatccgtttcaactacttgttctttttgcangatcccatcgattcgaattcggcacgaggcttcatccagccaaagaggtcnttagtggttctggaaactttggtggtggtccgtggangtggtttcggtgggaatgacacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtanctattgcagtggcagaagattttaattangaaacaaagcttatcagganaggaganccntaaaaagtgacangggaagctccaggttacaaccagattttgtgaacctcaacccaaccacaagtgggtgggccagggccttaccttgcttncaaaagaaanacattgtttttaanacnaaatacctcatgttgtattngggccaaaaaaaactcctanggacctggttttttgtggacctnaattggtattaaccaaggtttanttttaaatttcctgttncttgtnggnaaaagtggttaaaagccntttcccaaccaaaangggntttttaaatggtaaaaatttttttttttttggcaccccccattgccttgttttgnantc

SEQ ID NO: 7996 - DNA, 831 bp, Homo sapiens
  misc_feature 3, 4, 5, 6, 7, 8, 9, 10, 11, 12, 13, 14, 15, 16, 17, 28,31, 34, 50, 109, 644, 647, 655, 788, 816, 821, 830, 831: n = A,T,C or G
tgnnnnnnnnnnnnnnntattgaaactnatntgnaaaccctggaatttcncaggatcccatcgattcgaattcggcacgaggctgcttcggggactcagccagtatttntactgaggtgctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagccgtgcccaggtcttccagcaggtggccctgctgcctcttgagtgctggcagcatggctgaccctcggggtggttttatggtgcaggtcacttgggtcttcagggtcccttccgagggcatgtgttcagcactccccgcgttcagcctgaggggtgtacagttaagagaagacagttacagatctcattaatctacatttttcactgtcctctaacattgaaagaaggatgtctacctggtgaaagtatattttaacatgactgatggaattcactaattgcccactctcttggaacttganganaaaccggntggccacccatatgtcacctaacctctatattcttttcaggctgaagattcttcttcaaggaaaaatgaaggaagcagaaactgggccaccccttgggctggttcaaagaaggcatttttaaaaaataagganaaagccaattttggaaggttgggggaanggggnaaaggaaann

SEQ ID NO: 7997 - DNA, 674 bp, Homo sapiens
  misc_feature 4, 7, 628, 638, 666, 674: n = A,T,C or G
cccnccncgaattcggcacgagctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggcttcctctgtgtccgggtccccctgctggggaggagccggccatctctgaggcagcgcctgaagctggcgcccccacttcagccagtggcctcatggccaccccaccctgtcagggggtggtgaccaaanggaggcccanaccttggacagccagatccaggagacangcatctan

SEQ ID NO: 7998 - DNA, 930 bp, Homo sapiens
  misc_feature 3, 8, 9, 11, 16, 17, 18, 22, 26, 27, 28, 29, 30, 31, 32,38, 42, 45, 46, 47, 48, 54, 56, 59, 60, 63, 66, 67, 68,70, 72, 73, 75, 78, 80, 91, 92, 99, 100, 109, 110, 113,114, 119, 120, 125, 126, 129, 130, 131, 135, 138, 140, 143,151: n = A,T,C or G
  misc_feature 154, 155, 156, 164, 165, 167, 169, 172, 177, 178, 179, 180,181, 182, 183, 184, 185, 196, 203, 229, 239, 252, 253, 258,264, 269, 280, 286, 290, 295, 308, 313, 328, 341, 356, 358,359, 365, 368, 369, 385, 388, 392, 393, 395, 400, 403: n = A,T,C or G
  misc_feature 410, 413, 415, 431, 436, 445, 450, 452, 454, 459, 473, 498,504, 517, 519, 524, 525, 526, 544, 548, 550, 551, 552, 554,557, 564, 567, 571, 577, 578, 588, 591, 593, 607, 608, 623,629, 630, 631, 632, 636, 637, 638, 639, 650, 662, 664: n = A,T,C or G
  misc_feature 670, 683, 693, 702, 710, 715, 728, 729, 733, 735, 737, 739,742, 745, 765, 767, 775, 779, 786, 790, 792, 794, 798, 809,819, 823, 836, 839, 841, 843, 844, 847, 853, 856, 863, 865,868, 871, 872, 874, 883, 892, 901, 903, 909, 911, 917: n = A,T,C or G
  misc_feature 918, 921, 929, 930: n = A,T,C or G
ttnaaatnnanttcannnattnattnnnnnnnaatttnattnttnnnngggggnantanntantannntnanntnttnancttttttatannaaaaacnnccccctttnnttnnttacnntatcnnaannnaaantcngnggnggaatatnatnnnaaattaannantnctnttttnnnnnnnnnaggggggggtncaccccnccaactatttatcattttaaatactngtaaataaancttatattaaatnntttancccttntcttntcccccccccnccacancttntttcnctaaataattcantatantatcatataatacanccatcttaacttntatattatatatatnanncttttnatnnatatatactattcctncantatnncnctaanaangcctctnatntncatttattttctcccncatanaactttctnaaatnanantattnttaataaatcattntaaaattattatacatattttatcntttatntccttattatatntntttcnnntaactatatttattattncatntnnnanatntatactnatnatgntaattnntattaaatanacntnaccttacacattcnntcattataaaatttncattcnnnnatannnnttacaattttntattattaaatntncatttntttacataataanatacaatatntaatatacnttaaacanatccntaaaactattatnntatntntntnttntanatacaaaaattaataaaatntnttcaattntttnacaaacnttantntncatnttacaaaaaanattatctttntttntattatactcatnctntnanntantttcanatncaaatcntnttnttnntnttatttaantatacactnaattatacntnataacntnttattnntanccattacnn

SEQ ID NO: 7999 - DNA, 1148 bp, Homo sapiens
  misc_feature 3, 6, 10, 12, 15, 18, 23, 24, 26, 27, 30, 44, 48, 49, 51,52, 54, 56, 64, 66, 69, 72, 73, 77, 78, 84, 103, 104, 106,110, 111, 120, 129, 130, 135, 138, 140, 141, 142, 159, 160,161, 166, 172, 176, 186, 187, 194, 197, 201, 202, 203: n = A,T,C or G
  misc_feature 211, 214, 215, 217, 221, 226, 231, 233, 240, 241, 243, 246,251, 256, 272, 274, 283, 285, 294, 300, 302, 320, 321, 322,324, 336, 338, 342, 344, 346, 347, 350, 358, 364, 366, 369,373, 377, 379, 392, 397, 402, 414, 422, 429, 434, 436: n = A,T,C or G
  misc_feature 445, 446, 451, 459, 461, 464, 477, 479, 480, 485, 487, 488,490, 492, 497, 498, 503, 504, 516, 520, 521, 523, 524, 533,550, 554, 557, 577, 578, 579, 582, 584, 593, 594, 595, 597,615, 617, 627, 629, 633, 634, 639, 663, 664, 666, 669: n = A,T,C or G
  misc_feature 673, 674, 677, 681, 686, 705, 709, 725, 726, 727, 728, 732,736, 741, 743, 745, 748, 749, 768, 770, 772, 777, 778, 779,781, 783, 786, 798, 802, 827, 828, 830, 837, 845, 846, 850,857, 873, 879, 887, 896, 897, 922, 927, 928, 931, 933: n = A,T,C or G
  misc_feature 937, 941, 945, 947, 952, 991, 1000, 1003, 1012, 1014, 1018,1020, 1027, 1031, 1035, 1036, 1039, 1042, 1048, 1050, 1053,1054, 1056, 1061, 1073, 1079, 1084, 1086, 1093, 1095, 1100,1103, 1109, 1113, 1115, 1128, 1130, 1131, 1138, 1146: n = A,T,C or G
ttnctncctntnagnagnggggnntnnttncttattgaaatccntccnncnntngnaggggggngnaanttnnttgnnaccccnccttttcactagggcctgnntntgtnnaagtacccntgtattttnngcgantgntnnntgaaactgggtaacttnnntgttnagcgtnactngtcctgtggnnacttttnttntccnnnatcttctntcnnancttngtctnatggnangttaggnntngcnattgnttccncacgtctttctgcttnantcacatagncngatatttcnttggantnggcctgaattggtgaatnnntnttggtcgtatananaacncnanntcngatttggncactcncngancccntcgngnattcccgggtttngaaantcttnttctttactccncccgtatnggatatncaacnangtggtaacnnatagncagctcgntnttnaaactctaaatgncnncacgnannantnaggtnntattnntctctactgggnaatnnanntatttctanagcttaattacctatangtcnccntatctctcttgagggtatannnccnantttataacnnngntgtattctccgggtaagngntataaaaccntnggtnnatcanccgcaactactttcaaatgggggnngnggnggannggntctngtctntatatacaattccttcggncggnctcatctcaaagtgcnnnnactnaatngcctntngnganngcttcaaccccctaagctntnanattannngngnganatccgtatatgnctgnggtgttcctcgacgcccctatgggnnantgggggnattgcaannagtntaaatanagactttggtcttctntggaanccccaagnggacgggtnncctttcttgggtccctctccatagnggganncananggcnttgncttngntatgnggtggaacccccctctgggggggaaaatcggccccccanctgggctcnctncaaatgtantngccngnttacgtntttnctcnnctnggntaggancnccnntntaccntctctatcttantttttnttacngntggtatnanggcanacngccgtngagntntccctttgggagnanncacttcncctctttngg

SEQ ID NO: 8000 - DNA, 1194 bp, Homo sapiens
  misc_feature 3, 9, 10, 11, 13, 14, 15, 19, 20, 21, 22, 23, 24, 25, 26,27, 28, 29, 30, 31, 35, 37, 42, 44, 56, 57, 58, 59, 61,70, 73, 77, 78, 79, 80, 84, 87, 88, 89, 97, 105, 107, 108,109, 110, 111, 114, 115, 118, 120, 124, 129, 130, 131, 135: n = A,T,C or G
  misc_feature 148, 149, 150, 151, 153, 154, 155, 156, 160, 165, 166, 167,168, 173, 174, 176, 178, 179, 180, 181, 182, 183, 185, 186,187, 188, 190, 192, 196, 202, 207, 218, 229, 232, 236, 237,238, 239, 246, 250, 268, 272, 278, 287, 299, 308, 310: n = A,T,C or G
  misc_feature 313, 318, 320, 325, 326, 329, 331, 335, 337, 338, 345, 347,353, 357, 361, 364, 366, 373, 375, 382, 384, 385, 387, 396,402, 405, 414, 416, 419, 422, 423, 428, 433, 440, 444, 450,456, 459, 461, 464, 467, 472, 475, 483, 495, 497, 500: n = A,T,C or G
  misc_feature 505, 512, 516, 520, 526, 528, 534, 537, 543, 546, 552, 555,557, 564, 567, 568, 580, 586, 587, 592, 599, 600, 602, 603,620, 625, 627, 632, 633, 636, 638, 641, 644, 650, 656, 659,661, 662, 668, 670, 673, 677, 680, 682, 687, 689, 698: n = A,T,C or G
  misc_feature 706, 708, 710, 713, 717, 718, 719, 723, 736, 737, 749, 750,756, 760, 766, 769, 770, 771, 777, 779, 781, 787, 788, 789,790, 798, 802, 811, 812, 817, 820, 824, 829, 836, 846, 848,853, 856, 864, 867, 876, 878, 887, 897, 900, 901, 903: n = A,T,C or G
  misc_feature 905, 907, 909, 916, 917, 918, 928, 929, 931, 939, 947, 950,952, 954, 955, 956, 957, 959, 969, 970, 972, 984, 993, 996,997, 998, 1013, 1014, 1025, 1026, 1031, 1041, 1042, 1049,1055, 1056, 1062, 1065, 1068, 1078, 1083, 1087, 1088: n = A,T,C or G
cancaaaannnannnaacnnnnnnnnnnnnnaacnanaaggngnggggggggggannnngnaaacgcaanaanaacnnnntcgnagnnnaaaaaccncccccccncnnnnnaannccnancaangcggnnnggangggggggggggannnnannnnaaanaaaannnncctanngngnnnnnntnnnntntnacgncccccnccganaacaccaacgncacggcggggnggngggnnnncgaaaanacgnagaggacgagaggatggnaacncccacnccccacaantccccggacagnacatcgccncnacnacacnangaagnnggngngggngnnggcaagnanaaactnacanaaancantnccacgcncnaacggancnncncaaaaacancatcanggngggaaacgnanacngcnntacanagggncacacanaagncaccanaagacntananccnaanggaanganccgcaacngaaccagaacantnagncctgnaacgcangaangganagcctntnatgcgncanccacgnaanacctcnacnancgcaccnccnnaaaggccagcangataannacagnatagtcnnanntacacaaccacgagacncatgngncacannacnancanagnaaagancgcggngancnnaagcananacngagnacnanaacgncnccccaagtnaccacaancntnaanaacnnngaanacaaagcgaccannaaagccacacgnncgaaanaatnacgacnaannnaaccancncnaccacnnnngaagcgangcantatggcacnngacancgnaccncggangaaaacngcgtacaccngnagacnacnatcgtccngcngatgggccnantaggcaccnggggaccttnganngnananancataggnnnaaaacacagnnanaaaaatgnactaatanccngngnnnngntcaacgaaannancaccacaaccantcaccaganagnnnggcgaaacaaatcannggccacccctnngtgcncgccccccannaaggaanacccannaatacngcncgngttccccccncagancaanngaaggacccntatacccccaaacggctnnncaactaacggangaancaaanccccccnngacatnagaanaangantgcccacagaaagnagnanngcgcacccac

SEQ ID NO: 8001 - DNA, 705 bp, Homo sapiens
  misc_feature 3, 6, 30, 31, 32, 33, 34, 35, 37, 38, 494, 498, 502, 503,504, 505, 506, 507, 508, 509, 510, 511, 512, 513, 514, 515,516, 517, 518, 519, 520, 521, 523, 524, 525, 526, 527, 528,529, 531, 532, 533, 534, 535, 536, 537, 538, 539, 540: n = A,T,C or G
  misc_feature 541, 542, 543, 545, 546, 547, 548, 549, 550, 551, 552, 553,554, 555, 556, 557, 558, 559, 560, 561, 562, 563, 564, 565,566, 567, 568, 569, 570, 571, 572, 573, 574, 575, 576, 577,578, 579, 580, 581, 582, 583, 584, 585, 586, 587, 588: n = A,T,C or G
  misc_feature 589, 590, 591, 594, 595, 596, 597, 598, 599, 600, 601, 602,604, 605, 606, 607, 608, 609, 610, 611, 612, 613, 614, 615,616, 617, 620, 621, 622, 623, 624, 625, 626, 627, 628, 629,630, 631, 632, 633, 634, 635, 637, 638, 639, 640, 641: n = A,T,C or G
  misc_feature 642, 643, 644, 645, 647, 648, 649, 650, 651, 652, 653, 654,655, 656, 657, 658, 660, 661, 662, 663, 664, 665, 666, 667,668, 669, 671, 673, 674, 675, 676, 677, 678, 679, 680, 681,682, 683, 684, 685, 686, 687, 688, 689, 690, 691, 692: n = A,T,C or G
  misc_feature 693, 694, 695, 696, 697, 698, 699, 700, 701, 702, 705: n = A,T,C or G
ccncgnatcccctgaggggaccatgacttnnnnnntnncagtatgtgaccgagaaggtgctggctgctgtctacaaggctctgagtgaccaccactgcactccagcctgggtgacagagcgagactccatttcaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaaaaaaaaaaaaaaaaaaanaaanaaannnnnnnnnnnnnnnnnnnnannnnnnnannnnnnnnnnnnnannnnnnnnnnnnnnnnnnnnnnnnnnnnnnnnnnnnnnnnnnnnnnntcnnnnnnnnntnnnnnnnnnnnnnnttnnnnnnnnnnnnnnnntnnnnnnnnntnnnnnnnnnnnntnnnnnnnnnntntnnnnnnnnnnnnnnnnnnnnnnnnnnnnnnccn

SEQ ID NO: 8002 - DNA, 1379 bp, Homo sapiens
  misc_feature 3, 4, 5, 9, 10, 13, 14, 17, 18, 20, 21, 22, 24, 27, 31, 32,33, 41, 53, 55, 57, 58, 64, 67, 69, 72, 73, 74, 89, 90,96, 97, 98, 100, 102, 105, 109, 111, 112, 113, 115, 140,143, 145, 149, 153, 160, 162, 163, 164, 165, 169, 170, 177: n = A,T,C or G
  misc_feature 183, 194, 202, 210, 212, 245, 247, 251, 252, 253, 254, 270,271, 275, 277, 279, 281, 283, 285, 288, 295, 297, 314, 317,319, 321, 322, 327, 334, 342, 349, 363, 364, 368, 372, 373,379, 382, 388, 393, 408, 418, 423, 427, 443, 445, 449: n = A,T,C or G
  misc_feature 451, 462, 463, 473, 477, 485, 487, 495, 502, 503, 510, 511,512, 517, 519, 528, 531, 532, 537, 542, 544, 556, 562, 564,565, 570, 571, 577, 584, 585, 588, 592, 594, 597, 599, 602,603, 604, 607, 612, 615, 619, 622, 626, 636, 645, 648: n = A,T,C or G
  misc_feature 653, 656, 658, 665, 666, 677, 678, 679, 683, 685, 689, 694,695, 705, 707, 708, 709, 710, 716, 717, 718, 723, 734, 737,743, 746, 749, 750, 751, 753, 762, 774, 778, 779, 787, 789,801, 811, 813, 818, 821, 822, 823, 834, 846, 852, 855: n = A,T,C or G
  misc_feature 860, 862, 876, 888, 889, 894, 896, 897, 898, 905, 914, 917,923, 928, 933, 942, 945, 947, 955, 956, 958, 965, 966, 978,988, 1000, 1002, 1022, 1024, 1026, 1038, 1043, 1046, 1051,1052, 1058, 1063, 1064, 1067, 1071, 1077, 1088, 1091: n = A,T,C or G
  misc_feature 1099, 1107, 1116, 1119, 1120, 1127, 1128, 1136, 1144, 1154,1157, 1159, 1164, 1168, 1177, 1178, 1187, 1190, 1193, 1195,1206, 1211, 1220, 1223, 1239, 1243, 1254, 1259, 1263, 1264,1266, 1271, 1273, 1277, 1278, 1280, 1287, 1290, 1296: n = A,T,C or G
ttnnnaatnnttnnttnnannnantanttannntaaggggntgggggggggtnantnnttaaanaananaannnttttggggaaaaagnncccccnnntntntantaangnnntnaagataggggggggggggggtgagnaantntaantatngattttntnnnnaganntaggagnaacganataataataangaaattgnggggagantntagggagtataaaaatcgatatgtggatctaantnatcnnnngctatgtattacgaannattntnantncntntanttatgananatatatttacattgatnatntnannatatntaatgcngtatacgntataatngtttcaatacttanntaanatanntaattnttntagatnttatntataattttacgtcnaacaataatngttangatntttattattatcatgntnttgnanataatttttannaataatttcntatnaatcttancncaaatatnttgtttnntgttaannnataananataattatnatnntaatncaaancnattaataatttnagtttngnntaaannaaatantggtatnnttntgtntnatnanatnnnatnattantanttgngtntganaaagaaactnattgcatanttngaggntantntgaaatnnaatattcacannnttgntntttntgtannacacatatangnnnntatgannnaatanaaataagttangtngatatntantgnnncnttatcaatngtaagtatgttngagnnttgatacntnaataagaaattnataatgtgtncnagtantannntaaatataatnagagtatgtagngctatnaancactntnataaatgaacgtcnatcgttattgcnntattnannnaaagacntatatatanatntaaatnaaatnacganatatagtcnatntntattatanngntaatacnnataatatatatntaagcgagangatgaaaatacnanacaaataactatgcgtagtntntnaagataagaatnataanctnatatnntctatntcatnnatnaganataaanagatgataaancanatagaatnaggtaggntaagttatnctnnaataatnnaatatatnatagatanatagtcgatnaancntaagnatangtacgagtnnagagtatgntantantnaatgctatgtnttatnatcgataantantcgtaaatgtgatatnttanatatagtgtanaatgnacgnntnataangngtgnnantttgaantanaccganataggntacntncgtganattanaagtataatatgctatatanannnnggngnnagaaaganatgatataatatatttcgagn

SEQ ID NO: 8003 - DNA, 676 bp, Homo sapiens
  misc_feature 1, 15, 16, 17, 18, 277, 576, 627, 649, 659, 675, 676: n = A,T,C or G
ngagaaaaacctgcnnnncgctccccagggttgcttttcccaggaggtgtgagcctacctggaggaggcttaggcacagggatacctgctggaggtctgagcgttggttgagcacctcctgtttgtaggatcctgtgccagacctgtggggaggtggagagaggctaggagacatagcccccacccctgagggatgagacagctccctgcaggcaggctgtgcccagtcatctcaagcctacagctgggctgctggctgcagggtctggagggcggnggggagggtggcagacagagtagcaagacccccacttccctggccttcttcacagacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggcttgaagtggggaccatcgtggacaaagtgaaaagaagtctcttccagcacaatggcttncagcagagttgacctgggaattctgtcattgggtgtcccttctgtactcanaaaatgggttcaggccaagtcngtgaaagatngatgtttggcaaaaann

SEQ ID NO: 8004 - DNA, 785 bp, Homo sapiens
  misc_feature 1, 2, 5, 7, 14, 155, 159, 227, 234, 257, 258, 259, 260, 261,262, 264, 265, 267, 268, 292, 300, 301, 306, 317, 324, 338,340, 346, 354, 355, 357, 360, 362, 376, 381, 385, 388, 392,395, 399, 403, 405, 406, 415, 426, 428, 432, 435: n = A,T,C or G
  misc_feature 447, 449, 457, 460, 461, 464, 474, 479, 491, 496, 505, 507,510, 514, 541, 543, 558, 563, 573, 594, 600, 651, 675, 688,691, 697, 715, 719, 720, 726, 734, 735, 750, 758, 763, 781,783, 785: n = A,T,C or G
nnaancncatacangctacttgttctttttgcaggatccctcgattcgaattcggcacgaggggagaagagccgccagcggaacccctgtgtgcaccaaccttccccagagctccggagcgccctctcctcacttccaggttttggggccagagnttgncgggagaccgccccagcttccttctgaccttcagttcactttgtcgcccttggagaaagatgtttttnttttctnaaaataaccccaatgctccaaannnnnngnnannaaaaaaaaaaaaaaaaaaaaaaanaaaaaaanntaaanaaaaaaaaaanaaaaccncgaccctttaaaantntagggngtcgtttnncntananccaaacttgataanatccnttgntgngttnggncaanccananntaaaatgcngggaaaaaaangntttnttngggaaattgggnangctatggnttnnttngaaaccattntaagntgcaataaacangttancaccaccantngcnttcnttttatgtttcaggttcagggggaggngngggaggttttttaanttcgnggccggggcncccaatgctttgggcccggancccagnttttgttcctttaagggagggttaattgcccccttggcgtaatcatgggcntagcttgtttcctgggggaaaatngttttcccgttcnaanttcccnacaaaaatacgagccggnagcnntaaagngtaaagcnngggggggcctaatgnagggaccnactcnatttaattggggtggccncncn

SEQ ID NO: 8005 - DNA, 957 bp, Homo sapiens
  misc_feature 1, 2, 4, 6, 7, 13, 15, 18, 26, 29, 40, 41, 43, 44, 47, 50,59, 63, 64, 67, 69, 71, 78, 79, 82, 85, 87, 90, 94, 96,97, 103, 109, 112, 113, 114, 116, 117, 118, 119, 129, 132,133, 134, 138, 140, 145, 147, 154, 160, 163, 166, 176, 177: n = A,T,C or G
  misc_feature 180, 181, 188, 189, 194, 195, 210, 212, 214, 215, 216, 222,224, 226, 231, 232, 249, 250, 253, 259, 263, 264, 269, 278,281, 282, 287, 289, 290, 293, 295, 296, 297, 301, 305, 306,309, 310, 312, 316, 317, 319, 321, 324, 327, 329, 332: n = A,T,C or G
  misc_feature 339, 340, 344, 350, 352, 353, 354, 360, 367, 369, 370, 376,377, 381, 385, 390, 391, 400, 401, 402, 403, 408, 413, 417,424, 426, 437, 441, 444, 445, 448, 451, 454, 455, 457, 460,463, 467, 470, 472, 475, 482, 483, 484, 485, 486, 490: n = A,T,C or G
  misc_feature 491, 495, 496, 499, 504, 505, 507, 509, 513, 520, 523, 528,537, 540, 542, 551, 552, 559, 566, 567, 568, 569, 576, 577,579, 582, 583, 584, 586, 587, 589, 593, 594, 598, 600, 601,602, 603, 607, 610, 615, 616, 618, 623, 628, 631, 638: n = A,T,C or G
  misc_feature 640, 646, 648, 649, 653, 654, 656, 660, 662, 670, 671, 672,674, 678, 684, 689, 691, 696, 697, 700, 701, 705, 706, 710,712, 714, 716, 717, 722, 728, 729, 730, 738, 739, 748, 762,767, 768, 770, 771, 772, 774, 775, 776, 777, 778, 784: n = A,T,C or G
  misc_feature 789, 790, 793, 796, 798, 808, 810, 820, 824, 828, 832, 833,839, 846, 848, 852, 854, 855, 857, 859, 863, 868, 869, 870,877, 879, 880, 882, 891, 895, 897, 903, 904, 905, 906, 909,911, 919, 923, 930, 937, 938, 940, 943: n = A,T,C or G
nnangnngtctananagnggggtgtnttngatttcgaacnncnncanttnaagaatgcngggnnttnanangttgtannagnggngnggnaaantnntggttnatagantannnannnntaatcgacantcnnntgtncnttttncnataaggnaataanttntgngcgatgtctnntgnnatgtatnntactnnatcttccctcatgancntnnnataacntnangaatnntagactttcaagacttnntgntaattntatnntaacngtggatttnttnnatagntnnatnannnctancgtnntcnncnaaannantntantgntnatnataatanntagntcttantnnngtttanaagatantnnattggnntgangttntatanncttgagtcnnnngaccncatantaanttgtttncnaatattatttntaantanntantgnttnntncanacntttntgnanacntttaaannnnngccnnaaanntcntcaanntncntctngtatctngcntattnttcagaatncancntcccttttnntaacatnctgaatnnnnataaaannanatnnntnnanatanntatnannnntatnacnatctnntnatganaactntanacttttnanattcananncatnncnagtnantaattaannntntttntattgnatcangnatttnnatnntcanntcgnanantnngatgnataaannnagtcatannaaagattangtacgactgcggtncaacnntnnnannnnntgaatnatgannttngananaattttgtgnangataatgctnattnaaantatnncactantataacnancatntnntntntgantaatnnnaatattntnnanatatagttngacntnacgtgnnnnctnantgagcagnatangttatcnagatatnntntanctctccatgaccac

SEQ ID NO: 8006 - DNA, 682 bp, Homo sapiens
  misc_feature 4, 17, 18, 19, 20, 21, 22, 662, 671, 682: n = A,T,C or G
gcangaggcctgcatannnnnncattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctcccgaaaacacagtgatcaccgaatgagggaaaaagcagacattcaacttcttgtttacactattgatgacttaattgataagctctcaactattagttaactagtatcacatgtttagttgggtattgtaaacctatgtatcccagaagantgggaaganggataagaaan

SEQ ID NO: 8007 - DNA, 875 bp, Homo sapiens
  misc_feature 2, 4, 5, 10, 13, 16, 22, 23, 26, 37, 38, 39, 40, 41, 42,51, 57, 67, 68, 70, 74, 81, 88, 94, 96, 107, 126, 137, 139,141, 143, 144, 146, 150, 152, 155, 156, 157, 166, 169, 178,182, 188, 197, 198, 204, 207, 225, 248, 253, 254, 263: n = A,T,C or G
  misc_feature 268, 274, 279, 281, 284, 290, 298, 302, 306, 315, 316, 322,324, 329, 330, 331, 332, 336, 344, 354, 355, 358, 360, 363,366, 378, 383, 390, 404, 408, 415, 423, 425, 435, 441, 449,456, 457, 459, 461, 471, 480, 481, 500, 503, 507, 510: n = A,T,C or G
  misc_feature 511, 515, 517, 522, 529, 531, 541, 544, 545, 572, 573, 577,590, 608, 622, 633, 642, 644, 645, 648, 650, 657, 663, 665,669, 672, 674, 679, 682, 684, 689, 692, 693, 698, 705, 708,709, 713, 718, 722, 733, 737, 738, 743, 751, 754, 755: n = A,T,C or G
  misc_feature 764, 766, 767, 775, 780, 783, 792, 793, 795, 822, 823, 834,838, 839, 847, 848, 851, 852, 857, 858, 863, 875: n = A,T,C or G
angnngaaanaanagngggatnnaanattggaaaccnnnnnnatgagaggnggggtnaaatgatggnntntggnaaatttngaagaanaaaaananaaagtattaancggaggaggggggaagtgnataaataattntntnannanagantnaannntaaaaatanttnatcaatttntgantaaaanttagattannaatctnatntttggagataaatattgntaaaatataaaaagaaaagtaanaatannaagaattantatantattantatananaanaaaatngtatgaantatnatantttaaaaannagtaananaatannnntatnaaaataanactaggaatnnatnantanaantttaaaaaaaanaatanataatanaaattaaaaaatanttcnaaaaaantaatgtanantaaaaaaaanataaantaattaangaaatannananaaataaaatntataataannataaatatataataataantantatnatnnagtntnaaatnataatantnataatataantannaaaaaatataaaaataagaagatatgnnaaangaaaaaaatatanaggaaaagtaaattaatngatatttaaagaanaaagaaaaaanaaaatatanannatnanaatatantataantnaaantananaaaanatncnaattntannagatnataaganaanntatnaaatnaacntgaaatatatntaannatagnacttatanatnntataaagangnnttaagganaatanatnaatagatanntnaaataaattataatatataaaaaatannaaataatgagntganngattatannaanntatanngtatntaatataataan

SEQ ID NO: 8008 - DNA, 671 bp, Homo sapiens
  misc_feature 3, 17, 18, 19, 20, 21, 22, 588, 591, 619, 621, 624, 625,635, 642, 645, 657, 669, 671: n = A,T,C or G
gcnggagggaaatcatnnnnnnaggcaagcagtttcaccggatagtgacataccatcgccacctttatgatatccacgtgactgttcagccaaagtataaacacgtttatcctaagaactctgtagtaagaaaaagccatttgtagggtgcttaagcttgtttgtaaaatggcctacttgaagtcctcatgaataatgagggttgactttcatttgcttgaaacttaaggaagtttgtgcctataaaagttactgcaattcagtatttctttatttttttcgagacagagtctcaatctgtcgcccaggctggagtgcagtggcatgatataggctcactggaagctctgcctcaggggttcatgccattctcctgcctcagcctcccgagtagctgggactacaggcgcccgccaccatgcccagctaatttttttttgtatttttagtagagacgggttttcaccgtgttagccaggatggtctcaatctcttgacctcgtgatacgcccgccttggcctcccaaagtgctgggattacaggtgtgggccaccacacccagccttttttttttttttttgaaaaanagngtttatttttgccaaaacccagggtggngnggnngggccaaatntgggttnttnaaacctcccccnccccgggtccancn

SEQ ID NO: 8009 - DNA, 685 bp, Homo sapiens
  misc_feature 3, 5, 6, 12, 31, 32, 33, 34, 35, 623, 624, 647, 656, 668,683, 684, 685: n = A,T,C or G
ccncnntccaangggactatcctctggaggnnnnnccatgcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagcctacctgtatgtcaataaacaacagctgaagcaaaaaaaaaaaaaaaaactcgaccctnnaaactttagggagcctttttccntaaatccancttgaaaaaaancttttttgatttggnnn

SEQ ID NO: 8010 - DNA, 690 bp, Homo sapiens
  misc_feature 3, 5, 6, 9, 19, 32, 33, 34, 35, 36, 37, 38, 44, 610, 656,680: n = A,T,C or G
ccncnntcnaattcggcangaggccagatccnnnnnnnacagcngaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgntgatagagacatcgaagtacaaaaaaaaaagcctttaaactatagngagtcgtttacgtagatccagacntgataagatc

SEQ ID NO: 8011 - DNA, 780 bp, Homo sapiens
  misc_feature 2, 3, 5, 6, 7, 19, 20, 23, 25, 30, 31, 34, 35, 40, 42, 43,45, 46, 47, 51, 53, 60, 61, 66, 67, 70, 71, 72, 73, 77,82, 89, 104, 116, 129, 138, 142, 154, 162, 164, 166, 172,207, 211, 214, 217, 238, 241, 249, 254, 255, 265, 296, 305: n = A,T,C or G
  misc_feature 316, 323, 333, 334, 337, 348, 349, 353, 360, 376, 377, 378,380, 418, 420, 428, 446, 449, 455, 466, 479, 481, 507, 509,516, 517, 525, 533, 546, 573, 585, 607, 622, 641, 644, 647,648, 651, 654, 656, 659, 662, 677, 683, 685, 699, 709: n = A,T,C or G
  misc_feature 710, 712, 724, 741, 750, 751, 772, 773, 780: n = A,T,C or G
annannnagaggggaatanngantnagttnnaannccatntnnannnaaananggggggnnaatannatnnnnttgnggccnaatctgnacgataaacaatgangtcaaatcctanatgccttaatatntgtacattnatanaacaattatatngattatcnancnaaagtnactgtgaagagcgataaatacttcactattaaganactntcngcngagaacatttcagtggaacanttngcaaaaanatttnntcaaaaatgngcaattcctgggaaaaaaggaatgatggaangaaggttantagcagttttncataaanaattagacannatnggcctgcattnntatngactaangaatcccaatttatannntnaagaccattaatatatgaatacataaggccataacatntnaaattaancacatggagtgatttgtnatntcgtgntaatttaaacntaagatgttattntnaaaaatgatcttggaatataataaanantttaaanntgaggaanggaaggtnaaaataaaaattnctgataacccttttctttatgaaatcntgctaaataaanaataacctaggatatacttaanaagaaccaagccaanaaaaaattaccttttaagnaancanntcnttnanttnatntttctttctgaaatnaatacncnaattttaatgaccncaggattttnncngatcttaacggnaaaggaataaattaaanaccaaggcnncatatacctcttgattcattnnaataaan

SEQ ID NO: 8012 - DNA, 848 bp, Homo sapiens
  misc_feature 4, 6, 14, 176, 183, 192, 204, 207, 208, 215, 217, 224, 226,227, 231, 241, 258, 260, 263, 267, 271, 276, 280, 284, 289,290, 298, 303, 306, 309, 310, 312, 316, 327, 328, 334, 348,350, 351, 358, 360, 367, 372, 377, 385, 392, 403, 411: n = A,T,C or G
  misc_feature 418, 422, 423, 424, 428, 430, 433, 436, 437, 444, 448, 452,455, 456, 461, 463, 465, 480, 483, 493, 500, 502, 505, 506,509, 510, 513, 519, 541, 545, 546, 563, 572, 581, 589, 590,591, 593, 601, 603, 604, 624, 630, 640, 643, 651, 660: n = A,T,C or G
  misc_feature 663, 667, 673, 677, 679, 686, 711, 717, 720, 725, 734, 740,747, 759, 761, 762, 765, 766, 790, 799, 800, 814, 830, 835,848: n = A,T,C or G
ccgntnttccgaantcggcacgagaagactttctcctaatgcttggaaaaccataactgacatagttctaaatggcacagccttcgtgacactagaaattggaaaacaactaattaaagcacagaaaggagcagcatttctttctattactactatctatgctgagactggttcangttttgnagtaccaangtgctttctgcnctnngcaggtntngacccangnnctantctcttggcntttgaatggggtgattntngcngtgnattnagctnttcnatcnctgtnntcagagcntattnttnatnntnaccntagtactttanngctatnacagtatcaataantnnttttttntnttctacncactntttcnacaccctncgaggancgagttccatnttttgctnacaaacnagtnnncttngnatntannaccggancctntcanttnnggatntnanaactggagctatggnggnttaccttgcntttaacntngannaannccntctacnaagcaatgggcatttgggcccncgtnnggggatttctaagaaancttggatgnaggtggganatttcacnnncncaattggnanngcgtataggcctagaaacantttggnaacggtttgnaanaattctgnttttcgggncantttngggtgnaagnangggggcntctaaatgtaaaccataactccttntcgganaanggttnggaaaaaanattttnttaaaancctaaattccangnngcnncaaacctttttccatttttgcacnggaaattannggggtaaaaggccnttcctggaaaaaattntggcnccccttaaggttn

SEQ ID NO: 8013 - DNA, 690 bp, Homo sapiens
  misc_feature 1, 5, 6, 9, 11, 13, 29, 30, 32, 33, 34, 35, 108, 553: n = A,T,C or G
ncccnntcnantngccggcaaaggacttnntnnnnttgaaaaccatgtaaagtttgatcatatcattagctattggtcagacctattttgttgtttgagaaaaacagncacatggggaaaatggtgaggtgaggtagtgtgttgaggagctggaagtgagcagctcttaattttttcctcctgagactgagttcggaagaagagtagaccatggcatggaggtgggagagacaaggacagagttggggaggtcactgcctcacacttctgctcacaccgctgggtctggtggaaactcaaagtttgtatctaaaaatgggaggtgttgggatagagtttgcttcctaatacaattgaaataaatcaggataatgttttggtgctatgtaataataatagttaatatgaccaattattctgtgccagacacaattctgagtactttttgagtgttgtctcatttaatctcttcaaaaccatgtgagaggcctagcgtggtggctcacacctgtaatccctgcactttgggaggctgaggtgggcagatcatgangtcaggagttgaagaccacctggtcaacatggtgaaaccctgtctctactaaaaatccaaaaattagccaggcatgctgctcacccctttaatcccaactacttgagaaactgaggcaggattatcccttgaagccg

SEQ ID NO: 8014 - DNA, 1325 bp, Homo sapiens
  misc_feature 3, 4, 11, 12, 13, 15, 18, 19, 21, 26, 32, 43, 44, 45, 46,48, 49, 52, 56, 69, 83, 84, 86, 88, 91, 105, 114, 117, 118,127, 128, 129, 135, 136, 137, 138, 150, 151, 153, 159, 161,163, 165, 185, 211, 213, 223, 225, 226, 229, 234, 236: n = A,T,C or G
  misc_feature 237, 239, 240, 251, 256, 257, 262, 263, 266, 275, 276, 278,279, 283, 284, 287, 288, 293, 297, 309, 319, 322, 323, 325,327, 333, 334, 338, 340, 342, 344, 346, 347, 355, 359, 364,366, 369, 376, 379, 386, 397, 399, 403, 406, 410, 413: n = A,T,C or G
  misc_feature 414, 418, 419, 423, 424, 438, 442, 443, 446, 452, 464, 466,471, 474, 476, 481, 494, 497, 499, 502, 507, 510, 513, 526,529, 537, 545, 547, 548, 551, 553, 554, 566, 568, 569, 570,575, 582, 584, 588, 590, 591, 593, 607, 615, 616, 622: n = A,T,C or G
  misc_feature 623, 624, 627, 628, 630, 637, 638, 640, 641, 642, 648, 661,663, 667, 674, 679, 680, 684, 687, 691, 695, 699, 700, 702,703, 706, 708, 716, 718, 722, 726, 729, 742, 751, 764, 766,771, 774, 779, 793, 795, 798, 808, 826, 835, 836, 854: n = A,T,C or G
  misc_feature 855, 858, 869, 871, 875, 884, 886, 889, 891, 897, 899, 909,913, 919, 920, 925, 926, 931, 934, 940, 943, 949, 953, 955,957, 960, 961, 963, 975, 984, 987, 988, 994, 995, 1001,1003, 1004, 1005, 1015, 1027, 1030, 1031, 1034, 1035, 1037: n = A,T,C or G
  misc_feature 1039, 1040, 1041, 1043, 1044, 1053, 1055, 1058, 1063, 1064,1066, 1069, 1071, 1074, 1076, 1079, 1084, 1086, 1088, 1091,1092, 1095, 1096, 1098, 1100, 1106, 1110, 1111, 1127, 1129,1131, 1134, 1135, 1136, 1145, 1146, 1147, 1151, 1159: n = A,T,C or G
acnntaacttnnntnttnncntatgntaaggnggggggggttnnnncnngtnatanttttaaataaaancccctttttatttnntnantangtaggggggggggnatttccacncgnnttttgggannnagcccnnnncctccgatattnnantatatngngngngaaatactataacgtgtgtntatatatctcccccccctatatcggngngatactcagnanntanacatntnntnngatctccactncgagnnatcanntgnatataatcnncnncaannagnntatantcantcacatagatgngactatattntanntncnttctcnnactntntntntnnactaatanattntgatncnccntattatntcngatatcntcataacagtntnatantancttntcnngtanntaannttatataagtgttnactnnacnagatanattataagttangncgttntcnanctganaactctttattgnttntnttnatcanatnatnctttgctcaatcnacnttcaattntgaatagntnnctntnngttatgatattntnnntttanatatctntntgantnnantactaagctctatncaacattnnatattnnnaannanacgatanntnnnctttcnttgtacctcatcntntctngtatcangattnngacncgnctcncttntcgnncnntcntnatattatntntgancttntanacactatattctntatcaatangtgtatagtatgnanacatngcncatancgtaaacataaacntnatngaatgatctnatttataataatatattnatatatcannaactatcatgttatcctnngancatatatatancntgantctttagtncntcnancattcnanatacgtcttncatnccgctnntttgnnttatnccntattgngantgtgtnctancntnttnncnaacgtgtcgtantatacagtntanntatgtnnttatancnnnacatccactngtacgatatatncanngcnnancnnnanntatgtaatntngcnactgnntnaantnatncncantatgnananatnnttnntntncattgnatcnntagcttttatcatgcncnanagnnncacttgtannngttngtatatantntatatcgctntcctnnttgangtatntattctgtgtantactncttcgncncannactcagatcnnanatttcnctcgtnngangcatgttaantactcncnngttanatatatnatatatcanttctctatattntatnaacttgatntatannactntaccn

SEQ ID NO: 8015 - DNA, 662 bp, Homo sapiens
  misc_feature 1, 11, 438: n = A,T,C or G
ncccgatcgantcggcacgactcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggtcatctttgctttgaaccagaccctcctgcagcangaaagcctgcgagcaggcagtcttcagatcccctacacgacggaggatctcatcaaacactataactgcggggacctcagctccgtcatcctcagccatgacagctcccaggtggaggttcccaattttattaatgccacgctaccacctcaggaagcgcatcactgctcaaggaagaattgacagctactttaccccgggaacttgatctacaaaccggaatg

SEQ ID NO: 8016 - DNA, 663 bp, Homo sapiens
  misc_feature 3, 6, 663: n = A,T,C or G
ccncgnatcgaattcggcacgaggccacctactgcgtcttggtcatggagaagaagagctggagacagagaaagatttcagcagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcaagtattctaacaacatataatggccaaaagcatcttattcgcgacatcatcaatagacgatgtggaaacaatccattgattggaagaccaaacaaggtgacaactgttgatagatttcaaggtcaacagaatgactatattcn

SEQ ID NO: 8017 - DNA, 909 bp, Homo sapiens
  misc_feature 4, 5, 6, 7, 8, 9, 10, 12, 14, 17, 18, 23, 26, 27, 30, 45,49, 52, 53, 57, 60, 62, 63, 64, 67, 68, 69, 72, 82, 84,87, 102, 112, 113, 126, 131, 132, 133, 135, 140, 141, 158,163, 170, 182, 186, 189, 192, 199, 213, 217, 247, 254, 264: n = A,T,C or G
  misc_feature 265, 266, 277, 281, 286, 294, 301, 303, 304, 310, 311, 312,314, 319, 321, 328, 336, 347, 352, 363, 367, 378, 382, 384,386, 388, 399, 404, 408, 421, 423, 427, 434, 435, 436, 452,456, 461, 466, 471, 487, 488, 491, 492, 494, 495, 507: n = A,T,C or G
  misc_feature 515, 516, 522, 527, 529, 536, 548, 559, 566, 578, 579, 583,601, 602, 613, 614, 630, 637, 648, 651, 653, 655, 666, 671,676, 681, 683, 713, 717, 718, 728, 737, 738, 760, 761, 762,792, 796, 798, 804, 810, 814, 815, 821, 827, 834, 842: n = A,T,C or G
  misc_feature 845, 856, 862, 866, 868, 869, 884, 887, 888, 891, 893, 894,896, 897, 898, 901, 909: n = A,T,C or G
aaannnnnnnananagnnggganaannaantataaaaattaattnaaanagnnggantanannnttnnnctntggaaaattntnttnagataaaataaagtnagaattacannaattaattaaacnaagannnanatttnnaataggaaagataaaanaaaanagattantaaattataaanatanaantgntggaatntgaaattaatgaanaagntaatattaaataaaaaaaagaaaatgtaancattatngaaaatagtnnnaaggattaaangaanaaacncaaaaaanaaatcantnntaaagnnngnatagnanaaaaatnatataatnaaaaaaaatangtttnaaaaatgtganaaanaaagattaaanacancnantnattaaagagtnatacnagtnggaatgaaaaaanangatnatatatnnntaaagtaaagaatganaatnaattnataantaagnaatatagtaaataaannagnngnntaaaaattaaantgggaatnnaaatgntaaanantgtacanataggagatggnaataaatttcnaataatngattagaaaatnntgtntatgaaaagaaactgtgnnaatataaaganncaactactattaatanaagctangatttgtttanaanantntataatggagntaaanaaatngaatngngaatatgaatattgataattatctaaaaanaaanntttaatattngagatattnngattataaggtatttatgcgtnnntaataagaagttaataatcattaaaattanggantntttaanaataantgtnnatgggngtaaanaaacaanaaaattanaangattaaagaanttaaanaaantnntttagacatataaanaannatnannannnatnattaaaan

SEQ ID NO: 8018 - DNA, 1325 bp, Homo sapiens
  misc_feature 1, 2, 5, 6, 7, 8, 18, 20, 22, 23, 27, 28, 35, 36, 48, 51,57, 59, 62, 63, 69, 72, 75, 76, 77, 82, 84, 87, 91, 93,95, 96, 98, 105, 106, 108, 120, 121, 124, 126, 132, 141,142, 146, 148, 155, 157, 161, 164, 169, 171, 184, 189, 194: n = A,T,C or G
  misc_feature 201, 205, 206, 210, 226, 228, 230, 235, 236, 241, 250, 254,257, 260, 262, 267, 268, 272, 275, 278, 289, 298, 300, 303,304, 305, 307, 308, 311, 318, 320, 321, 324, 325, 328, 329,334, 336, 342, 344, 346, 348, 351, 352, 355, 360, 363: n = A,T,C or G
  misc_feature 373, 376, 379, 380, 387, 409, 413, 414, 423, 424, 427, 428,429, 434, 437, 442, 455, 471, 473, 478, 485, 488, 489, 490,494, 497, 504, 508, 509, 510, 511, 512, 513, 516, 521, 525,533, 541, 542, 550, 556, 558, 563, 565, 566, 571, 572: n = A,T,C or G
  misc_feature 575, 576, 590, 591, 594, 596, 598, 599, 600, 602, 615, 631,633, 637, 640, 646, 647, 652, 653, 656, 658, 664, 667, 674,675, 678, 680, 683, 684, 690, 692, 695, 697, 699, 704, 705,709, 723, 726, 727, 730, 734, 740, 743, 744, 747, 748: n = A,T,C or G
  misc_feature 751, 752, 755, 760, 762, 775, 777, 779, 780, 784, 794, 799,802, 803, 804, 805, 824, 827, 829, 832, 833, 834, 841, 848,853, 860, 864, 865, 867, 871, 873, 875, 880, 882, 885, 892,893, 894, 896, 903, 908, 909, 912, 913, 914, 915, 928: n = A,T,C or G
  misc_feature 932, 934, 936, 943, 951, 956, 961, 982, 984, 986, 987, 989,1002, 1021, 1022, 1030, 1031, 1037, 1040, 1044, 1051, 1054,1067, 1077, 1083, 1087, 1095, 1103, 1106, 1127, 1141, 1154,1162, 1163, 1167, 1173, 1181, 1189, 1194, 1196, 1204: n = A,T,C or G
nncannnnattattctcncncnnaatnnaaggtgnngggggggttttnctncaactncntanntttttnggnatnnnccccnantgnatangntnncnaggatanngngggggggggttnncanantatagntttttgggnnagananacccgtntnccgnatntaatntntagattgggggantattntatantatgagngggnnatgnataccctcttcattcngnanacacnnattanaatatgctnatgntanctncnctctnntatntcntancgtatattttnttcaccatnanatnnntnntcncatcacncnntannatnnatttntncaattntncnantcnncantcgtntanaatcatatcntanatnnctataanagacgctctaactaatcgcacntatnntatttatcnntannngagtnttntatcntatatcaatatanatttctcttagatccnanttacnttacctntannnctcntantattctnactnnnnnntcnacgtnacgnaataatancttctatnnacgctcgntgatgncnactgntnntattnnatnnaatactacttctcnntcntncnnncntctatcacatttncgatattgaactcgtntntatnctnccttanntcatnnttntnacacantanacatcanntangnatnntgctcntntancntnatctnnctanatctctctatctantannttntacnctagcnaannctnntcnnatntattnantacttcaatactntntnnactnttttgacctnatttnctnnnnttgttgcttttataacatntantntannntctgacncttatancgatntatctcnatannantttncncnctatntntcnctttatnnntngctcacnatatnnacnnnncataagataaacntccnantnatttacncatagatntatangtaanattatgtcatatgtccttcantntnntntgacatatgaatncagtacctatatctgatcnngcatatannctcgcnacnaacnctcatanaantatccttatatanatatgaattngtgtangagntatgccgntaacgtgntcnatacgctctatatatgcaatnatttttttcatacncatgtacagtacntctatgtnntatntagtanatgtctcnactatganctganantattcagntatagtcccttncnactcatctcgananactctntcactatnnatatannttctctnaatctatnnntatatctctcttgatncttctcacaaaanatgagantcatgtatatntangcgn

SEQ ID NO: 8019 - DNA, 823 bp, Homo sapiens
  misc_feature 1, 2, 5, 7, 8, 9, 13, 14, 19, 20, 21, 22, 26, 28, 36, 38,43, 44, 47, 48, 52, 57, 65, 68, 69, 70, 71, 73, 95, 98,99, 102, 114, 128, 132, 136, 137, 144, 149, 155, 157, 165,174, 188, 190, 198, 209, 215, 238, 245, 255, 267, 269, 270: n = A,T,C or G
  misc_feature 273, 276, 277, 281, 282, 286, 297, 300, 305, 312, 317, 321,331, 337, 350, 359, 370, 384, 388, 389, 414, 424, 443, 451,464, 471, 474, 476, 477, 489, 491, 493, 494, 499, 510, 514,517, 522, 526, 530, 532, 535, 541, 548, 558, 563, 565: n = A,T,C or G
  misc_feature 570, 577, 578, 579, 581, 589, 590, 597, 598, 603, 604, 605,606, 611, 614, 623, 624, 625, 627, 630, 634, 646, 658, 661,665, 681, 684, 688, 699, 703, 705, 723, 728, 732, 746, 747,752, 755, 756, 757, 759, 761, 762, 769, 770, 772, 776: n = A,T,C or G
  misc_feature 780, 784, 788, 790, 798, 801, 803, 808, 809, 813, 816, 819,821, 822: n = A,T,C or G
nnttntnnnatannggggnnnntttntntttgtacncnttttnntanncagnggggnaaacgcgnttnnnnantcccccaagtttacttgggatnaanntgnggtggggaatanctgtatgaatatanaccncggnngacctgntagangcctgnanatgctgtncacagctcngggttttgggatantntccgtggntactgtatgtnacgganagttatagcctttacttactgtnctccctnactttggagngatgagagatcngnnttnganntcannatcntgttggatggntantctgnctacggngctgntatngcaaatcacntactgngattgagcacctnactgttttncccctcctctnctcttagattctgnttgnnccggttattctctacctacctcgangtaatgtgtntctcgtcactcctatctantctccttncccttatcttctntgccttnatntnnagaatctgtggngnanntcctnggcatcataancagnttnatctnttanaagntnttngtgttnagtaaanaagcccattntgtgntnctttnatctagnnntntcggggtnnggaaaannttatnnnnattanttnaaggtggannntnaancgtntgaatatttctnatgaaactgggnatntgtngtcctaatagggagtnatnctantgctactgganagangnttggggatttttcaatgntaagngggnttggactcttatcnngtganatnnntnanngggggtnngngcgngctnaacnatgntntgaaatanttngngggtnnggcntanaananng

SEQ ID NO: 8020 - DNA, 1171 bp, Homo sapiens
  misc_feature 5, 7, 12, 25, 26, 27, 28, 32, 39, 42, 45, 46, 47, 49, 51,53, 55, 57, 61, 64, 66, 69, 71, 72, 73, 78, 79, 80, 81,84, 88, 94, 95, 97, 98, 103, 110, 114, 122, 124, 133, 155,164, 165, 169, 174, 177, 180, 190, 193, 201, 204, 209, 211: n = A,T,C or G
  misc_feature 225, 227, 228, 233, 234, 237, 238, 240, 241, 252, 258, 259,260, 261, 263, 269, 272, 273, 276, 277, 278, 281, 282, 292,297, 315, 329, 331, 332, 333, 336, 345, 346, 347, 353, 364,368, 377, 379, 380, 393, 394, 396, 406, 413, 416, 421: n = A,T,C or G
  misc_feature 431, 434, 441, 450, 454, 455, 456, 461, 463, 468, 472, 475,479, 482, 489, 491, 501, 503, 507, 513, 515, 521, 524, 540,541, 563, 564, 577, 589, 590, 612, 615, 616, 617, 619, 623,633, 634, 646, 650, 651, 657, 671, 674, 683, 687, 697: n = A,T,C or G
  misc_feature 701, 704, 705, 710, 712, 714, 718, 719, 721, 722, 728, 731,734, 736, 738, 745, 747, 748, 749, 762, 776, 778, 781, 783,795, 799, 802, 806, 808, 811, 812, 814, 816, 821, 824, 827,833, 839, 840, 842, 845, 849, 853, 858, 862, 865, 866: n = A,T,C or G
  misc_feature 872, 873, 881, 885, 888, 890, 891, 896, 898, 908, 910, 920,922, 929, 932, 939, 947, 952, 962, 967, 973, 992, 996, 997,998, 1003, 1004, 1009, 1027, 1028, 1030, 1039, 1041, 1042,1043, 1047, 1048, 1053, 1054, 1075, 1081, 1089, 1092: n = A,T,C or G
  misc_feature 1103, 1106, 1108, 1113, 1119, 1122, 1127, 1130, 1135, 1136,1141, 1144, 1146, 1150, 1152, 1153, 1155, 1157, 1165, 1168,1170, 1171: n = A,T,C or G
attantnactanaagtagtggggannnnttanttatttnaantcnnntntntnangnggtnggntnatncnnnatttnnnnatnaggncgaatnncnntcttntaaattnaagngtttcgcntnagggactanttggtctaaacttgtgtgctcnattctgggnnaatntagtnttncantcttggactnagnggtaatgnttnttcananttattctaacaggnannatttnngtnntnnttcaataaggngtgtannnnangtgcgnganngannnaanntggttaatgntggtnatcataatagattatttntataatgccatacnannnagngtgctcttnnngaatantgattacttgntttntagttgatnanngattttgaattgnngnattttctaangcgttanttngctanaaatcggggngtngttgtgntagttaacntgannnatccntnaggcngtcngcnatanatnattcttnanacatccagtntntagntttaantntattgngantaggggtggaacattnnggaactcatggattgcctatcnntttctttatcatncgatgggttaanngttttgttatatgatagtatanatnnnangaanaatgatttgnntaaatatctacnttgnnataggntaagttattctggnatngtgttattngtcnagaatctggntctnttnncatancngngganntnntcacgntcntgntnangattatncnnnatatatatacgcntttctgtatttagnanatntntattttgtgaantaanatntacntnatnngntngtctnatnttnccgcantatatnngnatngatntgtnctatnattnttnngaggtnncatttggnaganctngnnctcantngacgaatttntntcttgtacanantcgaaanatncggtaanaagggacnaaatntgtgcctcanacatnacacantacggcatagtgacatctnaggnnngatcnntagtnataaatctctacccaganntnatcacttantnnnggtnnaaatnntctctatgttttgagtgggcnaattgnattatctnatntctgtaaggcnctntngcggntactanatntctanatntactnntcttntancnttgngnntntnctcacctncgngnn

SEQ ID NO: 8021 - DNA, 1010 bp, Homo sapiens
  misc_feature 2, 8, 9, 12, 17, 25, 29, 35, 37, 38, 41, 42, 44, 45, 65,66, 70, 71, 72, 73, 74, 97, 100, 101, 102, 104, 105, 108,111, 113, 114, 117, 123, 129, 132, 134, 137, 144, 147, 152,153, 155, 158, 160, 163, 169, 170, 175, 176, 180, 184, 186: n = A,T,C or G
  misc_feature 196, 200, 204, 206, 207, 209, 213, 217, 218, 221, 223, 229,237, 240, 242, 243, 244, 251, 254, 255, 257, 258, 280, 282,289, 301, 307, 310, 311, 313, 319, 322, 323, 335, 336, 342,345, 351, 353, 354, 356, 358, 365, 366, 368, 369, 370: n = A,T,C or G
  misc_feature 376, 379, 382, 385, 387, 390, 394, 396, 397, 402, 403, 407,412, 422, 423, 425, 435, 437, 469, 478, 482, 491, 492, 493,494, 497, 507, 518, 522, 523, 529, 530, 535, 538, 541, 549,559, 562, 563, 564, 565, 567, 571, 578, 584, 587, 588: n = A,T,C or G
  misc_feature 591, 593, 597, 603, 606, 607, 608, 611, 614, 617, 625, 627,629, 632, 635, 636, 637, 648, 650, 652, 657, 659, 663, 667,674, 676, 682, 687, 688, 698, 710, 714, 716, 718, 720, 722,723, 727, 729, 730, 734, 735, 736, 737, 742, 744, 746: n = A,T,C or G
  misc_feature 750, 751, 760, 772, 773, 777, 778, 781, 787, 788, 789, 792,802, 808, 810, 814, 815, 818, 822, 824, 831, 832, 840, 844,845, 851, 855, 858, 860, 871, 872, 884, 887, 891, 896, 897,900, 902, 906, 911, 920, 924, 927, 935, 937, 940, 945: n = A,T,C or G
  misc_feature 948, 954, 966, 970, 975, 984, 989, 1002, 1006, 1009: n = A,T,C or G
tntcgttnnctnatagnggggtctntgtnattttntnncanntnnaatagaggtgggagtctagnnttgnnnnnagacccgagtgagtgaggggttnatnnngnnttnagncnnggngtgcgntttttntancntanaaatctnttntcgtnnanttntnttngctaanntttanntagntaanangttttaagtntagntccntnnantatnatgnntgntnttaagntcataatnatntnnncaagatntgnnanngtgcttagaaagtaaattattnantttggtngttaagtagatntgtatnagnncnaaatanatnnaatcgattgganntttgtnttnaatatngnntncntgagctnnannnaaaaantgnaancantnaantttnanntcatnnagtnggaanttaagttctnntnaacattttcntnttcatttaattgatatattattagtgataaanggtactaantttngtattattnnnnatnatggtaatantcagtttgcantgtnnttattnngtccnaangtngaattgtnaaaaatgtgnatnnnnanaatngcgtagntataanatnnggntntggnatgganctnnnatnttngtnatgtattngntncanatnnntatcagatatngntnaggtntngctntatnattacangnttattnaagtnngcattatttngtctacggcatnatangnanantnnttanannattnnnntgganananattnnatgttgaantgggagataacnntaanntgntgtttnnnaantgtatatcgnatattncncatnntangtananatatgannagtttaangttnntatgantggntcncnatgttatattnnttcaggtatagngantatnggtannacncnatanattgnctcatgatnatgnganaaatggancnaantctanatntttganatgaaacatagntagnaaatncgatgtgtnagaangtatggttgtatngcanatng

SEQ ID NO: 8022 - DNA, 665 bp, Homo sapiens
  misc_feature 2, 4, 23, 25, 26, 27, 29, 40, 46, 51, 52, 53, 60, 61, 76,85, 94, 95, 104, 105, 108, 112, 129, 135, 141, 144, 154,157, 173, 180, 193, 198, 199, 200, 202, 206, 210, 212, 214,217, 227, 240, 245, 251, 254, 267, 276, 286, 293, 295, 296: n = A,T,C or G
  misc_feature 297, 300, 302, 306, 307, 316, 322, 324, 327, 328, 330, 331,337, 343, 344, 346, 347, 348, 356, 368, 380, 381, 391, 399,401, 407, 408, 413, 414, 417, 420, 423, 427, 429, 432, 436,438, 452, 453, 457, 458, 462, 468, 478, 485, 494, 518: n = A,T,C or G
  misc_feature 519, 526, 527, 553, 558, 591, 612, 621, 632, 658, 665: n = A,T,C or G
gngntcgaattcggcacgagacnannntncttatcctcanaacacnttagnnnagctctnnagtaatctggctacnagtatgccntagaaaagnngacacattnnctnaaanatgatgatagagaacangtgatnttttgngcngattaccaanganctttgccctgttgagngtctggnggatcatagggantcctnnncngccnttanantnatngcaaggtcangatcgctgagggntgagnatgganctntcatacctataanggcaacctngagttgatcnaaaaaangnnnacntnctcnnagtacaccnactcanancanngnngacatntgcatnnannnggacaccntctcattaatantcaaaggataanntttcttttcntatgacancncctacnnccacnngtnacncanggcncntcnctcnanacagtaaacccaanncacnntgcncaccanatcacctgtncagaggnttatgcctnagcatatttcttttaagccgaggnnaagttcnntatgccacccctgctttgtaacaaanttatnttaaagtgactggaattatctattccccagatngatcatcttcccctgcaacgngactctgtntcctgcgcggnttccatgctgactagtcccctactgntaatatn

SEQ ID NO: 8023 - DNA, 1035 bp, Homo sapiens
  misc_feature 5, 6, 12, 20, 21, 25, 33, 34, 37, 38, 41, 44, 49, 64, 71,72, 76, 79, 84, 85, 86, 100, 102, 107, 109, 111, 113, 120,129, 132, 138, 154, 160, 171, 172, 175, 183, 194, 200, 204,209, 212, 214, 232, 245, 252, 254, 256, 261, 273, 282: n = A,T,C or G
  misc_feature 292, 293, 294, 301, 306, 308, 309, 320, 326, 332, 333, 338,340, 347, 349, 355, 358, 364, 366, 368, 382, 389, 395, 396,397, 402, 405, 412, 417, 418, 425, 432, 442, 447, 454, 487,499, 500, 506, 525, 526, 528, 530, 536, 538, 541, 550: n = A,T,C or G
  misc_feature 555, 563, 569, 577, 582, 593, 596, 605, 608, 612, 619, 620,622, 638, 639, 645, 655, 659, 663, 673, 674, 677, 687, 702,722, 724, 725, 726, 739, 742, 750, 756, 765, 766, 767, 770,773, 775, 777, 786, 790, 799, 803, 805, 807, 813, 818: n = A,T,C or G
  misc_feature 819, 823, 826, 852, 855, 862, 868, 877, 897, 899, 902, 905,908, 916, 920, 923, 934, 939, 940, 946, 948, 951, 954, 955,962, 966, 972, 978, 979, 985, 989, 1003, 1005, 1009, 1019,1022, 1033, 1034, 1035: n = A,T,C or G
aaaannaaaaantgaggggnnatanatatatanntannaanaanaagangaagggggataaaanagatggnnggcnggngggannnatatgaaagggagnanagaananangnggaattncaatatgantangtaatnataaaaagagaaagtnggaaanaattataaganntantataaaangaaaaaaatantatganaatnaatangtnanaagaaatataaataatanataataaaataanaatgaanananaagangtaaatattagnaatatgaantaaaataatnnnaaaatanaaatnannaaaaaaaatanaatgtnaaaaannaatananggaaatntnaaatanaanaataangnantgataaaatattanatataanaaaaannnaaaanagnaaaaatntaaanntaaaaangagaaantgaaaataanataantaagaanataaataataaaagtataatatgaaaaaaatanataataaagaanntataanaatgaaaagaagatgtaanntnantatatnanatnaaaaaaganaaagngaaaaaanatattnaatataanattanaagatataaanatngatagaaanaantaanatgagannanatagagaagataatannataaanaaagagtaantaanaaanaataaatgannaantaataaatanataaataggtaaaangaaaataaaaataaaaaganannnaagatgaagaagnaangaaaatgnaataanatataaaannnagnatntnanagagataanaagnaaaaaaaanaaanananaaaagnatgannatanaanaaataaaaagtataaatataagaatngangaaagangagtanaatgatagngactaactataaagaatatnanagnaanganatgagaanaatnatngaataggaaanataannattatntnaanatnnaattagntatnaatatnaatgannataaanaaantatatgaaggaaanangaanaataaaaatnaangtaaaaaaaannn

SEQ ID NO: 8024 - DNA, 665 bp, Homo sapiens
cccgatcgaatcggcacgagggaagacacaataattttaaattgcctacagcaggggttggcaaatagtggtgcaagggccacatctggctagcagcctatttttgagaatgaagttttatgagaacccacacatctgtttgtagattgctatggctgcctttgagttacagcagtggagctgagtagctgtgacagagactatatgacctacaaaaactaaaaatattggtcctttacagaaaaagttgtctgacccctggcctactatttcaaatcctgggtaggtcctccacgtcagttcttcatggaactgtattgccgagggaaaggcagtccccacactgtgcagcccttcatgctgtgctcctggctttctctgccatcctgagccgcaggctgtggggcagcgcagcaccagcactgcagctgagcagaagttttgtgcccgcctgcccccatcccctccaggccacgttttagatggcccttgtagttgcgggtcctgggtgtcctcagaactagacatcaatgcctggatccttcagcccggccctgccctcctttaggagacaggagtcaccagggcacagccctccagcccgcctcaggaaggaatgaaaggaatgccatcatctctagttcccagggcccagcctttccctt

SEQ ID NO: 8025 - DNA, 665 bp, Homo sapiens
  misc_feature 2, 4, 208, 209, 213, 219, 225, 228, 229, 233, 237, 240, 243,252, 257, 259, 266, 276, 282, 283, 289, 295, 298, 301, 305,314, 316, 319, 321, 322, 323, 332, 335, 336, 340, 343, 354,356, 362, 364, 365, 370, 379, 387, 390, 398, 399: n = A,T,C or G
  misc_feature 403, 408, 417, 418, 419, 422, 429, 431, 434, 440, 442, 444,447, 450, 457, 461, 470, 472, 473, 483, 488, 492, 496, 509,525, 528, 530, 532, 543, 545, 549, 551, 564, 585, 591, 599,605, 623, 626, 629, 665: n = A,T,C or G
cncnttcgaatcggcacgaggattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttctttctttttttttttttnnaaanggagtntccccntgnnaccnaggntgnagngcaggggcncaatntnggttaantgaaaccttngcctcnngggttnaccccnttntcntgtntaaccctcntnagnannnggaactacnggnnaatnccnccacccccggntnattttngnnttttnagaaaaaanggggtttnacnataggggnnaggntgttntcaaactcnnnacntaagggnanccncctgcntngnccnccnaaagggntagnattacaggngnnacccaccacncccgncccnaaanaaagggtttttgnactttctgaacccctngtncntnagtctgctggnanattnangtggaccttaatnattttttattctgaacccctnttaacntttaatgngaaatntaaaaaattaaaaagtanaanggnttttattgttttgacacctttgaaatttttataaan

SEQ ID NO: 8026 - DNA, 673 bp, Homo sapiens
  misc_feature 4, 6, 7, 11, 609, 673: n = A,T,C or G
cccncnncgantcggcacgagggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaaggcaaaagcctccaatcccatttttcaagttctcctangatgcaccccttaagggagccctggccagagttccgaggcccgtgagcgtcaactgttgctttn

SEQ ID NO: 8027 - DNA, 667 bp, Homo sapiens
  misc_feature 3, 6, 665: n = A,T,C or G
ccnccncctgggaggaataattcaatttgattggcagatatatataatacagtaggagaataatgggagaaagataaattgagactagaataggtagactttaaatgcctgtctggtttaggtatttgaactttcaaggtgtggtaaatgtttgagtaaaggaataatgtgtccaaagattattatggaattgtctctctgcatacctctatcgctgtttgtcacagctgtgttcttatgtgactgattcttcctgaagattagaaactcctcaaagactggttattagagcttattcttcattatagccccagcacttagtgcaatgacagaagcaaaaatattaattgaattgagagaaaattgagatatagagacgagtcatttttgttcacaacagaactagtatttaatgaaatataatggaaaagactgagttgggttactgtttaactgagagcatcagagatggataggcagggaggatttagaactgagagtgaattacagcaatgagggaagcagaaagctggaagttgagagcgtttggcattggggagagtgctgagtgagcagagtttttggaggtagagaaatttataaaactaatcagaatgaacatttcatttgaagtaatagggtaagcctctgaaaattgttcctangt

SEQ ID NO: 8028 - DNA, 708 bp, Homo sapiens
  misc_feature 4, 5, 9, 11, 16, 17, 19, 25, 28, 30, 32, 33, 34, 36, 52,65, 74, 76, 77, 92, 94, 95, 98, 99, 101, 103, 108, 110,116, 117, 123, 124, 126, 129, 136, 137, 140, 146, 159, 160,172, 174, 185, 191, 202, 205, 209, 214, 256, 345, 588, 651: n = A,T,C or G
  misc_feature 677, 696, 705, 708: n = A,T,C or G
cccnntccnantcggnngngcaacnacntngnnngncccccctcctataggngaattcaactcantgcccgatntnnctaatacagtcaggntnntanngngngaacnanaatttnntactannanacntagactnnaantgcggngtctggtttatgnntttgaacttgcncnagagtggtatncgctcncataaaggaanaangtgnccaangattattatggaattgtctctctgcatacctctatcgctgtntgtcacagctgtgttcttatgtgactgattcttcctgaagattagaaactcctcaaagactggttattagagcttattcttcattatanccccagcacttagtgcaatgacagaagcaaaaatattaattgaattgagagaaaattgagatatagagacgagtcatttttgttcacaacagaactagtatttaatgaaatataatggaaaagactgagttgggttactgtttaactgagagcatcagagatggataggcagggaggatttagaactgagagtgaattacagcaatgagggaagcagaaagctggaagtttgagagcgtttgncattggggagagtgctgagtgagccagagttttggaggtagagaaatttataaaactaatcanaatgaacatttcatttgaagtaatanggtaacctctgaaaaattnttcctaggnttn

SEQ ID NO: 8029 - DNA, 641 bp, Homo sapiens
  misc_feature 9, 332, 372, 574, 635: n = A,T,C or G
agagtttangaagaaaggaggatttgaagggggaggattccttggaagaaagaaagttccctatctggcatcatcaccaagtacttccagagtgctgggattacaggcatgagccaccacacccgacacttaaagggcatttcttatttatccttgttttagtcacaccatagtggaatgagtaatcagttttagaagctgcaaatttaccattctctcaaagatgctagtgtaatagggcactttaattatgagtgggctatatgcttattctgtatgtatccttcttagtgagttgagaatattatgtattctaatgctttttttcttanactgaattgggtgactaaatacatttgtactatataattntagtgattttaaaatccagctaactttgcaaacttggtttggaaatcttgttaaccactaatatatacagccatatagataaatggatgtttagttcattagatcttattaactgacaattaactgttttaataggaacaagagtttgttcagaaaccaacagccaagaatttagatggctctctgaaaaagatcatcccancagcagaaggcagaagttagctaatattgagagagagtgcctggaataacaaagcaacagnttcatg

SEQ ID NO: 8030 - DNA, 657 bp, Homo sapiens
  misc_feature 566, 585, 587, 588, 593, 653, 657: n = A,T,C or G
cctaggtggtataatgtgatgtacattacacatgaactatctacactcactaaaagccattatttaagagtaagctcacatagcacacctatttccttggtgttgcaaagcttgaggttgcacagctttctcattttgtagagcaaatgacagttttcatcaacagaccaatggattcacagctaagaataagacaacttgaaaactccacgttttacaaaatcattttctattaaattataaaaacctctgggatccaaactagcaaaaaatgccaattttcaaaaaaaaaattttttagtggaaaatacaaatatgggctctatctaatttttaaaaagctggagctgggcatggtggctcacgcctataatcccagttctttaggaggctgaggtgggaggatcatttgagttcaggagttcaagaccagcctggacaacatagcaagactctgtctcaataaaataaattttaaaagccgggtgccatggctcacacctgtaatccccggcactttgggaagtcaaaggtgggcaggtcactttgagatcaggagtttcaanaccagcctggccaaatatngnngaaanccttgttttttttttgaaaaaaaccaaaaaatttaaccttgggccatggtaaacaaggcncccn

SEQ ID NO: 8031 - DNA, 646 bp, Homo sapiens
  misc_feature 41, 116, 148, 200, 309, 375, 381, 395, 440, 522, 532, 536,557, 569, 571, 592, 596, 644: n = A,T,C or G
tgctgccgcctggtcagtattgggaagcaaggtgaccgcangggggtatgatcatgcagcccacttgttccagggttcaccggggcccccaaccgtttctactgcagccaaaccanataggctactggtggggcaagtccaaggtctncgaccatgccacctgccctgggggctcccctggaaccccggcccctggattnagctctgcagcctcctccgcactcaggatcagccctcctgtcctgccactagcccttttgtccccaggttcagcgatacccaggccacgtgcccaactttctgagccanacccagggctacctgcggagtccacaggaccccctgcgccgggcagccaccgtgcttataggcttncttgtncaccacgccagccncggctgtgtcaaccaggacctgctggactccctgttccaggggcntgaatgaggaacgcgccacttggacacatgaggaaaaagctgcccttgggagctactgatgctgtgacctcacctctctggntttgggcggnaggncccttgcacctaggatgcctngccttggaaaangnccttgcattcgtgggcctccnttanaggcttcttcttaaaagaagcctcttgcgaatgcacagggaagtgtgnca

SEQ ID NO: 8032 - DNA, 654 bp, Homo sapiens
  misc_feature 8, 9, 10, 11, 12, 14, 529, 552, 579, 587, 620, 623, 636, 652: n = A,T,C or G
tttgaagnnnnncnccgcaaatatgccaaattttgtattataattcaatctgtatgacagttatgtgagtttttttttgttttgttttatgcttgtgtgaagatttttgtagttaagctttttttaaaaaaaagtcaactgagttacttacgtgatgaaattagaacacatacttcttacaagcacattctctcctatccccctctccatttcagttggcaccataatgccatttttgcctaaccataacataaattaatatcattttattttatggagtttttctttctgggataataacatttctgctttgttgcataattatcacagacaggtttttctttttttggagatggagtcttgctctgtcacccaggctggagtacagtggcgcgatcttggctcactgcaacctctgcctcccaggttcaagcaattctcctgcttcaacctcccccagtagctggggacacaaggcacctgccatcaagccccagctaatttttaaaaatatttttaagtagagaanggggtttctccatgttggccagnctggtttgggaactcctggacctcaanaaattctncgcacctcaacctccgaaagtgctgggattacnggnggtgaaccacagngcctggccacacacangt

SEQ ID NO: 8033 - DNA, 748 bp, Homo sapiens
  misc_feature 51, 53, 54, 56, 57, 146, 149, 151, 162, 168, 182, 192, 193,208, 209, 221, 223, 225, 231, 240, 243, 244, 259, 263, 274,275, 296, 301, 327, 344, 353, 361, 373, 396, 400, 406, 412,416, 417, 424, 441, 443, 450, 461, 464, 472, 477, 495: n = A,T,C or G
  misc_feature 496, 505, 509, 514, 515, 519, 520, 524, 527, 528, 547, 560,563, 565, 576, 577, 581, 591, 594, 603, 608, 612, 619, 624,628, 652, 658, 661, 663, 676, 677, 682, 689, 693, 701: n = A,T,C or G
cgcctgggaatactcgggaggctaaggcaggagaatcgcttgaacctgacngnntnncggttgcagtgagccgagatcgcgccacttcactccagcctgggcgaaagagcgaaactccatctcaaaaaaaaaaagggaagttgaanaananctgcaaatgtnttgttngggtaactttatgnagggttgtgnncgtaagggccattanntaaccccaggantncntttaangggaaaggnggnnaaggctgttcaaacncagngagtccatgtnnaaaatatgttttgtttccctnattcntttccccatcttttagttactaaaanatgtaactgaactgcanatccttggngaaatatntttcaacaaatntttatttgagggactgattgcanaganccacanactaanatcnntgtcgcnttcctgaaagatgaaangncccattntttgcctatcntcnttaaaggncagcngttgggggacttctgggnntggaccggnattntggcnntccnngttnaanngggggctttttttaaaaanaaaaatttcaccnccntngacctttggannagcnattagggaanggncccatttgnaaatncaanaaaaatnttgcntccnaaaaaaaaaaaaaattttagggancctggnttntnccacttgggggannagggnttttaancccnaatccttngggaactttggggaaaacccaaccttccctttttggcattttaattt

SEQ ID NO: 8034 - DNA, 640 bp, Homo sapiens
  misc_feature 174, 208, 451, 484, 488, 501, 521, 527, 535, 541, 542, 552,562, 575, 576, 579, 581, 595, 611, 637, 639: n = A,T,C or G
ggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggncaactgggccccggggcggaagaagaaagacttntcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggatttcctggggccgggaagtccacctttctcaagaagcacctcgtntcggccggatattgttcaacgtgaacagggtancgtncagtgtgcccganccgcgggcgtcccttgccgntgcttnctcttcancgccanntctggagcangcgccccacnacaaccggttttnnganangacggactcctctnatatccccgtgttcanacatggtcatttatggctacaggaancna

SEQ ID NO: 8035 - DNA, 646 bp, Homo sapiens
  misc_feature 2, 3, 4, 10, 499, 569, 610, 614, 630, 646: n = A,T,C or G
gnnncggccngaatacatttgttcatgatgtcaagtgtctggtatgtagctaatgcttattgaacacatagtaatttattgaataattgtcatgatcactggatgagatatagccactgtggaggtaggcacaccagggttttagaggcttgggatcttgcaacaggattttcctcttgcctctccaaactgccctttgcccagatggcttcagcatctttttgcatccctgtttccttgtttggtgaacacctgtctcaacctgtctgcaaggcgtggtgagattctgcatccttggtaagcactcatgtcactccaaaacagctgtttgatgctaatagcacacatgaggtcttgcaaatttgtctgaggaactacaggacattggagagatatttatcaaacacccactacatgcctgatacttaactaggaactagaaagtgggtggtgaagacaagtggaaagtaaatgcaaacctattcccatatatgtttgncgcttagattgttcccaccaattccctcttggaattgaatgaatggacgtgtgtgtgtgcatgtgtaagnggagtgtgtatgccttgtgtggtattctgagggcaagtcangtanagggaaaggaggccanaagccagaaaaatggn

SEQ ID NO: 8036 - DNA, 704 bp, Homo sapiens
  misc_feature 1, 56, 57, 616, 631, 660, 669, 682, 686, 698, 704: n = A,T,C or G
ncagatgtgcagttgtgttgactctttgtctcccggtgataaacccatgtgatatnncccaaagtagataatcaaaagaattgaccaaaaaatattaaagcaaagcaaagaaacaaaaggtgatactgccagaagtgaaatttgaatggaacataaatggaattacagaggaaatagcaaagagtgggaatgttggcactgctgttgttccagtgactctagatttgctgccagacaaacttagtgaaagcattgtgacataaaggatgaacaagtgacactggcataagattttacagtaaacaaatcctgaagataatttcatgacattgaaggcaccaaggatacagtgtcagaagctgatccttaggaatataacggttcaccatggcatagaaaagatgtatccggccaggtacggtgcctcaagcttctaatcccagcactttgggaggccgaggtgggtggatcatttgaggtcaggagttcagggccagcctggccaacatggtgaaaccctgtctctacttaaaatgtaaaaaattagctgggcagtagtcgcatgcgcctgtagtcccagctctcaggagactgaggcaggaaaaatcgccaagancctgggaaggcggangttgccagtgaaccaaagatcgcaagcanttgcacttncaacctggccganagantgagaaccttgnttcaan

SEQ ID NO: 8037 - DNA, 717 bp, Homo sapiens
  misc_feature 3, 11, 30, 64, 65, 66, 67, 68, 69, 595, 671, 695, 696, 703,715, 717: n = A,T,C or G
ccncgatcgantcggcacgaccacctaaanatcattattttcaatacttaaatattagcccatnnnnnnttatcttcagatgtctataattggaagcctatatagaaatggttgatgagcctatcggttgaaccactgcagagaatagagtgatggtcttagggcatcctgtactttgcatgctcctcctggaagtaaagagtaagacagagaatagtaataatcacccattccagaactggttgcacaacatcacaaaagcttgtccagacttattagcaagttaataaaaaactagacttctttctaagtacttataatttaggctgtggggtagttctgttatgatacatttgttttaaaatattctgcttctttttaaagtgagttgtatgtgtctttgttgtagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcancaaggtgtcaagataaacacttgggaagaagggtcggctttatcctccttttgaataccattaagagaagtttctnttgaaaattgcagaaaaagaatgnngaaagangccttaccaagnan

SEQ ID NO: 8038 - DNA, 714 bp, Homo sapiens
  misc_feature 6, 11, 66, 67, 68, 69, 70, 71, 72, 633: n = A,T,C or G
ccccgntcgantcggcacgaggttggaagttcctaattctttcctcggttaactgtgaaactctgnnnnnnnggaaggcctggcctcagtcatcaggccaggagaggtactggacgccgcgcacgcactcgtctgccagcgaggcccaaaggggaagcctagcggagctcagtgtggcagctgctggcctctgggccggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagcttttcagcaaggcatggatagagtccagtggtctggtgatctacaattggctcancagcttcagccaggaagaagacagaaagaggagatctggaagaatcaagacaggaaattgaagaaattcagagcttgcaga

SEQ ID NO: 8039 - DNA, 718 bp, Homo sapiens
  misc_feature 3, 6, 11, 68, 69, 70, 71, 72, 76, 77, 491, 625, 671, 689,691, 693, 694, 706, 710, 712: n = A,T,C or G
ccncgntcgantcggcacgagccaaaaggcataaagataagtgagggatggagttctggaagttgtgnnnnngggnnagatttactttcaggtattggcaaaaatcacagctggagtgcagattaagcatggtaggagggtggtgattggagaaggaatggaggggaaaaaggaaaaactacaaatcatgttaaaactgtcctcattgagttttacaagtaatatactggtcttatataccctttcctcctaccgtgggaaaatatcactaacttgtaataggattaaatgaggcaatacgtaagctttttagacattttctttatagagaacattattagaagttgttggcctggcgcagtggctcgtgcctgtaatcccagcactttgggaggctgaggcaggcagatcacctgaggtcaggagttcaagaacagcctggccaacatggtgaaaccccttctttactaaaaacacaaaaaaattagtcnggcttggtggcacaagcctgtagtcccagctactcggggaggatgaggcatgagaatcgcttgaacccaggtggcagaggttgcagtgagccaagatcacgccctgcacttcacctgggcaacagaagcgagantccatctaaaaaaaaaaaaaaaaaaaattcggccctttaaaaattntagggagccgttttacgnananncccaaccttganaaananacattg

SEQ ID NO: 8040 - DNA, 715 bp, Homo sapiens
  misc_feature 1, 4, 6, 32, 61, 62, 63, 64, 65, 66, 67, 502, 557, 708, 715: n = A,T,C or G
ntcnantcggcacgagctgattgagaatagtncgagatgacaccacttgggtaaaaggacnnnnnnnaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaanaacttctggcatggatccagtgggcttgagaccaccctcattcagccgggatcangagccaatcccgcagaacatttgacccgagttaaaagcccttatcgcttgagcatcaagacatttatggaggagatgactcgcaaacagcctgacgtggaccgggtcaccaagacatccaaaagggaaaacatagagcctactccgcgccnttcatan

SEQ ID NO: 8041 - DNA, 1006 bp, Homo sapiens
  misc_feature 1, 5, 6, 8, 10, 15, 16, 17, 19, 23, 26, 29, 30, 37, 40, 47,48, 49, 50, 54, 56, 65, 73, 75, 77, 80, 87, 88, 94, 96,100, 101, 108, 119, 123, 124, 126, 129, 132, 134, 143, 146,150, 152, 156, 157, 158, 159, 160, 165, 179, 180, 181: n = A,T,C or G
  misc_feature 183, 184, 186, 196, 201, 202, 215, 216, 223, 236, 241, 275,279, 281, 293, 294, 297, 302, 305, 306, 307, 310, 317, 318,328, 346, 354, 355, 356, 359, 367, 370, 373, 382, 390, 392,396, 400, 402, 405, 418, 422, 431, 435, 444, 450, 454: n = A,T,C or G
  misc_feature 457, 463, 466, 467, 468, 482, 487, 489, 490, 492, 495, 501,519, 520, 523, 527, 528, 532, 533, 535, 537, 539, 542, 566,567, 568, 573, 579, 584, 585, 586, 591, 593, 599, 603, 610,612, 615, 616, 621, 625, 626, 630, 638, 643, 645, 646: n = A,T,C or G
  misc_feature 649, 650, 661, 662, 666, 670, 672, 675, 680, 684, 687, 689,690, 692, 699, 703, 705, 709, 713, 716, 727, 728, 729, 732,743, 745, 750, 759, 776, 787, 791, 794, 798, 823, 826, 828,832, 837, 839, 843, 849, 851, 856, 859, 862, 867, 870: n = A,T,C or G
  misc_feature 873, 876, 880, 886, 890, 900, 901, 902, 911, 917, 924, 926,927, 930, 931, 933, 937, 944, 946, 947, 949, 954, 955, 962,970, 980, 995, 997, 999, 1002, 1004, 1006: n = A,T,C or G
nctannananatacnnntnaatnaantannatatcanttnaaacacnnnnatcnantattatctnatccctananantanaaatttnngggctntnttanntaatcanatcaaagggantatnnanttntanancctaacttntcntcantntctnnnnntgtantacgatttcctcannntnntntgaaaaaacnatttnngccaactgctaanntactcantcgttactgaaancaacnagtgtagcaataaatggctaatagttccattggncgtntnttactcaagcannaantacancannngtnaaaacgnngccaacatangatacctttcttggaacnatttttgnnnctnataaggcnaanagncttgtttcnaataaagntntacncctnanttnattaacttgctanttantatgaacanttcnatatgaatnaaatcnaaanaanaatctnatnnntattgatttcttcngatananncnatnttattncctttaatctattgcctnnaanttcnnctanntntncncanaagctgtccatgaatttatttcannnccacntaattnagggnnncaccnantaagcnttcntgatttnanaannattcnttgnntacnactggttnatttntnnaannaaaaatgttannactntgtntnatnaattnaaanacntnntngctaaanaagngnaacntaanaantcttaaaaaannnttnccacttaaatnanttacnttaataaantctaaattgggaaagtnaataatttcanaaanctnattnttttttaaactatccttatttaatntgnantttnaaaangnattnaacttntnacaanaanaanaaaanctnganctntaancgaatngttnctttttttcnnngataaattntcgaanaaaatantnnaanncnatanttaaaangnnanatagnnaaaactnccataatngttttcctanaaacttaaaaaatantnanttntncn

SEQ ID NO: 8042 - DNA, 701 bp, Homo sapiens
  misc_feature 59, 60, 670, 671, 672, 673, 681, 684, 685, 691, 692, 693,694, 695, 697, 699, 701: n = A,T,C or G
ggtctcgccaaggtgtgattggaaaaattcaaaaaattgcaacctcaggcataaatggnncaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtgaaagacttaaaaaaaagaatcacattgttcagaggtgctcaatggaaagaaaaggaaatgaacaagtttgttaaaaggataaaaaataaaaaaattccatccttggtnnnnaaaaaatnctnncctctnnnnncnancn

SEQ ID NO: 8043 - DNA, 724 bp, Homo sapiens
  misc_feature 34, 35, 36, 37, 38, 39, 530, 543, 549, 567, 574, 589, 595,623, 654, 658, 662, 695, 724: n = A,T,C or G
gacctcgtgatccacctgccgcggcctcccaaannnnnntctcactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatcttacccagaatctggntggaggctgggantttcangattttggttccaggaanttagacngaaggaaccccagangggggncaggcctcaatttaagggttggaaggtngtggggggtaagggaaagccaggaccttggntatnaaanttatttgggaaatcaattgggcctttttaaaanccaagggggttttattgtcacgggggatn

SEQ ID NO: 8044 - DNA, 1000 bp, Homo sapiens
  misc_feature 2, 3, 4, 5, 6, 7, 8, 9, 11, 12, 13, 14, 15, 16, 17, 18, 20,21, 23, 24, 25, 26, 27, 28, 29, 31, 32, 34, 35, 36, 39,40, 41, 42, 44, 45, 49, 51, 54, 56, 58, 61, 64, 66, 67,68, 69, 72, 74, 75, 77, 78, 79, 80, 81, 82, 85, 86, 87,89: n = A,T,C or G
  misc_feature 93, 94, 95, 100, 110, 111, 113, 114, 116, 117, 120, 122,124, 125, 129, 131, 132, 133, 134, 135, 140, 142, 150, 151,152, 161, 164, 168, 170, 176, 178, 184, 190, 196, 198, 210,214, 226, 228, 230, 231, 234, 241, 247, 258, 260, 262: n = A,T,C or G
  misc_feature 282, 298, 312, 315, 317, 322, 329, 337, 342, 345, 357, 360,393, 404, 439, 474, 478, 513, 558, 562, 593, 600, 607, 620,624, 634, 639, 641, 644, 650, 652, 677, 684, 685, 687, 696,700, 722, 742, 748, 752, 753, 755, 757, 768, 783, 835: n = A,T,C or G
  misc_feature 837, 841, 843, 860, 868, 871, 881, 900, 905, 915, 917, 919,920, 922, 940, 949, 951, 957, 969, 974, 980, 986, 987: n = A,T,C or G
annnnnnnntnnnnnnnntnntnnnnnnnannannntannnnanntacnanatnantntanacnannnntananntnnnnnnttnnnanatcnnnataantatggggcannannannttnanannaccntnnnnnggggntntatcattnnntttgaaaanccnatantnaatacntnaggagnaattcncagcangnattgaagaaaangtancaggctgcaccntntnncanatccttncgtgcnatcatctccangnantaattgaaagggccattcangaaacagcaccagggngctacaaatttacnggntncactnggtgatntgatcttntcatncancacaatggacanaangtctaaggaacgtccttgtggattcctttgggntcctgcttctntttacagcctatggaggtcttgcaagagcctgcanagcatccttgtacagctaggagggcctgggtgatnacancgcctcagcaccctctatggaggcatgctcctgtnctccatgttcctcccaccgctcctcatcgaagaggctgggcttgnaaangggaccaatcaatcctcttccaatgtgtggntacgtgngacttcntccgtgggcaaantttnttcgccagcntgggnanaanttttgnantcccaccttcccataacttgcttgnggaactnngngggcctgcncccnactttgtgggtctggcaacagnttgccacattacccttaacngaattnaacnngngnaaaaccacacnattgcctgaaaaaanggccggggaaaaaaccgttggccaaaacaaacaattggatggaaaaccaagntntttntngggcaatctttacttcntcaaaaanatncaaatcaatncccgggtggtgtggggggnaaacntttgaaactnananncnttggtaattttggcccanaattccaancnaaaaanaaaccctttcanaaaanaacaancttcanntatcttgttgggg

SEQ ID NO: 8045 - DNA, 713 bp, Homo sapiens
  misc_feature 3, 12, 66, 67, 68, 69, 70, 71, 72, 76, 596, 597, 598, 599,600, 601, 602, 603, 604, 605, 609, 610, 611, 612, 615, 616,617, 618, 619, 620, 621, 622, 623, 624, 625, 626, 627, 629,630, 631, 632, 633, 634, 636, 637, 638, 639, 640, 641: n = A,T,C or G
  misc_feature 642, 643, 644, 645, 646, 647, 648, 649, 650, 651, 652, 653,654, 655, 656, 657, 658, 659, 660, 661, 662, 663, 664, 665,667, 668, 669, 670, 671, 672, 673, 674, 675, 676, 677, 678,679, 680, 681, 682, 683, 684, 685, 686, 687, 688, 689: n = A,T,C or G
  misc_feature 690, 691, 692, 693, 694, 695, 696, 697, 698, 699, 700, 701,702, 704, 709, 711, 713: n = A,T,C or G
ccncgaatcgtnttactctggaaagtagtagcagcacttcaaggacataggggttgctcatgtcannnnnnnccgnttgtattggaagaatcataataacaaatatttaagttggtaaattactaggtaaacaggttggtggattttttgttatttttgagaatactttttagtttgattctttgaatgaatttacataacagctttcctgtcaagtcagtaatttcacccatctttaaaaaacaagtaccaaaagagtttcttaacaccatatactcctctagcagctgctgcctagtttctctcctccacaacagagctccttaaaagaatgcagttccattttcttttttccattctctcttgaatccactcctccagtgatggatgagattgcaaatgtttgactctgcctatcgtattactcagtctcggcaacatttctttatttagcttctgggataccattctagcctggatgtagtcctatcgttgtgattactccagtcttcgatgctgtttcttcttcttcaccctgacctcgggatgagataacaaattgtaataaagtaacttctctttttaaaaaaaaaaannnnnnnnnnaaannnngannnnnnnnnnnnntnnnnnncnnnnnnnnnnnnnnnnnnnnnnnnnnnnnntnnnnnnnnnnnnnnnnnnnnnnnnnnnnnnnnnnnncncctcncncn

SEQ ID NO: 8046 - DNA, 700 bp, Homo sapiens
  misc_feature 3, 6, 11, 63, 64, 65, 66, 67, 68, 69, 582, 617, 659, 665,672, 674, 676, 677, 678, 680, 682, 695, 699, 700: n = A,T,C or G
ccncgntcgantcggcacgaggcttgattgtggcttgaagtttgaaaggaagtgcctgtttgnnnnnnnaacaccaattggactaacagctgtcctctgtattaaggccatctttagcttgtcttgcaaatactttccttgttcactaatcccttctccccaccctgcttcctttagacccatgttaatctattacctgggagcagctctagattcttgagttggtaatgactaatttctccgttgctctcatcctgttgagtttaataggctctcttttttcttactgatgttttcatgatgagatttctaataagttatttgggagctatcagaatagaaactaataaatattatctatctattagctgtcagaataaaagcttactgagggtcctgaactgtgaggccactgaaggcaggggtttgggtctgatttatctgtgtttgcctagagctttaacagagcctgacacttgtaactcttaaaaatatgctttaaaataaatctaaactcaggcatggtggctcatgccagtgatcccaacactttggaaggctgaggtgggaggaaggcctgancctaggaactcaaggtgagaagtgactatgattgngtcactgcactccacctgggtaacagagtggagaccctgctnttttanaaaaaananannntntnaaaaaaaaccccncccnn

SEQ ID NO: 8047 - DNA, 710 bp, Homo sapiens
  misc_feature 3, 6, 10, 13, 64, 65, 66, 67, 68, 592, 605, 663, 695, 697,710: n = A,T,C or G
ccncgntcgnaancccaaatcaaagtggtgatagtaaatatcattgccttggttctcacctcannnnncccgtttcaccattaagtgtgatatagcttagttttttataaatacttgggagtgaatttttaactgggtcatagaggattgttggatttcagcaagtagaaatcagtggaaattagttctccagacacagggaagagacactagtagtaaaacaaatggtctcctttggctatagattaaagggagatagtggaacacacacatttgtcatgataaccctggctcaaagatagaagattaaaaaaagttatgatggggccaaatcatggagataagacagttgggaataactcttctttcagcgctaggaggagaatggagccaacatcaacagaattagagaagtcatcaagaaaagttagttatgtgaaggaatgcctcttgtggcaattttttaaaaattgcattttatgatttggaactcacccgtcttaaaataattggctcttagaaatgttgtactgctacttagcagaaaattcagggcaaaagggtaaatgtgggtatcatttacatgttggangacattgtatganaagtttgaagaaatgtttggtataaaagataaatttaattctgcttctttggttctgngacaatgggaaatttgtttaatatctttgggncnttcttttcaccan

SEQ ID NO: 8048 - DNA, 764 bp, Homo sapiens
  misc_feature 3, 6, 12, 65, 66, 67, 68, 69, 71, 72, 512, 553, 577, 640,653, 672, 683, 705, 717, 763, 764: n = A,T,C or G
ccncgntcctangtgctataaattcttctgacttgctgtggctaatttattaatttaaaaagtannnnnannctttcttaggcctccttgaatctagtcactctagagatagaatacacaatcttgtcctgatgtttttacttgcaactcacaatcttgtttggtggtttagttgcaggtttcagagattagaccgtatatatctaaatgctgggatcatgcctaatccacaactaaatatcaaagcacttctctttggcctcttttcaagctgaaggcctgctgacccagggtgataagatcactgctgatggacttcaggaggtgtttgagaccgatgtctttggccattttatcctggtaaagaagctgtgggcttaataagctaatatttggtgtgataagttcctgtaaagctctgggcacagggcattattatagttgagcagccagttaactgatttaatctcatgtttgagttttcttggattgcatttgccttgttaattggngaaccatggaaaaacttctgggaagctttcctaagtaaganttttttctttttaataaaatggancttaaataagttttttggaatttaacaggaaattaactggccaaaagaataagtaccaagaanactttttttggtnttgccccctacccccccangtttttccccntaattaattaaaccattttccncattgggtatgnatgccattttggccgaaaataggatggaaatccaatttcttgcttnn

SEQ ID NO: 8049 - DNA, 736 bp, Homo sapiens
  misc_feature 3, 6, 64, 66, 67, 68, 69, 70, 71, 72, 349, 570, 588, 598,599, 602, 624, 628, 644, 647, 665, 666, 667, 669, 671, 674,675, 676, 680, 681, 684, 688, 689, 693, 695, 697, 699, 700,709, 712, 713, 716, 719, 735, 736: n = A,T,C or G
ccncgntcccccccgcgtctcccgggagcgtcgccgccacctgcacgcgtctggcacacaaacntnnnnnnntccccttagtttctggaagagaaaaaggaaaagccaccgagaggcctgaccctgaggggtcggggggagatgcgggcgcgtagtagagggaagcgactgaggagcggggactgggcagcatttgaatggatgcgggtgccgctggcacccgggaagacgcctgggagccggcgctggggagccgggcatgggctgggatgtgtttggattccaatctgggcctgacaccagttcagtgacctcgggaagttccccaaccctgcgggcctgtttcctncctctgaagtggcgacagtaatagaaccgacctcgtaggctcatcgggaggtcctgatgggagaacccatgcaacttgccaccacagagccaggcccgcggcgactggctcctggtgggtattaaagacgagtcgggaaagaagagcaggctcaatcaaaccttcaattggccccgaaagacattttgattgaaaacctcattgaaaaacttttgagccanaaaacccaaccaactttnaaaaccccannatnccttgaccattcagccacttgngtgnaaaaaaataaaaatgnttngttggttttaaccttggnnnananggnnntcgnnacntttnnaaanantntnnaaaaaaatnttnnganaanatttttcttctttttnn

SEQ ID NO: 8050 - DNA, 698 bp, Homo sapiens
  misc_feature 9, 54, 55, 56, 623, 633, 642, 644, 645, 654, 663, 693, 695,698: n = A,T,C or G
gaagcttancaccttgatgcctgacaatagaaactatccaaaataaggcacagnnngaaagtggaaaaaaaggcaaaaaggaaaacagagcacagataatgtgagacaaggtcagatagtctttatgtatgtgtaattggagtccccaggagatgtgagaggaaaaagagttgaaacaatcatagacaaaatatttccacgtttgatgaaaactatattagttgtgtattgctacctaacaagttattccaaaaatttagtggcttaaacaaaacatccattatctcccagtttctctgcgtggctcagctgggccctctggttcagggactcttcacacggctgcaatcaaggtatcagctgaggctgcagtgatctcagggcttgactgagggagactgctttcaggctcactcgtggttattggcaggatttagttccttgtgggttgttggcctgacggcctcggcttcttcattggctgttggccagaggctgcccacaattctggatcacataggcttctccgtagggcagctcacaacatggcaagctaacttcattagaatgaacaagcaagaagcgccaaaaaaaaaaaaaaaaaaaactcccccctttaaaanatataggggngtccttttncnnaaatccccncttgaaaanaaccccttgggggaatttgggacacccccntnttn

SEQ ID NO: 8051 - DNA, 708 bp, Homo sapiens
  misc_feature 8, 9, 11, 359, 513, 533, 534, 561, 570, 585, 586, 597, 614,646, 651, 663, 664, 674, 676, 678, 688, 697, 703, 707: n = A,T,C or G
gtagcacnncnacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagatcaatattgaactgtacagattgtttggcataaagcaaattgtaatttctcacacctctggaactgttaacccaacggaaaggtcacctaacacaantcaaagcatttctctccaaacactgtgctgaccacccaacaattggggatggatcacctatcagctggttcatttgccttcaaatggtaactcacttgggaacctacttaaaaaataccaccatatttttccaaaatggtttaagtccgaaaancccttatatggcctggaganntttaagaatagtctttcaatgaaagtnggaatgggnggataaataaccaanntattggttttngccaaaaaatttctaanaaggccaatttaaaaggaaacctggataaaantaatngggaaaaataannaacaaccttncncntggggcccanaatgggaanaacaancaant

SEQ ID NO: 8052 - DNA, 707 bp, Homo sapiens
  misc_feature 3, 4, 19, 67, 69, 70, 71, 72, 496, 691: n = A,T,C or G
ccnncgtatcgccctgcanattcttcttggacatcattaatggagattccactgctgtggcattaancnnnnccaagactttaaagccacagagatcatagagccttccaagcaggataagccactcatagaaaaattagcggagatttatgtcaactcctccttctacaaagagacaaaagctgaattacatcaactttccgggggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgngtttatgatgattttttcaggtctggtggtcaatctcacaaccattgcatcttggctgcatggcttcagtacttcagcattccacgatatggatttaccggctttgcagcataatgaatttttgggacaaaacttctgcccaggactcaatgcacaggaaacaatccttgtaactatgcacatgtactggcgaanaatatttggtaaacag

SEQ ID NO: 8053 - DNA, 697 bp, Homo sapiens
  misc_feature 511, 512, 523, 531, 537, 557, 560, 568, 571, 572, 595, 621,630, 642, 674, 681: n = A,T,C or G
gagaaagttgtgcaactgaaaatcctttcaaacaacagctacaaaagagattggtcagttaggacaggaatagaaagtggaaacttagaagactggctactccttgtgtatgattgctggggtgagtctgtgctgagaactttttacaaagggtgtcctttgctgatatgagaggggggtgtcaaacttttgagtgatcactgtgggtcctcagcttagacatcttctctggcccaagatggcaccccttgctctctttccatgggacacagggaccttgccatccttccatcttataagccttctgtcatgatttttacttcatcctagataaccttaatttgggccaggtctccaggttcctccactttcttctgtcccatccatacccctcaccaatcctctgtaaattccttttccaggattttactggagaaccaacagaagaaaacaggctggggaataaacaaacatgggggaggttattgtaagttaaacatacacttttgannatccccctagnccattttncttgantaattataagaaataaaccnctnggtaattnacnngggttaataaagggtcccatggnagaaaagccttttaattccttttttntgggaaaanccaaagaaaaanccaccctgccccttccctttaagtccttaaanggggggngaaaacttttatgggg

SEQ ID NO: 8054 - DNA, 1101 bp, Homo sapiens
  misc_feature 8, 14, 15, 20, 25, 30, 31, 40, 46, 47, 52, 58, 66, 67, 68,70, 73, 84, 89, 91, 92, 100, 124, 126, 129, 136, 139, 142,151, 169, 170, 173, 174, 178, 182, 186, 187, 188, 195, 199,201, 205, 208, 214, 216, 221, 223, 232, 233, 241, 242: n = A,T,C or G
  misc_feature 246, 249, 251, 252, 253, 256, 257, 258, 259, 262, 265, 267,268, 270, 286, 288, 290, 291, 292, 298, 302, 303, 305, 309,315, 316, 322, 323, 326, 327, 332, 333, 336, 340, 342, 358,362, 372, 373, 394, 397, 400, 401, 405, 410, 415, 418: n = A,T,C or G
  misc_feature 419, 421, 422, 425, 426, 430, 433, 434, 437, 438, 447, 448,451, 460, 462, 464, 467, 471, 476, 479, 481, 484, 487, 499,502, 503, 508, 509, 513, 514, 520, 524, 528, 529, 530, 537,539, 540, 542, 544, 549, 553, 575, 579, 585, 589, 596: n = A,T,C or G
  misc_feature 599, 602, 606, 611, 614, 619, 643, 646, 663, 673, 676, 679,681, 686, 687, 692, 695, 704, 706, 710, 728, 736, 738, 743,745, 750, 755, 757, 763, 766, 773, 777, 782, 790, 792, 795,797, 801, 807, 811, 812, 817, 819, 820, 827, 829, 830: n = A,T,C or G
  misc_feature 832, 836, 847, 852, 862, 863, 867, 871, 872, 879, 880, 886,887, 899, 901, 906, 910, 913, 916, 921, 923, 931, 932, 933,939, 944, 953, 954, 965, 967, 971, 972, 976, 979, 985, 991,993, 997, 1001, 1005, 1006, 1019, 1022, 1023, 1025: n = A,T,C or G
  misc_feature 1030, 1032, 1038, 1040, 1047, 1051, 1052, 1053, 1058, 1064,1066, 1070, 1077, 1081, 1085, 1086, 1089, 1090, 1099: n = A,T,C or G
ttttggantttggnnggctncgtgnaaacnnttggaaaanccccgnnctttntggaanggcacatnnngnaanaattggagggnccggnanncctttttnattctccgtttttaccccccctgngnccnaaggtanttnaangggaccctntttcaagatcgagccttnnctnntttncccngaannnccccaangagnantcangtnggcaananggttntnccacacacnnactggtcnngcgngtnannngcnnnncancananngnccttagcccctatccncngnnncccctncttnntncacnaccgcnncacttnnganntcccnntcnggcngngcacacacagtgaaangganaactagtgannacagccccaggtgcccttacntangannagantgaanattantcnncnntanncaanaannaannctctgggannggngctgaaacntnanacncganccggngtntnganatngcccagaagaanggnntcccnnaacnngcaacnacanaaannnaatggangnncntntcacnctantaaataggaaaatggcctattngctnttgggncccnctgatcnagnaantggnaactnaancccanctctctggaacggggaaaaaaaanctntctcgtaaaagggagantccccatganacnatntntctgnnaagcnttntcgacaacntnaggngtagattagtacaagacngggagatngnctctntncatgnaacancntggggnaanccatgtncctntcctnggtgaacnanagngngggntagccnctanntcagnannggtcgcncnncncaancgggggctccnaatgncatgtgggtnncgcntaanngtcgggnnataatnnctacactatacntngtganatantcntcnctagntncagcttcnnntacganccatnactcaaaanngccgctccccntncacnnctangantaaganggtatncnaganatcnatanntctgactgggatncgnntntcatngnatcttntnagtaggnaggnnnctatnatatcngntacnaatcccngatntctnncanntatggagancg

SEQ ID NO: 8055 - DNA, 596 bp, Homo sapiens
  misc_feature 3, 13, 91, 143, 145, 147, 158, 159, 167, 173, 178, 179, 180,182, 187, 188, 189, 191, 202, 218, 228, 231, 397, 414, 417,426, 469, 488, 491, 498, 500, 503, 507, 564, 566, 567, 572,574, 577, 578, 596: n = A,T,C or G
acntattggaacncttgttctttttgcaggatcccatccgattcgcatgtggtgcacaggtcggatggtaaatttcagatctttgcctatntagggaaagttcctgtggttgtgagttacagacctgccaggggagtcctgcngncngttaccctgtnnttggtggnctgctnttccnnntntttgnnngntggggggcgtnccccctttgtgggggnatgatgtctnttnagatggctggctggctacaccgtgcacatttctgtctaagtgccttaagagaggatcgccaatccacatgcttttcagggaaatctgtgtgatagagaactggtacaggctttttgtgacgctcctctcattatgacacgtggtaaatcttgaaccatgagacagncattctgaaggagtgtntancaacgaggngcaaacttgccaacgacacataatgtgctgttccaccccatgncagcctgtcaagatgtgtnaancaacatncntgngtgngattctgaaaaagacttacctgactttgactgcaacttgctaccacggtctgactgntnnacctntnagnntttgacatggagaggggn

SEQ ID NO: 8056 - DNA, 777 bp, Homo sapiens
  misc_feature 1, 3, 4, 8, 42, 707, 776, 777: n = A,T,C or G
nanncctnttacaaactattgttctttttgcaggatcccatncgattcgaattcggcacgaggtcactttactctccatccggaccgcttcctttctcgccgcgaggctcggggttggggggggaccagattggagccgcgggctaactgggatccgtcccatttccctgggcttgacgttctctgaatttttagctaatgtggaaagttacatttatttgcatttgtttatcgcttgctcacataggtctgtgtcccgaagcttggcagatgagcgaacttagccagcacacccccggccgtgaagcagggaggtgaagcggggagagcaacgagccccacccgggtcttgccagctggacgttcttgtggggcagcgttgagcagcggttaggagtgccgtggactttggattcaaacagccccagctcttctgcttgctagctgggtgactttgggcaaattaacatctcgaaaatctgtttcctcattcctaaaatgcgggtctgaaagtgatcatgcctgtaaagccatctcatatccatggttctagaagcatggtgagcacctcaatttgaataatcagtgccatgctttagctacctcttgactcactcgtttgtggcaggaaatgttcccaaattaatcagaagaattcaatgactaagaggatgtaatagtatatagcgcaggcactggaatcaacntctgctgtgtgatcttggacaagctgcttctgttccgtttctcttatctggggcaatacctgtctgaann

SEQ ID NO: 8057 - DNA, 1016 bp, Homo sapiens
  misc_feature 3, 4, 5, 6, 7, 8, 9, 16, 17, 18, 19, 20, 21, 22, 23, 24,28, 29, 35, 37, 38, 44, 53, 79, 80, 83, 110, 115, 125, 135,150, 158, 168, 200, 210, 232, 247, 272, 285, 291, 292, 294,303, 306, 308, 309, 314, 346, 360, 375, 379, 388, 390: n = A,T,C or G
  misc_feature 391, 401, 402, 404, 410, 413, 414, 416, 421, 422, 425, 426,427, 428, 429, 431, 432, 447, 448, 449, 450, 487, 554, 583,637, 721, 747, 801, 854, 863, 866, 920, 997: n = A,T,C or G
ggnnnnnnnttttttnnnnnnnnncgcnntttaananntggggnaaaaaaaancccccttttttggcccaagaaacttnnccnctgggttttctttttttttgggcccanggggnaaaccccccnatccggggantttccggaaaatttncggggccnaccggaaggnaaacccatgggaaccttcccactgggttaagnccctttgggnactttttctttgggggggcctnccaggggcgggaatncccttcccccaaccctttcaaggcncttccctgggccnttaggnntnggggggggnttncnnggggncttgggtgggcccacccaacaaccctggggcntaaattttttgggnttttttttttttttngggnggggaggananngggttttgcnngngttggnccnngnttggnnttnnnnntnntggggttgggggggnnnnaattaacccgcaggctctcaaagtgctgggattacanggcatgagcccctgcacttggccgacattcaatttttatgaataaaaactacattggaaactaaggnggtatggtttaaaatgtgtcagcatttgnagaacgatttaccctttcaaaaggggagagcagggataattttactttttttgntttaaacaatctaatactggtagtaacttttaaaaaaatattcttaatagattggctactattgcaggggtattatttgtatgnctggctatattcattcagttaatcanggagctgaaattatgggaggtactatgtggagggagcagggcatttttctgacnaaatgctttatgggtggaatacatttatgaaagtaagttaatggttcttctgnccaaaatanggnagaagttcaaacccatattttggagtctcgcatcaagaaataaggggatggagnggccactggggaatataatgcagaaatgggcttaaggaaaaaagaagaagggggaatgaaatggtaagtttggcctngaggcttatacactatggg

SEQ ID NO: 8058 - DNA, 1259 bp, Homo sapiens
  misc_feature 2, 7, 9, 10, 11, 12, 13, 14, 15, 17, 18, 19, 20, 21, 34,45, 52, 74, 86, 90, 91, 98, 99, 110, 118, 121, 122, 137,142, 150, 159, 168, 189, 192, 193, 194, 196, 198, 199, 213,221, 230, 233, 243, 253, 260, 264, 275, 278, 279, 290, 306: n = A,T,C or G
  misc_feature 308, 313, 317, 318, 321, 323, 334, 336, 341, 343, 345, 357,361, 375, 377, 384, 387, 388, 396, 400, 403, 404, 405, 410,416, 419, 422, 433, 435, 436, 444, 451, 452, 456, 458, 467,469, 473, 476, 478, 479, 483, 491, 492, 493, 513, 514: n = A,T,C or G
  misc_feature 523, 525, 536, 537, 538, 540, 542, 544, 547, 549, 550, 570,575, 576, 578, 581, 582, 607, 617, 630, 635, 644, 645, 646,648, 656, 663, 664, 666, 667, 668, 677, 684, 687, 688, 689,693, 698, 705, 708, 719, 720, 725, 737, 748, 764, 770: n = A,T,C or G
  misc_feature 776, 785, 824, 833, 846, 856, 859, 862, 864, 865, 868, 873,881, 913, 915, 917, 922, 929, 930, 938, 949, 955, 959, 972,986, 988, 991, 997, 1005, 1009, 1024, 1026, 1047, 1049,1069, 1079, 1081, 1086, 1090, 1094, 1102, 1108, 1113, 1118: n = A,T,C or G
  misc_feature 1147, 1156, 1159, 1165, 1178, 1181, 1187, 1193, 1194, 1195,1204, 1214, 1222, 1223, 1226, 1227, 1235, 1236, 1237, 1257: n = A,T,C or G
anggggngnnnnnnncnnnnnttttttttttggnaaaaaaaaaanccccccnttttttttggggaaaaaaaaanaaaaaacccccnccgnncccttgnngggtttttttntttgtttnatnngggggaaaaaggcgncccanaatccccngcaaatttncccccacanatttcttccggggggtttaanccnnngngnnggggggggggaaanaaactttngggtgttgnggnctttttcaanaaaaaaaccnccggggngttnttttttgttgngtnnccccccccttncaaaagggggaacgcncnaaaanctgnnggngnggggaaaaaancncgatngngngcgccccccggnttgnttttcccccaatanangggggcncannaaaaaccncaangcnnnggggnaaaccntcnacncaattggccgngnnaattggtnctggggnngttntntgggggcgnanaacnagngnnttantttttttnnnccaaaaaaaatttccccaanngccaacctncnctttgggaacnnntnantnttnanncaacttctttgggtggaaanctttnnanaannggttccggggagggacatttggggnaaatggaatnttaccagccttgnaacancattttctnnntntgggccantctttcnntnnnccaaaaccncccaatnctnnncganttttnaaaaccntgntgggcaaatcnncagtngaaaaggaaccntaggttcggantattaccaccttcaangttttnaaaatncccaaaatnaaccccatttccttgggggttaaattaaatcccaagggnccaggaatntttttactttttngccaaccggnaantcnanntantttcnagccaggncttcttttaacttatttaacccttcccaaggncnangggangcctggnnggtggttnctgggactttntttttnaacnaaagggccttgtngccccccctggatngnttnttattnccgggaanccangggttaattaaaaancngaaattggattaaaaaatggntnggtctccttttgggcttggnaaattgcccnancaccncaangggnggggccantttttnttggntcaantttcccttcaagagaaaaatttggacctnccaaaaacnagncgtttnaaatttttttgcnaangaaacnaaaaannnccattgaangcctttgggnctcctacnnacnnactaccannntggggaaggttacccttttngg

SEQ ID NO: 8059 - DNA, 1088 bp, Homo sapiens
  misc_feature 2, 12, 16, 27, 29, 31, 32, 33, 44, 50, 53, 56, 57, 58, 60,74, 75, 80, 82, 84, 87, 89, 90, 93, 95, 96, 97, 98, 99,100, 101, 105, 119, 123, 126, 129, 130, 131, 134, 141, 143,146, 157, 158, 160, 164, 166, 180, 181, 185, 188, 200, 204: n = A,T,C or G
  misc_feature 207, 209, 212, 216, 220, 224, 226, 227, 229, 247, 256, 258,275, 291, 293, 294, 296, 303, 313, 314, 319, 322, 324, 337,338, 340, 358, 360, 361, 362, 371, 373, 383, 387, 390, 391,397, 406, 407, 408, 411, 413, 415, 419, 420, 424, 428: n = A,T,C or G
  misc_feature 433, 434, 440, 441, 449, 451, 465, 468, 475, 476, 479, 481,492, 495, 498, 500, 503, 506, 507, 513, 516, 519, 521, 525,530, 534, 537, 548, 551, 552, 553, 554, 555, 556, 558, 559,561, 565, 578, 579, 584, 585, 593, 601, 603, 604, 621: n = A,T,C or G
  misc_feature 622, 627, 630, 636, 638, 641, 642, 651, 659, 664, 671, 672,675, 681, 686, 690, 703, 704, 708, 710, 716, 724, 738, 742,756, 759, 762, 764, 765, 778, 783, 790, 802, 813, 815, 817,831, 837, 844, 851, 871, 873, 874, 875, 885, 886, 890: n = A,T,C or G
  misc_feature 901, 902, 906, 907, 910, 913, 920, 923, 949, 953, 970, 981,987, 994, 996, 1013, 1022, 1023, 1024, 1030, 1041, 1042,1051, 1053, 1061, 1063, 1065, 1083: n = A,T,C or G
gngcacgaaaangganacgaggggcgngngnnnagaaggagggngggaangcngcnnngnggaggggaggaggnnggggngncngangnngcnannnnnnngagntggaaccgtaagcnaacncgngcnnntgnaggaggncnccnaacgcgccccnngncggnanggaggggccaagcnnaaanacntaggaaggtttntttngtncncanaaangaanggcngnngnaaagggggggggtgtatngccccaaancntaagggagaaggccttnaggaaaggggagagangnngncaatgancaagaaaggnnccgcnccnanaagcccgagggannanagggggggaaaaaaagantnnnggacagggnangacagggggnaaanaannaaaggngaggaaaannnccnancntggnnggcnttcnaagannggtggnnacccgtangnctggaaggggcctncanacttggnnggncntcccaactggnaangcnanggnaannccaccngtnccnanaaanaaccngganggncgggtggcccnaannnnnncnngncagnggagagccacaannctaannggggaacnaagggaananntcggcactgtctgtggnnggganggnggaaantnccnntgggacagngggagggnccccncaattcnnaanagggcnggggnccanaaaaaaaaaggtnnggcntnggagancaacaaantgggccatcaccancccngggaaagaccccanccnagncnnggggaaaggcacnaaagnaaggganggaatgccctanggagggcccangnangtacccaaaaactnaggccngggggcnaataatngagggggagaacccccccanannncttccaagtnnaagnaaaaaaagaannggcnntcnaantcccaanganggggcgaccagagaaaatttggcccnagancttcaccggagaaacancgggggaaaancggggntgcgggnanaaagaagttaaaaaacnaacaggggnnnggggcncggggggggannacaccatanantgccgggncnanaaggggagggcaagggcnagggg

SEQ ID NO: 8060 - DNA, 762 bp, Homo sapiens
  misc_feature 45, 49, 54, 55, 86, 88, 95, 100, 102, 103, 104, 105, 106,121, 123, 126, 136, 147, 149, 160, 163, 165, 166, 171, 172,178, 182, 190, 202, 206, 214, 215, 218, 241, 246, 257, 307,311, 327, 328, 329, 330, 332, 348, 349, 413, 531, 598: n = A,T,C or G
  misc_feature 622, 626, 632, 676, 691, 721, 723, 738, 739, 745, 749, 751,756, 758: n = A,T,C or G
attctatcctttaactcttgtctttttgcaggatccctcgattcnattngggcnngggatgcccgggccttttggggggccttttngnccttttngttanannnnncccgggggggggggnantgnagggttcctnggggggccctntntcctttctaanttntnntgaannccttgnaaangccaaaantcacagggttanaaangacttggnntgntttgcggcccagtccacccaacntgccnttttttttganaaacagttgaagcctttaacaaactcttgcttgaaggcagaaagtccacntgtnttcccccaaccatggnnnncncccattgttgatgccnnttgtgacgttattggagcgccagcttgtgatttttgaaggaaccgacatgttgggaaaaaaccnaccagaagctgtgaaaattcatgctgaaccttttggcaacagcgccgattcatggccgaggcttgcagacacttaccggattgaatgctgagaggatcctggcaggttttcaacccanatgaagaaatgaattgaaaatctgcaagaattgaattcaaaatgcgattgctattggggcagcaaanggtgccccaagttcaattcagacnagangagatnttgagaaaattcaacccggatttttaactggcccttttcccgtnaaattgggaaccttncttcttgttaaagcaaggccagaagctttnantaacttttccaaaannaaaccntttnanaaatntntttt

SEQ ID NO: 8061 - DNA, 714 bp, Homo sapiens
  misc_feature 1, 3, 4, 7, 9, 64, 65, 66, 67, 68, 73, 74, 599, 601, 602,610, 611, 615, 616, 617, 618, 622, 625, 626, 627, 631, 632,633, 637, 644, 648, 649, 651, 659, 661, 680, 681, 684, 692,693, 711, 712, 713, 714: n = A,T,C or G
ncnntcnantcggcgcggtgagtggtgagactgccttgggcgggttaccgggcatgactcttcnnnnnccccnnagacccccccttccccccgaactcctccagcccgcagagttctatctccaggtggaccgcttcagcctgctgcccacggagcagccccggctacgggtgcctggttggtaagtgatgcctccgcccaggagccctgctctgtctgggtgagcatagcccctctgcagctggagggtagaacaaggaagcctgaggtagagctgggagggagcatgggtagccttggatggggttggggtccttgttagctcttccccagacaccatacccctttcaggaacccccaaagaggcatcgtgatggttctgccttccagtatgagtatgagccaccctgcacgtccctctgtgctcgggtccaagctgccaggcttcctccccagctcatggcctgggccttgcactttctgatggatgcacagccagggtctgagccaactccgatgtgagacgtcacgcaggacagataccgctccacactctgctttctttgagtttttttaataaaaataatctcatgcggccnannaaaaaatnnaaannnntttnatnnnaaannnaaanccctttnaaanntnaggggggngnttttttccgtcaccccccnnatntaaaaaanncttttggggggtgtgggnnnn

SEQ ID NO: 8062 - DNA, 691 bp, Homo sapiens
  misc_feature 49, 50, 51, 52, 53, 512, 671: n = A,T,C or G
gaggctccagacagctcttctgtctttcaccaggtccaaacaccagcannnnnctcccatgaaatatcccctttattccatctcaaatccttacctatcaactccttgcccagagaacctggaataacatatttacttctagtccttttcaatgcattttccccttgggagaggtgagggggtggtgtgtgtgtgtacatgaaagaaaatcagacagattgaccatctttgacggtaactcaaagggataaatagatatagttaaccgataaaaaaacaacaggtgaaaccatgatatttcatgtcttgaccagattataagcactcttaggataaaagcaaggtgataacccactttgttcatggtgtattgaagtatctttcttagtggacactcccatttcaccccctctcatcacctgttctgaaatacatgctgggaagttgacaaacaagattctggtaatttggagaagacagcggttcaaataaaggagaaaatttctctgtanttctgggaaaactgaaaatattcagtagataagccaaatgttcaatttcatgttgctcttatagttataggtattctaagaaacccatattaatccatcagaaaattcaacatcaagtttatcaacctgtttaattaatcaaccttatcattcaatggnacatcacctgagatagtaaa

SEQ ID NO: 8063 - DNA, 972 bp, Homo sapiens
  misc_feature 2, 3, 7, 8, 10, 12, 13, 15, 18, 19, 22, 23, 24, 26, 27, 29,31, 32, 33, 34, 37, 38, 39, 40, 41, 42, 43, 44, 45, 46,47, 50, 51, 52, 53, 57, 59, 60, 61, 62, 65, 67, 70, 71,73, 74, 79, 80, 81, 83, 87, 88, 90, 91, 95, 96, 98, 99,101: n = A,T,C or G
  misc_feature 103, 104, 115, 118, 119, 120, 123, 126, 128, 131, 134, 135,142, 147, 148, 149, 160, 163, 173, 175, 180, 181, 185, 189,192, 193, 195, 200, 201, 203, 204, 207, 208, 210, 212, 216,232, 234, 236, 237, 241, 245, 247, 248, 249, 256, 258: n = A,T,C or G
  misc_feature 259, 261, 266, 268, 270, 272, 274, 283, 285, 305, 306, 308,336, 347, 348, 362, 367, 374, 385, 386, 389, 394, 409, 412,421, 433, 435, 436, 453, 455, 457, 459, 484, 493, 497, 499,505, 512, 520, 524, 545, 587, 591, 597, 602, 603, 605: n = A,T,C or G
  misc_feature 611, 622, 623, 627, 629, 638, 648, 651, 653, 654, 656, 660,667, 689, 691, 694, 698, 704, 707, 711, 713, 714, 718, 722,728, 731, 746, 749, 750, 757, 764, 767, 768, 771, 776, 780,797, 799, 800, 802, 809, 813, 827, 828, 830, 832, 838: n = A,T,C or G
  misc_feature 839, 841, 855, 857, 859, 865, 870, 878, 881, 887, 889, 895,905, 909, 911, 913, 922, 928, 930, 931, 932, 934, 945, 946,962, 963, 965, 968, 971, 972: n = A,T,C or G
tnnacgnnantnntnatnncannnanntntnnnnatnnnnnnnnnnntannnntgtnannnntantntanntnnatctnnntnatcnntnnattnnanncntnntctcactatancannnggnggntnatntanntatatanaaacnnntattggggaanttntctctttatnantcccnnctcnaaantcnnangaccnnanntannantntgtntaacaactacataggnancnnactnacgngnnncaatccntnnanatcangncngncncaccactgncncttgtacaacctttgcagtnntncccggtatgtggtatgtggtctccgccnatgattgggcnnctggtcaggctggnatatncaaatancacccattggnnatntgctngacccctggaggggnaanccaggaaangaaactcacggncnnttgtgatcatatgttcntncnanttgggaagactaatcttggatatgnccaaatatntccnangattcntctgtcnaaattatncctngggatctgacccatttcctgnaaaaggggcgagcctgggttttgaagttcaaactagagtttnaatncacatnatttnncnctaatnccactgtaacnnctgngnaccttcatnctctgaagcnttnanntncttngttgtgnaaagcctgctaactactcgatnantantggnacatanaangccncnnggangagntttttnctntgagtcagctttggnttnntgaacanctttcanttnngcnattcncctnaaacgtttatggcgctnannantttcatnaaanttatatgggccaanncncnagtggnntnacaaccttgtaatncncnaatcanttatngtgaaggnccnaaaacngncttgantcaaacttgngggntngnaaactttgnaaaaantnnntntaacctaactnntgagtaaacccttttnntnttnatnn

SEQ ID NO: 8064 - DNA, 685 bp, Homo sapiens
  misc_feature 342, 405, 457, 466, 468, 488, 500, 513, 529, 560, 567, 574,581, 589, 592, 597, 598, 604, 629, 658, 660, 661, 662, 665,666, 672, 673, 674, 675, 683: n = A,T,C or G
gtggctcgcgcctgtaatcccagcactttggtaggctgaggccaggagtttgagaccagcctgggcaacatggtgaaaccctgtccttacaaaaaagttaaaaattagccgggatgtgataccttgtgcctgtggtcccagctacgtgggaagctgcggtggaaggattgcttgagcctgggagatcgaagcttcagtgaaccgtaattgcaccactcccttccaggctggaggacagagcaagaccccgtctctgaaaataaaaaagggcctgctttaggtggctcacacttctaatctcaacactttgggaggctaagcaagaaaactgcttgaacgcangagttcacgatcagcctgggcaacatagtgagaccccatctccacaaaaattaaaaaatcagnctggcatggtggcccacgcctgtatgaggtgaggtgggaggattgactgaancccagggangnttgaggctatatgtgaaccntgttcacaccanttgcactttccanccttgggcaaacaganccgaagaacctgtcttgaaaacaaaaaaaanaaagcanttcccgntgggaanggaaattngcnttcannaaaagnaaaagaccgtcggggaagaatccanatgggtttggtaaaagaaaaaaatgtggncnnncanngttacnnnnaaacctangg

SEQ ID NO: 8065 - DNA, 1376 bp, Homo sapiens
  misc_feature 3, 6, 10, 16, 22, 30, 33, 37, 40, 47, 52, 55, 56, 57, 59,65, 69, 75, 89, 95, 103, 109, 121, 123, 127, 135, 136, 140,143, 150, 151, 162, 174, 180, 182, 184, 201, 206, 220, 226,238, 244, 251, 253, 257, 258, 259, 261, 264, 267, 269: n = A,T,C or G
  misc_feature 272, 275, 276, 284, 285, 304, 307, 313, 320, 330, 333, 334,337, 339, 341, 346, 353, 354, 361, 362, 373, 374, 383, 391,393, 408, 411, 417, 418, 421, 422, 431, 439, 440, 441, 451,459, 461, 463, 466, 468, 469, 470, 471, 474, 483, 492: n = A,T,C or G
  misc_feature 494, 495, 503, 516, 518, 519, 526, 530, 532, 538, 543, 545,548, 549, 553, 555, 557, 564, 572, 578, 580, 582, 583, 585,590, 594, 599, 607, 608, 612, 614, 619, 621, 636, 645, 646,647, 652, 657, 660, 661, 666, 668, 676, 677, 678, 679: n = A,T,C or G
  misc_feature 680, 684, 687, 690, 694, 696, 701, 703, 705, 709, 721, 724,734, 745, 748, 750, 752, 757, 759, 767, 770, 771, 777, 783,788, 794, 803, 812, 821, 832, 839, 853, 861, 865, 875, 883,896, 910, 912, 922, 937, 944, 951, 954, 958, 964, 969: n = A,T,C or G
  misc_feature 977, 982, 1001, 1002, 1008, 1009, 1041, 1048, 1052, 1054,1076, 1078, 1084, 1094, 1096, 1117, 1128, 1142, 1148, 1150,1164, 1166, 1169, 1174, 1177, 1184, 1191, 1199, 1201, 1202,1231, 1235, 1237, 1262, 1264, 1273, 1274, 1287, 1291: n = A,T,C or G
  misc_feature 1313, 1315, 1328, 1330, 1340, 1344, 1354, 1355, 1362, 1369,1375: n = A,T,C or G
acnacnaccnaaatcntctaanaacttacnaanatcnttnaaatctntacanaannnantttatntaanttctanatcattaacactanattacnaaatttcnaaaacnctctctctatananaatnattttaanntttntanttccaanngggggtattcnaccatctaaatntctaantnantatcatattcggggggncaaanaaataattatcttnactaanacacacctatanttatanaaatctntnacannncnatnacncntanacnntcataacnnattctatatacatatacantanctaatntaatacntacattaatnatnnttncncnttacnttcaaanntatttannactttaaatanncatcatcantactcacncnttctactcattctanacnatctannccnnctttaaatnatttattnnncttaccattntatataantntnttnannnnatntattaatanctatttatntnnacaaaaanaatctctatttanannttaaatnattngntattanacttnantcnnaaancncnttttttntatttaanctaacncnanncncttcntatncattnataatatnnatcnanctctntncacaatataaatatncttttacannntattnatatntannttatnantttaatcnnnnntctntcnttntacnantcacnananactncattcttaactntancactattatntattatcaatntanantnctcananatacaatnatnnttattnacatanctaantaaatnataacaaantcatatatnttatatctncatcttaaaancccctantactctatataatncttgtctncatntatactttantctcatcnctcataatgcaanatctctatattatntntatatatacntctaccctactatangcttacnatattcntantatntatttntatantacttaantctangtacatatctctatatacnncctatnnatatatactctcatcaattactcatcttactntatatcncatntntataaaaaactcacatattacncncttccnctatatatananatatatcctcgtctatcatanatatctattanctacctttaccttncatatnancctctcatctctcncnctntaacntanatcatcngccatanttttatantnnaaaaactaaatacactattcaaatttatnattnanactacttatatactattacctactntnaacactttnnacacctctacatntatntaaattcaatataccctatacnantatatacttatcncntcaacttatntttntctactattnntcacttncaaacantttttnc

SEQ ID NO: 8066 - DNA, 618 bp, Homo sapiens
  misc_feature 3, 4, 5, 6, 7, 8, 450, 514, 519, 522, 526, 527, 529, 530,531, 532, 533, 534, 535, 536, 537, 538, 539, 540, 541, 542,543, 544, 545, 546, 547, 550, 551, 552, 558, 559, 560, 561,562, 563, 564, 565, 566, 567, 568, 569, 570, 571, 572: n = A,T,C or G
  misc_feature 573, 574, 575, 576, 577, 580, 581, 582, 583, 584, 585, 608,615, 618: n = A,T,C or G
agnnnnnnaatatttgaaaagagtaattggtttggaaggagacaaaatcctcaccactagtccatcagatttctttaaaagccatagttatactatagtgataaaaacctgtgctacacatccatttctcagcaacggctcctaggataatcaatcatggcatactgctaatgccttgattgcagctgatatggaggaaatatgtttactcttttgctaaagtgaagttcactgcggaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgnctccttttcatgtgaatttattactcccgttgaaaccgtgtacttaccaataaactatttgctnttccnaanaaannannnnnnnnnnnnnnnnnnnaannnaaaaannnnnnnnnnnnnnnnnnnnggnnnnnnccccccccccccccttaaaaaanggggggngtn

SEQ ID NO: 8067 - DNA, 796 bp, Homo sapiens
  misc_feature 1, 15, 18, 30, 55, 56, 62, 74, 81, 92, 103, 105, 113, 114,129, 137, 149, 163, 164, 166, 170, 172, 177, 178, 179, 182,184, 190, 217, 219, 294, 297, 302, 303, 314, 318, 322, 444,475, 532, 554, 578, 580, 583, 584, 596, 619, 656, 684: n = A,T,C or G
  misc_feature 701, 706, 720, 726, 742, 744, 770, 772, 794: n = A,T,C or G
ntgttcgaattctgnacnaagaattcaagncagcacgtatgtagcagatgatganntctaanctggatgatacntaatgangtcagatttgnaatctaacttngnggctgtgnntagggtgcaaggagnacttccangacctatactcnaggcgccctgggtnnantaangnaaacnnnctncntaaggntggcccccacgtggggaggtggagttncngaattattctgtgcgctaccggccgggcctagacctgtgctgagagactgagtctgcatgtgcaccggtggcaanaanggggnngatcgtggccncacntggngctgcaagtcttccatgacccttttgcttgttccgcatcctggaggcggcaaaagggtgaaatccgcattgatggcctcaatgtggcagacattcgggcctccattgacctgcgctcctcanctgaccattcatcccgcaggacccccatccntgtttctcggggggaccccttgccgccattgaaaccttggaaccccttttggcagcnttcttcagaagggaaggaacanttttgggtgggggctttttgggancnttnntcccccaccctngccaccaaccgtttttgttgaangccttccccaaaccccgggcaaaggcccctggggatncttttcccaaaatggccttcaaaaaaangggcccgggggggaagnaaatnctttcaaaccgttngggggncccaaaaaaggccaancnttccgtgggtggcccttgggcccccnanacccctttgttttccccaaaanaa

SEQ ID NO: 8068 - DNA, 681 bp, Homo sapiens
  misc_feature 31, 34, 35, 36, 37, 41, 670: n = A,T,C or G
ttatcgaataagacacgagggaggatgttgncannnnctantcgggaggctgacgcaggagaatcgcttgaacctgggaggcagaggttgcagtgagctgagaccatgccactgtactccagcctgggcaatagagcgagattctgtctcccaaaaaaacaaaaaacaacaacaaaacttgctaccacccagggattttctgctatttaaaaggtgaatttcttttctggtactaaactgtagctgcttaacttagtaaaggctgtgtttggccaggcctgtgccagaggctcacctggagtgctccacccactggcaggcaagtcctattcctattcacccaggatccccaaggctgggctgggatataaatgttgggataggaaagaaatatttcctttttagaggaaagcaagaagaaacattgcctgaaaggtgattttctagtcatttccaattagtacagaaatgttactgcctctgggtgcagtggttcacgcctgtaatcccagcactgtgggcggatcacttgagcccaggagttttgagaaccaacctgggccaagatggcgagaccccatctttcaaaaaaaatttaaaaattacctggggcattgggggcacacacctttattctcaacttcttcaggtggctgaggtgggaaggatncctttgaccct

SEQ ID NO: 8069 - DNA, 666 bp, Homo sapiens
  misc_feature 600: n = A,T,C or G
tttcattcgcacgaggcagactccggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaacagcagtgtgaggaactggtaactgggactgtgagaacattctctttgaagggaatgactaccaagctctttggtcaagaaactccagagcagagagaaccagaataaaggtgctagaagaacaaataaatgaaggagaacaacagctaaagtctaaaaatctggangcagagaatttgtgaaaaacgcatgggctgatattgaacgcttcaaagaacaaaagaacccgagac

SEQ ID NO: 8070 - DNA, 671 bp, Homo sapiens
  misc_feature 8, 527, 608, 655, 671: n = A,T,C or G
tttcgatncgcacgaggttctcccttatctgatgctcactgtggccttgggcagcctggcatcgagaattctcagcatgttcactcttgagttctgtgcctgcatcacacagcaatggaacagtcccaaaagattcttaagggtggggaaaggcactaagaaaagatgaacctgcagtccctgttataccatctggtctaattgatactactgttgtcaagcaaaaggagctctctccctgaggcactggaagccaatattttgacaccaggtttttgagaaagaaaagttttttattgtaagttgactcacaagatgagtcaagctcaaatctgtctccctgtgctggttttaaggcagtaatttaattataaaacgtttaggaggtggattctggggttctcaggtgataggtagaaggaaaggagaggtctggaaagtcttcaggcatgcacagttctcttcatgtctcctcatgcatcatgcgcacatttagtgggagtttgaaacatggtgaggaaattcangctgtgacatcagcatgcttggtctgtgcaaactccatttggccatattggtttcaaccaattttggccagttttgtaganggagttttgagcatttcaagaaagttatttcttatctgctggtctgnaaatcataatctttgn

SEQ ID NO: 8071 - DNA, 668 bp, Homo sapiens
  misc_feature 1, 3, 11, 462, 561, 596, 610, 615, 639, 660, 663, 667: n = A,T,C or G
ntncgaatcgnacgaggtattaaataagatgtctttaaacagaaacacacatatatgtattgattgattaatgaggctctcaggaacctgactctgtgtttcccctaggagcagtgtttcagtattcactaatcgagtgttcatggtgactttatagaaccactgcaaatagtgagaattaactatacatatatgtttctgtgtgtacgcacatgtgtgtgtatgcatacttgtctctaaacatatgggattatactctgctgctgttttgctctttatgtcattatgtatactatataagtatatttttacattataatatgtgctatatattaataaatttttttaaatgtattaatatctgctcttactgagagagttttcagcctgctgaatagtcagttttacagtactagctaaaccttcttttcttttttttttgagatggagtctcactctgtnttccaggctggagtgcagtggtgtgatcttggctcactgcagcctccgcctcccgagttcaaacaattctcctgcctcagcctccctacagctgggatnacaggcgcgtgccaccacgcccagctaatttttgnacttttagtaaaanatggngtttcaccatgttggccaggctgntcttgaactcctgaccttggnganccanc

SEQ ID NO: 8072 - DNA, 834 bp, Homo sapiens
  misc_feature 5, 6, 7, 11, 12, 13, 15, 16, 29, 34, 36, 40, 43, 48, 53,54, 58, 61, 63, 68, 73, 75, 76, 78, 80, 83, 87, 89, 90,91, 96, 97, 101, 114, 119, 123, 133, 134, 137, 138, 143,150, 173, 183, 185, 187, 190, 193, 205, 214, 216, 229, 233,281: n = A,T,C or G
  misc_feature 720, 722, 731, 777, 784, 789, 801, 809, 811: n = A,T,C or G
ccctnnncgtnnntnncttatcgctaaantggtngntctnttnacccnattgnnaatnagncntttcntttcncnntncnccntctncnnnatatnnatgnctgtcgtgtcttnataantatnttataatacnnaannttgtntcgttgnctcttgaccatgacttccctgcncgttcagctntntnctntgntgaaatgggaanagacgctcncnacaagtcaataanagangctatggtgaaatgtaaaaattcacaattctactttgtttcactgagngcccaatcaacgattcatacagttgagatgaatgtgacaaaactctttatagataaatatatatgcctaagtttatctatatatatatgtctttgtgtgtatatacatacacagatatatgcaaagacataaataatcttccttacaaaacatcaatagatcattttcacagggaataagagagtacacacatagcctcctatgttggctctgagacatctaaaaagcaagacagagagcattaatcttccattcaaaaatatatccctatagaaaactttttgcagtatattgtctcttggttcaatatatagcctagtcaaaacttatttatattggctattaaaatggcaaaggttttttgtttttttttcccttccctacaaatcgagttgacattttatcagcatatcaaaagcctgtttaaggttaatatttngnctaaagcanttaaattaaaaaaagcagcccaaacccatggagacttaaagatttncaatgtntttancctcttggattnagcacatncnatagagggacttgttgggctttg

SEQ ID NO: 8073 - DNA, 1366 bp, Homo sapiens
  misc_feature 34, 45, 48, 53, 59, 63, 74, 92, 106, 119, 125, 128, 129,135, 136, 138, 145, 151, 165, 174, 175, 176, 178, 182, 183,185, 194, 195, 202, 203, 204, 237, 238, 245, 250, 256, 257,276, 277, 293, 294, 297, 302, 308, 317, 320, 323, 324: n = A,T,C or G
  misc_feature 326, 327, 332, 336, 341, 343, 346, 347, 349, 352, 354, 356,365, 373, 376, 381, 388, 391, 393, 396, 401, 403, 409, 413,416, 421, 424, 425, 431, 434, 439, 441, 460, 469, 470, 481,484, 487, 488, 492, 494, 495, 496, 498, 501, 503, 508: n = A,T,C or G
  misc_feature 521, 525, 527, 529, 532, 533, 540, 541, 548, 550, 560, 561,563, 566, 568, 575, 579, 581, 582, 583, 586, 587, 588, 594,598, 599, 609, 611, 616, 620, 625, 631, 633, 634, 635, 636,643, 645, 654, 660, 661, 676, 677, 678, 682, 683, 687: n = A,T,C or G
  misc_feature 690, 706, 708, 715, 720, 723, 730, 733, 735, 746, 748, 753,755, 757, 759, 764, 768, 772, 773, 774, 781, 792, 803, 806,808, 814, 817, 821, 829, 837, 842, 843, 844, 846, 853, 856,868, 873, 878, 883, 893, 894, 904, 905, 911, 926, 927: n = A,T,C or G
  misc_feature 944, 945, 948, 950, 951, 953, 955, 960, 963, 966, 967, 973,976, 979, 981, 984, 987, 991, 993, 994, 997, 998, 999, 1007,1009, 1010, 1011, 1016, 1018, 1019, 1021, 1022, 1032, 1035,1036, 1037, 1039, 1040, 1041, 1042, 1044, 1048, 1058: n = A,T,C or G
  misc_feature 1064, 1068, 1073, 1074, 1078, 1080, 1084, 1085, 1094, 1098,1101, 1102, 1107, 1110, 1116, 1117, 1118, 1125, 1126, 1131,1135, 1139, 1142, 1145, 1146, 1147, 1152, 1156, 1157, 1158,1160, 1167, 1168, 1170, 1171, 1172, 1175, 1177, 1178: n = A,T,C or G
atttactgattttcggaaaaattttcccggtttngggctttggtnacngaacntttggntctntgggcccaaanattaagcccccccaattnctttttgcggcgcnactttgcttggcnaccttntgnnaagagnncncggaaancgaatnttcacatcaagagntatattatnnntnaaanntntaatctatnngttatannntatgatataaatggggggggggtgatatttttnnaagatgnagtgntcatannatactgctctatgagtttnntaatatatatcgatannaanatatntgatgntatataaangcnatnntnnactanaaanatacnanacnntngtnanantatttgtantagcgaanttnatganttagttnacngncgnatttntncatatntcgnctnatatnaannacatanatntcatntnaacattcgttactatgatngtatatatnnttgtaagactnatntanntganannntnccnanttctntagtttgtgatanattnantntanngatctanntcgtttntntatacatagnnanacnancgtgaangacnannntannntacgantacnntaattatatnantatcngatntatcnttgacntnnnnatatacncnatcgaacanagtatnnagtatatatctcaannnttannattntangacagtgtaaccgctntnacaactntaacnctngtacatnatntntttaaatcttngntggtntntnanaactntctnatannntacgcancatactgagtntatgtgtaatntantntacttnctngtanatgataanatagtatnaccannnanaatcttncanattaatctctcnatgtngatanacgcntatactcggnntgcgcgtatnnataacnactacttataacgcnnacattatatattcgaanntcncnnananataantancannctcgtntcnctntnaantanattngnnatnnncaatacanannnggagncnnannaattatgacnaannntnnnncnagtngtaatagtcnatactncttntaatnntacncnaacnncgattattnaacntanngttanttnatacannnaaaaaannttccntaanctanaanagnnnaaaanctgnnncngaatatnnannnatnannnannaannntntgntaanaantnnatataanttnactnatannnnannaanatnganatnaaatgacnnctgannnaattgatagtcatatatctanannntgtantgaatnaantgtaatacnngnatgatnnggcnanaactnnantannannnnanagcngagananatncngnataantnccng

SEQ ID NO: 8074 - DNA, 1369 bp, Homo sapiens
  misc_feature 1, 8, 14, 22, 46, 47, 53, 61, 66, 72, 80, 86, 98, 104, 119,121, 144, 163, 164, 168, 172, 176, 192, 200, 212, 213, 214,216, 218, 223, 229, 231, 236, 252, 261, 262, 264, 269, 286,287, 292, 309, 312, 315, 317, 320, 324, 330, 343, 345: n = A,T,C or G
  misc_feature 349, 350, 353, 358, 364, 368, 373, 382, 385, 392, 393, 394,396, 398, 405, 413, 423, 427, 429, 430, 439, 442, 445, 446,447, 453, 454, 457, 461, 466, 469, 471, 474, 475, 480, 481,485, 491, 492, 493, 499, 506, 508, 511, 515, 522, 526: n = A,T,C or G
  misc_feature 533, 536, 537, 541, 543, 547, 553, 554, 555, 570, 575, 576,584, 590, 595, 596, 608, 611, 615, 616, 622, 623, 629, 631,641, 644, 647, 653, 655, 656, 659, 663, 668, 674, 681, 683,691, 695, 698, 710, 711, 713, 715, 717, 720, 721, 726: n = A,T,C or G
  misc_feature 737, 738, 744, 753, 755, 757, 768, 773, 778, 782, 784, 788,793, 800, 801, 804, 805, 811, 822, 838, 841, 842, 847, 849,857, 861, 866, 867, 868, 870, 877, 878, 882, 885, 887, 899,905, 911, 913, 916, 921, 931, 937, 948, 950, 955, 961: n = A,T,C or G
  misc_feature 976, 987, 988, 994, 995, 1026, 1027, 1031, 1042, 1048, 1053,1064, 1065, 1066, 1067, 1081, 1086, 1087, 1088, 1104, 1105,1109, 1114, 1118, 1121, 1124, 1126, 1134, 1137, 1143, 1149,1151, 1153, 1155, 1159, 1160, 1165, 1182, 1186, 1191: n = A,T,C or G
  misc_feature 1196, 1198, 1204, 1205, 1211, 1213, 1230, 1236, 1239, 1243,1247, 1249, 1254, 1262, 1263, 1266, 1273, 1277, 1279, 1281,1289, 1293, 1296, 1297, 1305, 1315, 1328, 1332, 1333, 1334,1340, 1341, 1348, 1351, 1352, 1365, 1366: n = A,T,C or G
ncgagganatattncggcccgnggtccgaggcccgatggtgggggnnttgggnggtccttnttggnttgggngaattggncccggnggacaccctccncatccncccaattaaccggantncccccaaatcttaccaattgggnggaaaagaccccccccaanngganttcnactnaaaaaaatatcgctantgctcagncaaatccactgnnnananagatnaagcgngnataanatcacctcatttctgnggggggggnncnctatntagtgtgaaaacacatnncttcncatcagtacccactcancantanancantgtngacaancaagacgtcgaantnatanngtnaaaanaaatcnaaanaaaantaaaaaccnaanctcaccnnnanantggtaanaatctatnatataccatnctcntnntattatatnatntannnatctannaanatcnacccntanantannctganntatnaaaatnnnaatatncaattananggnaaangcattanattnaatatcncannatananaatnataacnnngctaaaaatctatcngacannatgtctanaatctnattanncttaaaactagntcncatnntacatnntctcantntgtactatanganatnatagtnannatnacanccttnatacancaaatanantatctaantaantanaccaataataannantntncannatgcncaaatatacgnncagagnacatcttanantncttatccattnttcanatcanacananaccntatcnactatcnncannctctanaccacacatantacgtctataaacacnatnncacantntattcaanatcnctgtnnnanatttatnnacanacntnttttcatatacnctaatngaatanancanaaatntaatgtaatntatatnaacaaacagancncgtanagatcncactactttcagtgntttaaagcttnnatatannatcagataaatacgctcatcactataatatnnaaanaaaatatcacncacgtntatancaataaacttnnnnattcaaaatatcgnacgcnnntcttctctattatatnnaaancatancatntantananactatatntancaatantcatanantntnatanngatanatatagcaatacatgtnaacnagcanatcgngnaatatnncaacantncaatatataatatattncaatcnatnagtnaacnantattnaacgcaannaanatagaantaancnantaacgatncaanaanngtgtattnataaaaattnctatatataaacntagnnnccctannatgcctnctnntacactaccatcnnacg

SEQ ID NO: 8075 - DNA, 1382 bp, Homo sapiens
  misc_feature 1, 4, 5, 45, 51, 52, 65, 80, 85, 104, 109, 111, 115, 119,130, 156, 160, 168, 176, 177, 180, 189, 194, 199, 207, 209,214, 222, 224, 225, 226, 233, 238, 243, 252, 253, 259, 260,264, 268, 270, 271, 275, 279, 280, 281, 285, 290, 307: n = A,T,C or G
  misc_feature 314, 316, 318, 323, 324, 326, 328, 333, 335, 336, 338, 339,345, 348, 351, 352, 353, 354, 356, 359, 360, 361, 362, 367,369, 375, 380, 382, 387, 393, 398, 407, 410, 414, 422, 423,426, 428, 433, 436, 439, 446, 448, 449, 450, 457, 462: n = A,T,C or G
  misc_feature 466, 468, 469, 471, 472, 474, 479, 480, 487, 488, 489, 490,494, 497, 499, 500, 504, 505, 509, 512, 513, 519, 521, 522,526, 532, 533, 534, 536, 547, 548, 549, 550, 551, 552, 553,558, 559, 561, 562, 565, 569, 570, 572, 575, 578, 581: n = A,T,C or G
  misc_feature 583, 585, 586, 588, 591, 596, 598, 600, 602, 613, 618, 620,621, 625, 627, 629, 632, 637, 643, 647, 653, 654, 657, 658,667, 674, 678, 680, 688, 689, 690, 691, 696, 698, 699, 708,716, 718, 721, 729, 731, 733, 745, 752, 756, 763, 767: n = A,T,C or G
  misc_feature 769, 770, 775, 776, 787, 788, 790, 792, 797, 802, 803, 804,805, 817, 819, 821, 832, 833, 841, 842, 851, 853, 855, 856,878, 880, 881, 882, 883, 886, 889, 891, 896, 898, 900, 904,906, 921, 922, 923, 924, 927, 934, 941, 947, 951, 953: n = A,T,C or G
  misc_feature 958, 961, 968, 970, 974, 977, 980, 982, 984, 986, 987, 989,990, 992, 998, 999, 1000, 1001, 1009, 1013, 1014, 1016,1028, 1032, 1047, 1055, 1056, 1062, 1065, 1067, 1071, 1074,1081, 1088, 1090, 1091, 1094, 1096, 1101, 1103, 1110, 1114: n = A,T,C or G
nttnnttcgctcccctaaatcccattccccacccttgtttaaggnaaatcnnctcatttttcatnctttttccccaggtnctttnagatgtgccacaaatcacnccacntntggntctntacttaatcgngaaaaactatcttcctgtcaaacgtntatncccggggnggggcggnnatnttttccacnacatnacatntactatgnanatcanccgctcanannnccacgtntcaanatgcnctgtaactnngctctnncgcnctancnncacncctnnncacnatcgncacatcgccactcgaanctctagncncnccctnncncntcgcnanntnncgtccncgntcnnnnancgnnnncctcncnattcgngcganantcttncccccnctttnctccgtatnacngccncgtcgcannagnanccgtnccncgntgacctnannntctccangcagntccncnncnntntggcnntgtcccnnnncganccngnntcgnnatcntanntcattncnncccntagctnnncncgccttcgtgnnnnnnncgctnncnntcnattnncnatnacnccntncnncntcnttatncntntncatgcctcacncgctncnnctcncncntcntcgtnatcacncgtncactcnngannctcaccgcnactcggngctnanaccagcgnnnncgttncnnatacgcatnctcctccntnacnatcatccncncncccttcgcgctngcacgtnccgncatcttncacngnnctcanntcatgcgtctnnananactcnccgcnnnntcccgcctctcntncntcatctctcannaatgcgcnntgcatctcncncnnctcctctgatcgccacagtctnannnntcngantntcgtncntntatncnattgcgtcgcatacnnnncanagtcgcncacactncgcacnactncnctctnctntccacgncngctncanatncncncnntnnanctgctnnnntcttatcntacnncncgcactccatcncacncgttcgtcacgtctncaatctanncctccnccncntccnacncacaccncgtctcngnntcncntcacncngcactcncacnncgncnnnatcacgcncnatcgccatntccgtanacanccncntcncangnttncgtctctncntcctncgccnggntaccnctatncnncatacnntnaactnctntnccaccanncanncccncgntctcctngcnnatcanctnctntgtgcnccgnnncncntcccncnctnntcattncanncnctacctgccgnanttcggcaaatntttcnnntncaccaaantgctcgcatcgacnncgcancccacncngcnntatccg

SEQ ID NO: 8076 - DNA, 1431 bp, Homo sapiens
  misc_feature 1, 2, 3, 5, 8, 10, 16, 22, 23, 33, 36, 38, 52, 54, 58, 60,61, 64, 68, 71, 79, 81, 83, 84, 90, 92, 94, 99, 102, 107,113, 127, 132, 142, 145, 148, 157, 164, 177, 179, 182, 192,193, 197, 202, 208, 216, 217, 223, 225, 232, 233, 235: n = A,T,C or G
  misc_feature 239, 240, 251, 252, 255, 264, 269, 275, 276, 287, 288, 294,295, 298, 300, 302, 305, 307, 315, 329, 331, 333, 334, 336,340, 341, 342, 343, 346, 351, 354, 358, 359, 360, 366, 367,374, 377, 386, 388, 390, 392, 396, 398, 406, 414, 419: n = A,T,C or G
  misc_feature 421, 422, 428, 433, 434, 438, 439, 442, 443, 444, 445, 455,456, 458, 472, 476, 479, 481, 484, 496, 504, 511, 513, 516,517, 523, 527, 536, 550, 557, 566, 577, 580, 590, 595, 599,601, 606, 609, 613, 615, 617, 627, 637, 640, 641, 644: n = A,T,C or G
  misc_feature 648, 649, 653, 655, 658, 664, 665, 669, 671, 683, 688, 690,695, 698, 703, 704, 708, 710, 716, 718, 722, 724, 732, 733,734, 735, 736, 738, 740, 746, 750, 754, 755, 760, 762, 768,776, 793, 805, 809, 817, 832, 850, 854, 856, 858, 859: n = A,T,C or G
  misc_feature 865, 867, 871, 876, 878, 879, 880, 882, 889, 897, 900, 902,907, 911, 927, 928, 931, 932, 940, 950, 952, 954, 969, 975,982, 992, 996, 998, 999, 1003, 1004, 1013, 1014, 1015, 1017,1024, 1031, 1040, 1042, 1045, 1047, 1051, 1054, 1056: n = A,T,C or G
  misc_feature 1060, 1065, 1070, 1075, 1083, 1087, 1095, 1102, 1111, 1120,1125, 1126, 1132, 1134, 1135, 1137, 1138, 1143, 1144, 1148,1154, 1156, 1157, 1158, 1163, 1166, 1171, 1174, 1179, 1185,1187, 1188, 1191, 1210, 1211, 1223, 1238, 1239, 1251: n = A,T,C or G
nnntnccnangcacanaaactnnactcaaacantancntctactcataatantntacngnntantaanacnccctcatnanannatttanantnttcantcnatatntgcaantcatatcttataanatacncaaaagtttnaancanggggagaanagctcanaagcccccttcantnatnataatatgcnnatanctttnaccaantatatatnnctctanancaactcnntnttcnnataaggggggnnttntaaaactcncttgntcgcanncccatgacctnnttatcnnttngncnacnancctataanactctaaaactcancntnncnatannnnttntatanatncatnnnatatanntatctanctncgatatctngncntncagntnatctaaanatatctcncacancnnctaccnagtannatanntannnntacataacgnntntctatctaccttcntatngancncanatatatcctaantatgctantatcacnantannatacanacancgaaatcgntactcctctcactnactacanatatatacngctcatcatcntancctttatacnataanaacntntatancanacgnanancacacacacntaacacacanctnnttntacnnatcncnccnaatatnntgtncncttgtcactacncgtanantcatntanactcnntacngntcacgncntaananacatatcnnnnncncncactcnacanatanntattntncgaatncactctcnacacaacacacatcacngctcatatattnacantatcactncatatattacactanaacactattcacatctcnaatncncnnaaatancngacntcatntnnncnaactacnctacactntantntattnttcnagtactacacacaacnnagnncaccactnatacacatcncncngttcatgaaatatancgatanatatcanagataacatnactnanntccnntatatctgnnnantcaaatnattaatntccaaacgncnctntntaanttntnacangactnctctntattntatattantatncatccccnactctantaactacantctacgacnactannattccntnntnnctatnnattnctatcncnnnctcanaanatatnagnctatnatatcncnnctnacattactttctacttcanntatccatctaanactactatatactannttctttacttcnncnnncatncntncnacttanaacnncttcataatactgtatcattanccacagnnaantnatctcnatgattncntcnatctntatatttannagtntannnnatttannctnnncanctgcancgacctaattatnnttcanacttaattnctaganataactctgtacatcnantcg

SEQ ID NO: 8077 - DNA, 692 bp, Homo sapiens
  misc_feature 19, 21, 581, 596, 599, 607, 645, 660, 683, 690: n = A,T,C or G
tttcaattcggacgagccnanatggtgacactgcactccagcctggctgatagagcgagactccatctataaaaagtaaaaaagaaagtcttcagtgaaaggagattcgccctatcagctatgaaagcacagaggggaggaacatggagtaggggctgcctgcagtcagatcctgccctcacaaccttgccagggaaacaggctcgtgggtacaaaggttgtgtgcctcaacttcctcatggaagcacgtgagattattttataaccatagagtggagacagtcagtatgaccaccaaacccaggagccatatattaaaatactgataaatttaactatataaaaaaatttttacaggtgtgcaccactatgcccggctaatttttgtatttttggaagaaacgtggttttactatattggccaggctggtctcgaactcccgacctcaagtgatccgcccaccttggcctcccaaagtgctggcattgcaggctgagccacggtgcccagcctgaacaccctttcctggtaaaacactccaaaaccaggaaaagaaggaatgtacagcaacaaaataaanggccagtcatgcaanggncccatggnttgaaaagtctttcaagtcattttaaggtggaaaaganttgaaaatcttttgncttccaagaatcaaggaaataangaaaaangg

SEQ ID NO: 8078 - DNA, 1397 bp, Homo sapiens
  misc_feature 22, 28, 29, 32, 47, 48, 56, 64, 65, 78, 80, 102, 108, 112,117, 130, 137, 146, 158, 159, 174, 180, 182, 184, 200, 205,207, 213, 214, 217, 219, 224, 239, 250, 254, 256, 257, 259,265, 269, 270, 272, 277, 284, 289, 290, 298, 300, 306: n = A,T,C or G
  misc_feature 308, 311, 312, 313, 316, 318, 329, 331, 336, 337, 338, 344,345, 349, 350, 352, 354, 356, 362, 363, 366, 373, 374, 376,387, 390, 392, 393, 397, 407, 409, 424, 428, 430, 432, 440,441, 442, 445, 448, 449, 450, 451, 456, 457, 459, 463: n = A,T,C or G
  misc_feature 466, 469, 473, 477, 480, 485, 489, 490, 496, 498, 500, 507,509, 516, 520, 525, 526, 542, 567, 570, 573, 576, 577, 582,585, 586, 588, 591, 593, 594, 596, 602, 607, 611, 612, 613,619, 622, 623, 626, 627, 631, 635, 636, 637, 638, 644: n = A,T,C or G
  misc_feature 648, 649, 659, 660, 662, 664, 667, 672, 674, 675, 676, 678,682, 686, 698, 701, 707, 713, 715, 716, 720, 724, 737, 739,741, 748, 750, 756, 763, 765, 770, 775, 777, 780, 784, 785,789, 791, 792, 793, 800, 806, 812, 818, 823, 824, 825: n = A,T,C or G
  misc_feature 828, 829, 834, 836, 838, 839, 843, 847, 849, 852, 853, 857,861, 867, 871, 872, 878, 886, 887, 888, 890, 897, 900, 907,910, 915, 916, 918, 919, 920, 921, 923, 929, 938, 939, 940,945, 946, 953, 958, 961, 972, 975, 984, 991, 1008: n = A,T,C or G
  misc_feature 1009, 1011, 1012, 1014, 1029, 1032, 1033, 1035, 1039, 1040,1043, 1045, 1048, 1049, 1050, 1052, 1055, 1059, 1067, 1068,1075, 1081, 1084, 1086, 1091, 1093, 1097, 1106, 1108, 1109,1110, 1112, 1118, 1123, 1127, 1137, 1139, 1143, 1145: n = A,T,C or G
agagcttttttcggaaaatctnccgggnnggncgggaaggggactannaagggccntccggtannttaagggaaccgncncaggtttttccctttgggaatngggggnaagnccctnggttaaaaaaggnccccacnccccaaccnaaaaacaccaanntttctttaaaccccnccaatntntntacctttgtttatctngggananaccttnncangnggggnggggactttgttttntctttatagtnacgngnnantcccancatnncncaatnttttttntttannctctcatnancgtcangnatnnncanantatatctgtgncntaagnnncatatnncgcnntnangnagtatnntanaggctgnncncatagttgttnctngnntcgnttaagtcttntnatcgtctcagaccantagntntntcatattnnngtntannnntgacnntncttnaanatncagnctcnttntttgngtannctttcngnantttgtantnatctatntggngatcnncgaaataacttgtatntatagcatatcgtaaaactttattnaanctnttnnttaantannanctntnnanttaaanctgtntacnnnttaatngtnnttnnacangaannnncattanttgnnatcgcttgtnntnanccnatgtntnnncnttantttntttctacctttnctnatttcnactctntnnactnttgntgtttcatatacnancnatgtgcnanatctantgatctntncgcantattntntantagnntaangnnncttgtanttaatncatctntcactnttatnnntgnntatcnancnngttntacntntcnntgtntacnctgacnatanngtcaanacatctcnnntncgagcanatncggagtngtnctacnncnnnngnatatcnctatcatcnnncacgnncactatngatanatnctgatatatcngcnagcaatcanacatacncgtagatctcttgtatnnanncngacagagtctgtgantcnnantgcnnacncnttnnntnatnttantcacacgnntgcactnactatntgntnatttntnaatnttacatcgncnnntncatttnctcgntacnaatatactcncngtcntncaaaattctcacgagttangattgcacnctatctctannncgttnncgtctcagnntacgngatctttnangantcntannnttncagtnttnctcncgaanacttntgngtncttatatanactnccnnnancnatctngatctntctttatatanacatnttacacgtatgtgaannntctgaatatatntcattnnctcncnntaaccgacatnncatntttntatantcacagaattannnaatagcc

SEQ ID NO: 8079 - DNA, 678 bp, Homo sapiens
  misc_feature 2, 3, 5, 15, 17, 24, 38, 75, 76, 77, 78, 80, 81, 82, 92,93, 94, 98, 99, 104, 113, 117, 118, 129, 130, 132, 133,135, 137, 141, 143, 144, 148, 150, 155, 158, 159, 163, 170,171, 172, 173, 187, 188, 189, 190, 194, 197, 198, 199, 200: n = A,T,C or G
  misc_feature 202, 203, 204, 206, 207, 209, 210, 212, 213, 218, 221, 222,223, 224, 225, 226, 227, 228, 229, 230, 240, 241, 242, 247,248, 254, 259, 260, 262, 270, 272, 273, 274, 278, 284, 291,292, 296, 297, 298, 299, 300, 301, 311, 312, 314, 315: n = A,T,C or G
  misc_feature 319, 329, 330, 331, 339, 343, 347, 348, 358, 360, 368, 369,370, 371, 374, 375, 380, 382, 383, 390, 399, 409, 410, 411,412, 413, 415, 424, 425, 426, 427, 428, 431, 434, 436, 437,438, 439, 442, 443, 444, 445, 450, 454, 455, 481, 483: n = A,T,C or G
  misc_feature 484, 497, 498, 500, 506, 509, 510, 517, 518, 533, 536, 539,541, 542, 553, 554, 557, 559, 567, 569, 570, 578, 579, 589,590, 591, 599, 600, 602, 603, 607, 608, 609, 613, 619, 620,624, 627, 634, 636, 639, 648, 661: n = A,T,C or G
cnncngtagacgttntnttttttntttttttggccttnttttttttttttttttttttttttttttaaaaaaaannnngnnntttttttttnnncccnnccccnccccccccnaatnnggggggggggnngnntntnaaancnntctntnccccncannaaanaaaaaannnnattttttttctccnnnntttncgnnnncnnntnncnntnnaaaanaannnnnnnnnncccccccccnnnggggnntttttnggggnntnaaaaaaantnnncccntttttnggggggnncccnnnnnngggggggggnncnnaaantttttttttnnnaaaaaaanaaantttnncccccccccngntttttttnnnnccnnttttncnnaaaaaanggggggggnaaaaaaaaannnnntnttttttttnnnnnttnaanannnnaannnnccccncccnntttttttttttttttttccccccagngnnaaaaaaaaaaagnngncccccnctnnccccctnnggggggggggaaaanccnctncnnttttttttttnnacncnttgggggngnnttttttgnncccccaaagnnngggggtgnntnnttgnnngggnaaaaanncccntgngggggcncnaanaaaaaaaangggggttttttcnttccccccccccccccc

SEQ ID NO: 8080 - DNA, 970 bp, Homo sapiens
  misc_feature 12, 104, 109, 110, 113, 116, 128, 129, 131, 135, 136, 144,159, 162, 168, 176, 177, 178, 180, 182, 192, 193, 202, 206,212, 213, 214, 215, 220, 223, 227, 231, 242, 246, 248, 250,251, 258, 280, 289, 292, 302, 303, 306, 308, 311, 313: n = A,T,C or G
  misc_feature 318, 320, 328, 335, 339, 343, 345, 350, 353, 355, 356, 358,359, 365, 372, 373, 376, 378, 381, 384, 392, 393, 394, 395,398, 399, 400, 413, 414, 416, 420, 422, 426, 430, 432, 434,439, 444, 449, 451, 462, 463, 464, 465, 479, 481, 482: n = A,T,C or G
  misc_feature 494, 500, 502, 510, 522, 530, 531, 535, 536, 537, 538, 539,548, 558, 559, 564, 573, 577, 583, 596, 609, 617, 618, 619,623, 625, 641, 647, 651, 652, 662, 666, 668, 671, 672, 674,679, 680, 683, 685, 686, 691, 694, 698, 703, 704, 705: n = A,T,C or G
  misc_feature 710, 714, 719, 720, 721, 724, 725, 739, 743, 746, 748, 753,755, 756, 758, 765, 766, 769, 771, 775, 782, 783, 787, 796,798, 808, 809, 811, 814, 818, 819, 826, 828, 831, 837, 847,858, 860, 862, 864, 868, 870, 876, 878, 883, 885, 887: n = A,T,C or G
  misc_feature 904, 909, 917, 920, 922, 931, 937, 938, 942, 953, 956, 960,963, 965: n = A,T,C or G
atatcgcaattncaggtctattgatttgctacatgcttaaaatgatagaggttgctcagcatttttggagtacaagggggtcagcagagacatgtgatgagggnttacnngtnatnataacccacacnntnacanngtgtccangctatttaaatgacnaanacttcnattcaacnnnantnctatgggtcnngtttggcancatngcttgnnnnatganaanatgntccnctccgcttatnatcncntnnctaattncagaaaggacttaatatctcantatccctanctnttggtacccnntcngnaantncattntncccatacnatttgtnccanttcnantcccntantnncnncagctnaaccacnnaancntantanttttctannnngcnnnaaaacttcataannanttgnantcanaccncncntttcnctaantcctnanctggggtcctnnnnaccgcctcatctancnntccgtattaccntttatncnctctatanctccgtcaacanaattctcnntctnnnnnaaactaacncctcattcannccccnactacaatncacntccacnttctactctcctntgacatctactancacctctnnntccntnatttcattctaaattnccccanaaanncgcgatacancctntnccnnanttccnnccntnncgccnctnctanaaaannnatatnttcntctannnttnnctaacatttctttnttcnatntnaaacncnnanactactnnaangnccancctcacnntatncccattacntncctttcatanncnatncccnncctatancncanacttanctttaccccnctctttaattntntntnaagntnatcttnantatantncnaggcctatcgcttacanacttncttatatnacnanccattcccnaaattnnttcnattcaataccntcnctanccntntaccg

SEQ ID NO: 8081 - DNA, 685 bp, Homo sapiens
  misc_feature 1, 2, 26, 27, 30, 35, 39, 42, 50, 54, 65, 628, 634, 676,677, 684: n = A,T,C or G
nnttgaaaatccggcacgaggggttnnganatgtncacnccnttactganaaancatacctgacngcagaataaacccacatctactaagaggcttccatggtttttactgctatcactttgattactccaataatgaaactattgaatctgtttcttagaagccaaggtaagaaagcagagaatagtctgccattgaactgatagcatctgttttataattatctggtgacttttctagagaagatgtataaaggctgtgttgtttcatgtacaccacacttgaatgattgcttcttgagttggattgtactccagttatctatttctgtgtaacagttcacctcagaacttcgtggcttaagatgcctgttatgggtaagatggagcaaacacatttcacctgtcttttctactgaactcagctaaaacacctggcctagagcaactatttgaggactccaaaagacgtatcttaaaagttgcactaagaaggagcagattttgaagtactggtgaaccagggtttaatttatcattctcacctctctcatatcctcaggcttcaaatcaacacagcctaaaacccctaagtgggacattaatggggggataaagaagaactctangaaaanccttcaagttctgggtcaaaagaatgggaaaggcgaaattgnnaatactna

SEQ ID NO: 8082 - DNA, 645 bp, Homo sapiens
  misc_feature 11, 71, 73, 74, 75, 82, 83, 105, 434, 471, 497, 504, 528,530, 545, 552, 595, 597, 624: n = A,T,C or G
gatcccgaagncccaagtgatccaaaatcaaatatttgtaaaagagtaattggtttggaaggagacaaaancnnnaccactnntgacatctcatcgcctggagtnggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcagcactgaagccttgccaggtggtgcccattgtaagtcggcggccctgtggaggctttcaggacagtctgagccccaggatctccgtgcccctgattncggactctgtacagcaatacatgagttctttctctanaaaaccaagccttctctggctgttanaaaggangctaaagaaggccgaaaacccaangnggtggggttggaatnccctgangaaaggctgatcaatctcaaaagaagggggactattgttgacngncccactgggaatttcagtgcacttaanggctacagatgaagagtttat

SEQ ID NO: 8083 - DNA, 1215 bp, Homo sapiens
  misc_feature 15, 16, 17, 18, 22, 25, 30, 33, 34, 50, 52, 54, 77, 79, 83,86, 94, 97, 99, 106, 113, 114, 117, 121, 123, 124, 126,134, 137, 139, 140, 142, 154, 157, 159, 161, 162, 164, 167,169, 172, 173, 174, 178, 188, 212, 216, 218, 221, 230: n = A,T,C or G
  misc_feature 232, 238, 240, 252, 254, 258, 259, 270, 276, 281, 285, 286,289, 299, 308, 332, 356, 361, 363, 380, 386, 389, 392, 393,395, 404, 410, 413, 420, 435, 440, 444, 449, 455, 458, 462,463, 465, 467, 471, 475, 478, 479, 480, 482, 483, 490: n = A,T,C or G
  misc_feature 491, 498, 499, 500, 507, 509, 510, 511, 513, 515, 523, 524,525, 528, 536, 537, 539, 541, 542, 545, 548, 551, 552, 553,554, 558, 559, 567, 571, 581, 589, 593, 596, 600, 605, 608,622, 623, 631, 632, 636, 637, 638, 645, 647, 648, 650: n = A,T,C or G
  misc_feature 651, 653, 664, 666, 676, 680, 682, 686, 692, 698, 699, 701,709, 724, 733, 743, 744, 747, 750, 751, 757, 760, 765, 770,781, 790, 814, 817, 818, 820, 823, 827, 832, 843, 853, 858,861, 863, 865, 866, 870, 879, 883, 888, 889, 895, 905: n = A,T,C or G
  misc_feature 910, 916, 917, 918, 924, 925, 928, 929, 930, 956, 970, 973,975, 983, 988, 995, 1002, 1005, 1006, 1009, 1011, 1036,1040, 1044, 1045, 1046, 1049, 1063, 1064, 1071, 1077, 1078,1081, 1083, 1085, 1087, 1102, 1104, 1105, 1114, 1115, 1120: n = A,T,C or G
  misc_feature 1142, 1145, 1157, 1178, 1183, 1184, 1188, 1197, 1199, 1202,1210, 1214: n = A,T,C or G
atttcgaatcgcaannnntggnacnaaaangannttaatctttcttcaancnancgttccctgtgggacaagggatngnaacnatntatggcanatntngagagancaagcannatncaananntntgtattcnatnanntntaatatacacanaananannantananatnnntaanacataaatcnggggggggggaaacattttttttntcanantanaactcatancnctattngncgccatccatantntcgnntccaacgtctnattaantatantganntanaatctataanaatatatcnattagcatccacacatatataaanatctacatctatattaaaagaatnagacnanttcaatatacatacacntatatnatntannancatgtaatntatcanacnaaagaantaccatcggtatatncacanacanatatntaactnctntatnnanantaanactnccnnntnnaaataanntatcatnnntactatnannncnancatcatannnctntatatganntntnnaanaantannnnattnncaaatcantcantaattaatanataattgnacanacnaatntttantanatcaatataatacnnatactaanntcannntcaaganannannanctaacagaacncnctatatatanatcnanaaanatctantcgcanntnaatcaccntatatcatatctatncatacaacncttaacgtgnntcntcnnaacatncanatctnttcanaccacatcacngacaacacntcagacatatggatctcttatcanacnntnaanacanctacnatcactcgatnataccacatntatanacnantnnatgnataaacacnctanatacnnaaatcncacatacatntttanatagannnacagtnntannnataacacacattaataatttattacnaattacacagaganacntntcacatancatanaaatctnaaaaacncanntananatcatatatatcacaacacacaccnatancatnnntanatacccttactcannctatacnatatannatnanananacaactcataataantnnctcatctanncaaancttaatctcactatgtatcaanacnccctttatagantaccaacatatccacacatantcacnnttanactctctgntnganatcgtttnatanc

SEQ ID NO: 8084 - DNA, 1162 bp, Homo sapiens
  misc_feature 1, 7, 12, 13, 16, 17, 18, 32, 95, 96, 101, 105, 106, 108,119, 124, 126, 131, 133, 134, 136, 139, 147, 148, 150, 153,160, 180, 191, 203, 204, 207, 209, 213, 215, 216, 217, 219,220, 224, 228, 244, 249, 254, 255, 261, 262, 263, 264: n = A,T,C or G
  misc_feature 266, 271, 275, 277, 278, 283, 285, 289, 295, 297, 299, 306,309, 314, 315, 317, 319, 322, 324, 326, 327, 332, 334, 341,343, 344, 350, 354, 356, 358, 360, 363, 367, 368, 369, 372,374, 379, 385, 387, 402, 415, 420, 431, 433, 446, 451: n = A,T,C or G
  misc_feature 456, 461, 465, 466, 469, 472, 490, 494, 497, 501, 504, 505,506, 514, 515, 516, 519, 524, 528, 536, 538, 546, 551, 555,560, 562, 563, 564, 568, 569, 572, 589, 603, 614, 623, 634,645, 656, 659, 663, 674, 677, 680, 684, 691, 694, 711: n = A,T,C or G
  misc_feature 715, 723, 727, 728, 735, 743, 744, 753, 759, 771, 773, 779,780, 781, 782, 784, 786, 790, 800, 802, 808, 815, 825, 827,832, 835, 840, 846, 850, 851, 852, 854, 857, 865, 874, 875,887, 889, 894, 913, 916, 919, 923, 938, 944, 947, 954: n = A,T,C or G
  misc_feature 958, 962, 964, 966, 973, 978, 983, 986, 989, 991, 995, 997,1020, 1021, 1023, 1026, 1029, 1030, 1032, 1038, 1039, 1047,1048, 1050, 1060, 1061, 1062, 1067, 1069, 1070, 1075, 1076,1078, 1085, 1088, 1095, 1103, 1110, 1115, 1117, 1118: n = A,T,C or G
  misc_feature 1138, 1141, 1142, 1143, 1149, 1151, 1154, 1160, 1161: n = A,T,C or G
nttcaancgcanngannngctgtaatccctcngtgtgatacagccaattgtaaaagactgcaaagaggctgacttatccttgtataatggaaccnnggggncgtnntnaggatgatccnccccncnccttncnncnctntcttcttnngncanaatcctnccagggaagatatctttccntgtttaaccantcttcaaattanncangngcancnnncnntatnaccnctttagcggccatctnctccntatcnnacctcnnnncntcttngaantnntcctnanctcncctctncntnacattcntgncgtanngntnttngncnnaatancnccttatntnntccacntccnanantnggntcgnnnatncnctacnccaatntntacaatctgtttcgncctattctacaancttgnttctctcaacnanatctacaacagtnccttnggtgncatcnaccnnccntcntcaacacttatacatccntcanacntctntannntactctcnnntcntctgncatnctgtatcncntctcttcnctgcntcanatccncnnnttcnnatntcctctgtactctctcncccctcctgtctantgcgtatcacntctacgtanttcgtcatacntctcccactcncacacatcgcntcnttcnccacacatacncanacngtcncccatangcncgcactctacatgcgcnctcnctctactntctnnactcgcncatctctnnctcatcgcnctccanatctccttatancncgcgannnntntngcanctttctcggnancactanctactcngagctcttcncnctctntangctantcatgngccnnnantcnctctgcgncacatctcnnatctcacaccgncnctatnctgcctgctcacgactctnacncanactnacacttccatttgtnctctcnatnatccctnccgnctcngncncacctanattcnacaancantgncncttncnatttgcactatcctattctatcnntntanctnnantccccnnccatcctnncnatctctccgnnntacancnntcttnnancctcatnggntcccgcnttcctctntcactancttantnnctcgtagacgtccctacgcnatnnntatctncnttnttttcnnc

SEQ ID NO: 8085 - DNA, 1125 bp, Homo sapiens
  misc_feature 1, 2, 9, 32, 35, 37, 44, 45, 46, 47, 49, 75, 83, 95, 99,100, 101, 104, 106, 107, 109, 114, 115, 119, 120, 127, 130,132, 139, 142, 149, 151, 158, 160, 161, 169, 171, 183, 184,192, 196, 199, 203, 212, 218, 221, 228, 230, 233, 235: n = A,T,C or G
  misc_feature 238, 240, 244, 245, 249, 255, 257, 259, 260, 261, 263, 264,270, 277, 278, 287, 293, 295, 298, 302, 308, 310, 313, 319,321, 323, 329, 330, 332, 339, 343, 346, 351, 358, 363, 366,367, 368, 372, 375, 378, 384, 385, 386, 387, 390, 394: n = A,T,C or G
  misc_feature 399, 401, 403, 405, 408, 412, 414, 424, 425, 429, 435, 438,442, 445, 452, 453, 457, 472, 475, 476, 477, 485, 503, 505,509, 516, 528, 529, 530, 538, 539, 547, 563, 564, 568, 569,571, 574, 585, 600, 605, 609, 613, 614, 621, 627, 636: n = A,T,C or G
  misc_feature 637, 639, 641, 643, 650, 655, 657, 662, 663, 669, 672, 679,681, 690, 691, 692, 693, 697, 702, 712, 732, 735, 736, 738,743, 745, 750, 751, 758, 759, 763, 764, 773, 779, 783, 792,798, 800, 805, 807, 808, 810, 815, 824, 828, 829, 831: n = A,T,C or G
  misc_feature 837, 845, 848, 853, 861, 868, 876, 884, 890, 892, 898, 902,903, 905, 907, 908, 919, 929, 931, 935, 936, 938, 940, 941,942, 949, 950, 953, 954, 962, 967, 968, 972, 977, 986, 991,997, 998, 1003, 1004, 1010, 1012, 1013, 1015, 1025: n = A,T,C or G
  misc_feature 1028, 1029, 1030, 1034, 1036, 1040, 1042, 1045, 1048, 1054,1057, 1061, 1069, 1080, 1090, 1094, 1106, 1110, 1115, 1122,1123, 1124: n = A,T,C or G
nnttcgaantcggcggggaggcaatactccanttngncccccgnnnngngacatcattaaataaaaagacacaanatcaaaanctattctcccantatnnnaantnncntctannaatnnggggggngtntntttaaanaantaccaantnctccaananntctccaanangtaataaaacannatatatcntctntancctntaagaaatnccacancanacgacantnttntnccnantatnntttncgttantncnnntnncagtanttcaaannattcatatnacaatnanttnaacntacttntnttnttcctnantntactannanaacaccntatnttnattanttatatntattnacnnncatnttntantgactnnnntcncaanatcananananacncaancncaagattatnntccntcctantantganttntacactnnaccncttaaacactctaancannnatatcaanatctttatcactctattntncaantacttcnaaaatacttctnnnataatatnnaaaaatcntcatctcatccaacanntatnntntantccccctatcncattgtccttctctnctccnctcngacnnctcttancatccncacctcatnncncncntatatcntacananctcannatatcntangctaatnancatatcacnnnntctncacancacttctcantatcaccatatcatcaatcnttnntngcgantnaacannatacacnnaatnnactgaactncatacngatncgccacaancactancncactncnnanacccntatcatgtntacnncncgtcanattacatnctnatacncaatactnacaccgnacactccnatcgatcncacttntncatcanactnntncnngtacaatctanacatccaacnantacnnanannnactacannccnnacacatcncgtcnnaacncacancatactagnaaaancatacnncactnnacattnannangacccatctnctnnnactncncacntnatnatnactctnctnactnatagtcantatatctaaanaaatccctanaaanaaatcgtatatnttcntatancactatnnnc

SEQ ID NO: 8086 - DNA, 670 bp, Homo sapiens
  misc_feature 1, 30, 33, 35, 39, 54, 69, 648: n = A,T,C or G
ntatcgattcggcacgaggttctcccttancanangctngctttatgacaacancagagcttgagcatnttgagaaccaactttgcccaagaatattgattagtagtttctgccatggtcacaggaaaggagaatttagcattttgtgtctctgtgtgtcatacctgaataagagtctattggtgcaaaagagcatatccaatagtgatattcataaaataagtgacgcaaaatagtccatgcaggatgggcacagtatttcaataaaatacaggtagttaagtaaaggtaatttctagttgagtacataactgagacagaaaatatgtgcatagcaattttaaggtatgttaataaaaaagataaagaatttactaaaattaaattgcaagaattctgcaaccatattttctttgcaatttaattttctgtattttaatttcttgggatatatttatatttggcagtataggatggaattttcaaaaacaatattgaaaagggctgggcatggtggctcacacctgtaaatcccggcactctgggaggctaaagcagaggattgcttgacccaggagtttgagaccagcctgaacaacacagcaagactctgctcttcagaaaacaaaaaacttatctaggtgtggnggcacatgcccggaagttccat

SEQ ID NO: 8087 - DNA, 1468 bp, Homo sapiens
  misc_feature 1, 2, 3, 4, 5, 8, 9, 12, 13, 14, 16, 17, 19, 22, 30, 31,34, 35, 36, 39, 41, 42, 50, 58, 59, 60, 63, 67, 68, 70,72, 74, 75, 76, 83, 84, 86, 89, 99, 100, 101, 105, 107,111, 119, 120, 126, 131, 133, 137, 143, 145, 149, 153, 156,158: n = A,T,C or G
  misc_feature 159, 164, 168, 169, 175, 184, 187, 206, 207, 208, 209, 210,215, 217, 220, 221, 222, 224, 230, 245, 258, 268, 269, 270,271, 275, 292, 294, 297, 300, 312, 324, 326, 329, 341, 348,350, 363, 369, 371, 373, 374, 377, 381, 384, 385, 387: n = A,T,C or G
  misc_feature 389, 395, 400, 401, 404, 409, 411, 413, 417, 423, 426, 427,428, 429, 434, 438, 442, 443, 446, 448, 450, 451, 455, 456,458, 459, 461, 462, 464, 468, 474, 475, 476, 478, 479, 480,481, 482, 485, 488, 495, 499, 501, 505, 512, 515, 516: n = A,T,C or G
  misc_feature 520, 522, 530, 532, 535, 536, 538, 543, 546, 548, 549, 550,551, 558, 559, 560, 563, 564, 569, 576, 580, 583, 584, 590,592, 593, 594, 595, 597, 605, 609, 614, 616, 619, 622, 623,625, 630, 633, 637, 639, 640, 645, 646, 660, 661, 663: n = A,T,C or G
  misc_feature 666, 670, 680, 685, 699, 702, 708, 709, 710, 714, 716, 717,718, 719, 720, 725, 730, 731, 735, 737, 741, 744, 756, 760,762, 764, 785, 790, 797, 799, 802, 812, 814, 815, 817, 819,820, 823, 828, 831, 835, 840, 843, 855, 859, 861, 871: n = A,T,C or G
  misc_feature 874, 877, 885, 890, 892, 897, 899, 907, 908, 910, 911, 915,925, 934, 942, 944, 949, 950, 958, 959, 964, 966, 967, 968,972, 976, 979, 981, 988, 989, 991, 995, 1000, 1002, 1006,1007, 1009, 1012, 1014, 1023, 1025, 1027, 1035, 1039: n = A,T,C or G
nnnnngcnntannntnntnaantactatcnnacnnntcnannacgctgcngaactatnnnaanaganntntncnnncacgacnnantantactaactannncggngnagtnatagctannagcgancttcncntcantgatgntngacncacnctncnntactntcanncatacntaatgatcngtnacgctaaacattaaatctnnnnnccacntntannnancgaaanccgggggggaaggtnattatactaaagnagggcccccnnnncagnaaacacctctacacatngnggnatntgcattcgtatntatatacgaacngnaantacacgatatcnatgaaananatggggggggctntagagnananngangttntcnngncntttacntagannccngtcgnanantagnatgaantcnnnnaagtnaganttgnnggnancnntagnntnnanngnaatntcattnnntnnnnnganagnataatgncgcnantgtngcgaatnctnncggncntcaaaccnanagnncngcganctncnnnngaccgcnnnaannaaganctacaancgtncgnngcatcncnnnntnagatttcnaaancgtgnancanaanntnaactnaantatntnnccggnnccgcaaatatgtannanacntggngtgggacaantgcgnagagacgtgtagcncantgctcnnnggancnnnnnagatnatcgnntaananagangancatacggagganaacnanantcatcgcacgccgcgtgtacnaacancgcactntnggntgcaatacancnnananngtngtgcnctnatanacgcnganatagtgctcaanatcngntgtatctatnatntantatatgtncgaanangaganancaggtacnnanncacngtatacgtcntagcacaangaaccaancncgccnncagtatcnnaaccncnnnacanacgncgnancaatcanncntacngcatncnacgnntncgngncatatatancngntcacgcanaagnaacgacnagncngtngatgcgacgtngcncgcagcanccnagaannncnnnnatgctntcnnccnnacngcngaaacngntnannnanacannnnnnnccgaatgtcctcnncnngannccgnttannancganctatncnngatncgcacnnnnnntcntnaatctanccnntcgntncatactnntccganttggacnccgctaacngtaatatanngnactncgnncacgtncgncacgagnntnnanagcgcgncgcanannnctgcnnnancaagncanatcngcacantcnggntntcntgtcgatanccnacanncgtntcgntantcancntatgntnntgnncacnagnantnncntcnaatncgtancanncaactancanncncccncnncngnnacaaccancncanntnncntccg

SEQ ID NO: 8088 - DNA, 1461 bp, Homo sapiens
  misc_feature 4, 8, 11, 14, 15, 23, 29, 32, 33, 41, 54, 55, 57, 58, 60,63, 74, 76, 81, 84, 90, 94, 95, 101, 113, 114, 115, 116,118, 123, 136, 140, 142, 149, 150, 157, 166, 167, 168, 177,183, 185, 187, 195, 203, 204, 206, 212, 213, 214, 215, 216: n = A,T,C or G
  misc_feature 217, 218, 224, 225, 228, 229, 232, 247, 249, 253, 259, 268,273, 280, 282, 284, 286, 287, 288, 294, 297, 298, 300, 304,305, 308, 310, 321, 322, 323, 329, 330, 331, 333, 338, 345,349, 369, 372, 373, 374, 375, 380, 387, 395, 396, 401: n = A,T,C or G
  misc_feature 402, 404, 408, 409, 410, 412, 415, 421, 425, 426, 429, 435,439, 440, 445, 447, 451, 452, 454, 458, 459, 461, 462, 464,466, 468, 471, 472, 474, 476, 479, 481, 482, 484, 486, 487,489, 498, 503, 511, 512, 515, 517, 520, 522, 527, 528: n = A,T,C or G
  misc_feature 531, 534, 537, 544, 546, 547, 552, 554, 559, 561, 574, 582,584, 586, 587, 589, 591, 592, 594, 595, 598, 600, 601, 603,604, 614, 620, 635, 643, 644, 649, 651, 653, 654, 656, 657,658, 660, 661, 662, 667, 668, 669, 670, 674, 676, 681: n = A,T,C or G
  misc_feature 692, 694, 697, 698, 702, 704, 706, 709, 713, 717, 722, 726,727, 728, 729, 740, 742, 745, 747, 751, 752, 758, 760, 767,768, 771, 772, 787, 789, 790, 795, 797, 817, 820, 824, 825,832, 841, 843, 849, 850, 865, 867, 869, 877, 878, 884: n = A,T,C or G
  misc_feature 896, 897, 906, 910, 917, 925, 929, 939, 940, 949, 956, 958,963, 969, 970, 973, 976, 980, 988, 990, 991, 993, 1003,1004, 1007, 1012, 1017, 1019, 1020, 1027, 1030, 1031, 1036,1040, 1047, 1049, 1069, 1072, 1073, 1082, 1088, 1092, 1103: n = A,T,C or G
gaanaacntangtnngattaatnggtganaanngcaaatangcattggtatganngnnanttngagaatgtatntntcgtngtnataacncacnngacganaactgtaaatannnntnttttntaagagaactganacanancatgganncggaacnatcaagtannngaaataaantgcgtnangntatatcantagcatanncntaaatnnnnnnntttaannttnntanaacttcgggggtgtnanttanccccanaaacccccngcggnggggggnangnannnaaaganatnnanttannacncntaaatactaannntcttgnnnantccanggggttntttnttacaagatgtgtggccaanaannnncaganttttgtntttatagnnttttnngnattnnntngtngatacntgtnngantggaanctannattgnangtgnntngaanntnnanantnganngnanagnanncngnntnagtatggcnaatgnattaagannggntnatntnggaannacnatntantcggagngnntgtantngggantnatttaggacggtnttcttatnantnngnanngnncantnnanngatatattcnattatngcgaatgggtattanaaattgtnntgatntntnntnnntnnntgatnnnnatgncnataantgcattggtcnanttnnacanangncanaacnatanttaanttgnnnnatagtatacananaancntgcnnatatgnanacaatannttnncggaactatacagtntnngccananttcatatgttggaacacttncgncacnngtctagntctatagananatatcnngggtgtgtatgagantnanagatcgcnngatctncagttatatgtnnattaccatnatanatagatnacgtacgngcanaatgtgatanntcatacaangagatcnangaatnttgatnntgnagntgtntgattacntnncnatactgatgnnagnagtancgctncnnataaacntgnnattangctngtgatangngttatgttgagataacatantannattaaactnacgagnatanttaaatattancntttgtnatantgnnnnnaaagngatcnnatananangtcngagtatactatacatgacggnagcncanttntganagngatncagatgtatcngtgtncgncanancancatccaatataaaaangttgatcngtcannnagcncagtgcncgnataaatnntacacncgtangnaacagatngattaactacaanatacacatcaganctgcgtgcanatgcagaangtgcnngtcatcncgnnagtgtatgtgnatgaatatcngaanganactactcantgaagacgagatgcanntnnnaancnnacatagacactcggaacgcatagancnctnctgggantgaactnnnn

SEQ ID NO: 8089 - DNA, 679 bp, Homo sapiens
  misc_feature 2, 6: n = A,T,C or G
tnatcnttagcatacaccctcagggagtcacagccttccaacgtccattcatggagcccaggtccaaaacctgtgatccgagaataggataacccttttctgcccatagggtgttttccaaagacctttcattgctctgggttacgtgggaaacaacaaaacagaaccatcccccgcactggtcagctgctacgggtcacgccagggaaaagtgtggactgatgtatttcgttgtttaccatgtttctagccagagctaatttgaaaataggtatcccaagaaccagactgcaggagtatcccaaaataaaacattttattataataataatgacaaggatggtatttttcttccatctcaaaattgtgtataatgcgatattcaatttatagtttaataaataaaaattcttatctcttacgaaaagtttcttttagagctgagctttgcttaaacatttattatccatctgctttctcctaatttgaaaacaagcgataaagcaagcaatttacattcctaacagtgcctaatgagacagtttattcattcagtcagtaaatatttattgaacatctactgtgtgccaggcatagggaaggcattaaaaagatcttgctgattacagtcaaaacatagtccctactctcatggggattttacaacctaaactcatgg

SEQ ID NO: 8090 - DNA, 701 bp, Homo sapiens
  misc_feature 2, 3, 4, 521, 583, 593, 613, 632, 636, 665: n = A,T,C or G
tnnntcgtccctaacgagggtacctggtgcctctgactgcgcctctgcctttgccgcctggctcctggtggttcaagttccagaaaggtccgagggctgtaaggtccttagagaacctagaggctcctcctaggaacctttaaaaatgataccctgccctgcgttggagcctgtgaatttctttgcatgtgaggggccagctgtcaggtggtcggctgagccagggcagacccaggagcccagcacgccatcgcggaggcctttctgatggcacaagtgctagccgttcctcctgcttctccgcccacttggccatgtctgggaaaaggctccccccagctcccttgctctccctggagcaccacgggcaggactctgaccggggatgggcaggttggggcattctggagaggaggttttggagtgatgggtgcagaaggcgttcagggtgggtgaatttccctgaaagcctcaggccccagctctggctctggtccttcaactcttaaggcccccttttnttcatcttgaagaaaatttgaactcaaactcaagggttccccacctgggggggacgccacanttggccagtntgccgtgggaggtccttaantggtggtctgaaggggctnctancgtcagaaaagctctgcagaagcccctgncccaaaggtgtctggtttggggctaaggtgatgccg

SEQ ID NO: 8091 - DNA, 1227 bp, Homo sapiens
  misc_feature 2, 4, 6, 7, 9, 11, 13, 14, 15, 16, 17, 18, 20, 22, 24, 25,27, 28, 30, 32, 33, 35, 38, 42, 43, 45, 46, 47, 48, 49,51, 53, 56, 58, 59, 60, 62, 64, 65, 66, 67, 68, 69, 70,72, 73, 75, 76, 77, 78, 79, 81, 82, 83, 85, 86, 87, 89,92: n = A,T,C or G
  misc_feature 93, 94, 97, 98, 99, 100, 101, 102, 103, 104, 106, 108, 109,110, 111, 113, 114, 115, 118, 119, 120, 121, 122, 124, 125,128, 130, 133, 135, 143, 144, 146, 147, 148, 149, 150, 152,153, 157, 159, 161, 163, 173, 176, 179, 180, 181, 182: n = A,T,C or G
  misc_feature 183, 185, 188, 189, 190, 191, 193, 194, 195, 196, 197, 198,199, 200, 201, 202, 208, 209, 221, 222, 224, 232, 239, 240,241, 243, 244, 248, 249, 251, 254, 271, 274, 281, 287, 289,294, 299, 328, 355, 363, 370, 374, 391, 393, 399, 402: n = A,T,C or G
  misc_feature 407, 419, 446, 464, 469, 479, 481, 482, 487, 501, 506, 515,517, 521, 525, 526, 531, 535, 537, 544, 547, 548, 549, 562,568, 580, 587, 589, 605, 607, 619, 626, 627, 628, 631, 632,633, 634, 651, 657, 690, 698, 713, 721, 725, 731, 758: n = A,T,C or G
  misc_feature 767, 773, 776, 779, 796, 797, 799, 800, 807, 819, 822, 833,852, 853, 855, 860, 866, 867, 880, 886, 889, 911, 916, 917,922, 929, 930, 935, 951, 954, 973, 975, 982, 984, 985, 987,998, 1000, 1011, 1021, 1025, 1040, 1046, 1051, 1057: n = A,T,C or G
  misc_feature 1077, 1086, 1092, 1098, 1115, 1117, 1126, 1129, 1132, 1135,1155, 1158, 1168, 1178, 1179, 1180, 1196, 1198, 1200, 1227: n = A,T,C or G
ananannananannnnnncnangnnanncnanncnaanaaannannnnngncnaangnnnanannnnnnnannannnnnannngnnnanagnnngannnnnnnnancnnnnannnacnnnnnannggngngangnaggacgannannnnnanngaangnangngagggccgangangannnnnanacnnnncnnnnnnnnnnagcctnnggaaaacccttnngnccaaaacnaccccgnnncnntttnngnaangggaaaacccaatcggnaanccccccnggggancngggantgggnaaaaacggaccaaacaaagggaaaacctnggaaaagggcccggaccggggggggcncggaaaancaccctngggngaaatcctggggggggngncggggnaanaaacnggaggcccgggnaaaaaaaaaaactgggactccaaaacnaccacccgggaacccaanccggnaccgggccananntcggnaaaaggtaaacctnccttnccccaaggncntccngggnnactcnggcntnggaatgnctnnngggggaacccaangggggngggaagggaagncacccancnaagagggggaagggcncnaagggggggaantgggaannngannnnccaggggaatggaaaanaaattngggaggggggaaaaaaaaaaaaatgggggggtnaaagaaangccccaaaaggaaanttgggggnaaangtaaangggggggggaagaaaacaaagaaaaangggagcccngggggnctnatnggggggaaaaagggaanntnnggaaaanaaaaggggaagnccnggggggaaaanaatggggcaggggaaaaanncnggggnaaaccnnaaaaaaaaaaaangggggnccntttaaaaagaaaaccccaaccntcccnnaaaanctccgtnnccccnaatcccaaaacccaanagncctgggccgggacccaaangnggcatcntnntnaccctggcctnancaagcattatnggcccccaangccnccctccaaaaaacanctggtnccccnggggcntaaagggcaagggggaaagnaaggggaanaacaanggattngggggggaaaaaggccntnaaggaaaantgnganaangtgggggaagaaggaacaanctnggggggcttngggccaatgnnnaaaaaagaaagggacngntnacggaaaccatatcgggagaaaaaaan

SEQ ID NO: 8092 - DNA, 764 bp, Homo sapiens
  misc_feature 14, 21, 24, 26, 366, 386, 388, 399, 413, 419, 420, 427, 430,434, 440, 442, 448, 450, 454, 457, 460, 461, 462, 473, 476,479, 480, 484, 488, 489, 491, 497, 499, 502, 538, 560, 629,638, 647, 666, 693, 715, 756: n = A,T,C or G
tcaaattcagctcnttgcctntcngnaggatcccatcgattcgtctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcatgggactggttgggccagggatgaatatttgagggataaaaattgtgtantgagccaaagaattggtacnantggggagaacngataggagctgtgntattgnnaatgatncgnttantggagntncaattntngctnaangtnnngaactagcttncgntgnncctnaccnnanaatgcntnccnagcccctggaacaacatctgaagagccatgtccccnaggtccaccttctgcttctgangggggctcccgggatgaacaggatggagcttcagctgagacagaaccttgggcagctgcagtccccccngaatgggtncctattatncagcaggacattcacagcncagccggaaaggtgaaaccgcagcccnctctgagtgatgcctaacttanttgggatgcctgcccagaaaccccagacgatgcatggtganggccccct

SEQ ID NO: 8093 - DNA, 731 bp, Homo sapiens
  misc_feature 2, 5, 16, 622, 691, 713, 719: n = A,T,C or G
gnttnaatatcagctntttgttctttctgcaggatcccatcgattcgaattccgttgctgtcgttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatccttcattcctctgnacttgcagactttctgagccaggggttttcttttagtggaaacaaatgggtgatggatccagatccttngaaaaggagaggattggggtanagtctnccaagccaaaat

SEQ ID NO: 8094 - DNA, 729 bp, Homo sapiens
  misc_feature 683, 704, 712: n = A,T,C or G
ttaataaactgctcttgttctttttgcaggatccctcgattcgcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattccccagtgtggacaacctttncatcaaatatgcttatatgantggctganaggactactaactagta

SEQ ID NO: 8095 - DNA, 689 bp, Homo sapiens
  misc_feature 12, 531, 533, 633, 649, 664, 675, 678, 684: n = A,T,C or G
gttcaattcgangagaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgtttgctgcacgcctgactctgtgcgagcttcttttctgngnatatattttggtttatttttttccgggtatatttttaatcccgacagaacatcatgtggagatttcttttaaaatgggaattaaaaccgatttctttcanccctgaaaaaaaaaanggtttttgaaaaatngttttccttgnaanttttgntttgg

SEQ ID NO: 8096 - DNA, 796 bp, Homo sapiens
  misc_feature 20, 21, 23, 24, 33, 34, 37, 38, 44, 52, 89, 93, 97, 115,117, 121, 123, 125, 127, 128, 129, 130, 132, 134, 135, 140,142, 143, 147, 148, 151, 154, 156, 168, 172, 174, 176, 180,194, 195, 204, 207, 209, 214, 217, 227, 231, 234, 253: n = A,T,C or G
  misc_feature 254, 255, 261, 265, 272, 276, 278, 289, 292, 299, 308, 328,345, 356, 362, 364, 365, 394, 396, 400, 407, 422, 427, 428,430, 447, 453, 465, 482, 486, 488, 490, 491, 500, 525, 530,558, 559, 568, 569, 571, 577, 605, 606, 610, 619, 627: n = A,T,C or G
  misc_feature 630, 634, 649, 650, 668, 670, 681, 682, 683, 705, 712, 718,719, 722, 755, 756, 762, 763, 768, 783, 796: n = A,T,C or G
cctcgattcggcgcgagacnnanngagagaganngcnngagagngagagagngagagagagagagagagagagagagagagagagaganaganaganagagagagagagagaganantgtntntntnnnngngnnagagngnnacannccntcncncctcctagaganctgncncnctgnccttggcttaaccnntaaatatanctntnttctngtncctgggtgantttntcnacaagaccttgtttccccnnntctttnctcngaaaccngtcntnctgcccctctnttntccctcnctctctctntgtgtctcacgctctaaacnctttctcgcgcttgttnttcggtgaaanatttantnntccatcttcgtgttggtgagcggagcccncntttntgcctgngtctctctttttttnatagnntncccttcttcttcgaacncttctncccccccccttnaatggccggcttttttnttantncnntggtgattncccccccaacgggaagggggggggnaaatnttgtccttgtggtcctgttttcttgccnnggggctttnnancttctnggtcctcctcccccccctggggttccannccangggtccccnctttcccnctntccngggcccccccccccnngagaaggggcttctgggncncccccttggcnnnccccccattaccccccccgggnccttggnttcttnnaanttgccgttctttggggtcattgaaagccccccnncccctnntgccngtattaaggccttgngtttgcccccccn

SEQ ID NO: 8097 - DNA, 1126 bp, Homo sapiens
  misc_feature 4, 6, 8, 9, 10, 14, 15, 16, 17, 20, 21, 22, 23, 26, 27, 29,31, 32, 36, 37, 39, 40, 41, 43, 44, 45, 50, 51, 52, 53,54, 56, 58, 59, 63, 65, 67, 69, 71, 72, 75, 76, 77, 78,80, 81, 83, 84, 89, 90, 91, 94, 98, 99, 100, 101, 103, 104: n = A,T,C or G
  misc_feature 105, 106, 109, 116, 118, 123, 124, 126, 127, 131, 135, 137,140, 141, 142, 144, 146, 147, 148, 149, 150, 154, 156, 158,160, 161, 162, 168, 173, 185, 186, 191, 194, 196, 198, 200,201, 204, 207, 209, 214, 215, 216, 217, 219, 220, 223: n = A,T,C or G
  misc_feature 224, 234, 235, 238, 243, 246, 248, 249, 251, 254, 255, 256,258, 260, 261, 262, 264, 265, 269, 271, 277, 281, 284, 292,295, 308, 310, 311, 317, 333, 334, 335, 336, 337, 338, 343,353, 354, 372, 375, 380, 449, 453, 468, 487, 489, 504: n = A,T,C or G
  misc_feature 505, 514, 516, 518, 528, 529, 530, 532, 558, 562, 563, 564,568, 577, 583, 584, 591, 596, 602, 603, 613, 625, 628, 631,648, 650, 652, 656, 661, 680, 693, 697, 703, 722, 725, 729,741, 758, 759, 760, 770, 772, 789, 791, 798, 815, 820: n = A,T,C or G
  misc_feature 829, 834, 835, 851, 852, 855, 856, 861, 864, 883, 884, 888,893, 894, 896, 902, 907, 908, 911, 913, 916, 920, 925, 927,931, 935, 936, 941, 949, 957, 959, 960, 962, 966, 967, 974,978, 984, 989, 993, 995, 1003, 1006, 1016, 1021, 1024: n = A,T,C or G
  misc_feature 1027, 1028, 1034, 1038, 1041, 1046, 1063, 1066, 1071, 1072,1073, 1075, 1081, 1091, 1093, 1094, 1100, 1103, 1105, 1106,1107, 1112, 1113, 1115, 1117: n = A,T,C or G
cccnancnnncaannnncannnnganntngnngcanngnnnannnggcannnnnangnntcancncntngnncannnnanncnngacannngcnaaannnnannnnatnccgccancnggganntnnaaangacncncannngngnnnnnacgnangngnnngcacgnacgcngcgctatacganncacanacncnanannaanacncntgcgnnnngnnccnntacgatcctnnaanacgcnacnanntnacnnncncnnncnnaacnanggaacncggnggngaaggaanagnccacaagggaccncnntgcggngcagtataaataagannnnnnccagnacatgttttnntacctctgctgtgggatnttnggggncattactttgttgatctactttgtagttaacctagagaagttaacacagccattgctacagagctttcngccncttgagtgccagaantccataatccagttatccnanggattgtgggggagnnaaaagaggnantncgggcatggnnncnttgaatggggagcaaatacaagtccnttannngganaagtggccnataaanngtcttangtatnacaccnnggcctgtcantattataacatntanaanaaaacccgaccaataananantganccatntggaaaaacttccctttantttgcgaaaacanggangaaaancggttgacggaagaataanaanaagnggggtccaaaanaaggggtttcaacttgnnnggaataatgnangtcgaagtttgccccancnagggatnggaattaggggtgaaancgggnaatgcctgnaaagnnggggccaaaacccccnnggnnaatanaancctctcaagaaagccatcnncaanggaannangggccntgggnngananaanccantaggnanaatnatgnngtggnagactaangggggacncnntncgannagggagnggtnaagggntcaanccgncntcgaaaanaanaggcccctanggggnagnccnnctaatngggnccnaaacnggagtcataaaagccgngcncaaannncnagaacnagcagcgcangnngaatantgncnnnaggannantntaaaccccg

SEQ ID NO: 8098 - DNA, 679 bp, Homo sapiens
  misc_feature 30: n = A,T,C or G
gttcgattcggcacgagattatacccaaanaatgggatgcgtgtgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaaatgtttgtcttggagtcaaacagaattaaactcagataccagctctgctattttctaactgaatgactttaagttatgtaatatatctgagctttaacttcatttttggcaaaaccagagtaaaaatgaatacctctagttgttttgaggattaaatgagataatgtaagaaaagtgattgggattgggtggtgacttaatgaacggtagtgggtttttaagtagttaatgtatagcaaaattaagtttcacattgtcaagttttcaatacatccccaagttaattggaattttaaattaatggatcaaataaatcacaaaggaccccaaatcaattctgaacaaacaatttagtttttgta

SEQ ID NO: 8099 - DNA, 684 bp, Homo sapiens
  misc_feature 2, 4, 21, 23, 26, 27, 38: n = A,T,C or G
antntcgaattcacaccagcncnctnnaaacctttagnctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaactatctgatagggaagctcaagttggccacccaagtctgagaaacccttaattactgagaatcaaaagagcagaatgtctgtagacattttggatttgtaaaaatcacattgttgagttatacctgtgatgggctgaaagtttttggcattctttcctgttcttcatatgccagtaccataaaccaaaaagtatctcagatctgtcactttcttctcctaaaccaatgtgattgcagcttttttgccttcagcccttttccctatccagtatctcctacatagttaccttttgatcttaaggaactggtttgaattggggtcacttccttgcctaaaattccattgaatggtcattggtaaattctaaaaataagagtt

SEQ ID NO: 8100 - DNA, 1508 bp, Homo sapiens
  misc_feature 3, 7, 8, 9, 12, 14, 15, 16, 21, 25, 26, 27, 28, 32, 33, 34,35, 36, 41, 44, 46, 48, 50, 51, 52, 54, 55, 57, 61, 62,63, 67, 68, 69, 72, 74, 76, 81, 82, 87, 90, 94, 96, 101,107, 111, 112, 118, 119, 120, 126, 131, 135, 141, 143, 146: n = A,T,C or G
  misc_feature 147, 148, 149, 152, 153, 155, 156, 162, 163, 168, 169, 173,174, 177, 186, 188, 197, 202, 203, 204, 207, 208, 211, 213,215, 226, 231, 232, 233, 234, 235, 236, 237, 238, 239, 240,243, 247, 250, 254, 257, 263, 269, 273, 282, 286, 291: n = A,T,C or G
  misc_feature 301, 303, 305, 309, 315, 320, 324, 328, 329, 333, 338, 340,344, 349, 356, 366, 370, 372, 378, 379, 381, 393, 397, 400,410, 411, 413, 419, 426, 427, 428, 431, 434, 449, 451, 460,468, 470, 472, 473, 475, 476, 478, 480, 484, 485, 487: n = A,T,C or G
  misc_feature 488, 489, 494, 495, 500, 501, 506, 512, 515, 522, 523, 524,525, 526, 527, 529, 535, 537, 541, 542, 543, 546, 549, 557,560, 561, 564, 567, 572, 575, 577, 579, 581, 591, 596, 599,600, 603, 607, 611, 613, 617, 619, 621, 622, 624, 626: n = A,T,C or G
  misc_feature 628, 629, 632, 638, 640, 647, 649, 656, 657, 664, 682, 684,685, 692, 697, 698, 701, 702, 703, 707, 712, 718, 719, 722,728, 735, 737, 740, 746, 747, 749, 750, 753, 756, 757, 758,773, 781, 789, 793, 796, 799, 800, 803, 805, 806, 809: n = A,T,C or G
  misc_feature 816, 818, 822, 825, 827, 835, 839, 843, 845, 850, 851, 856,863, 864, 868, 869, 872, 876, 887, 892, 895, 909, 910, 911,917, 918, 920, 929, 933, 939, 958, 959, 960, 974, 975, 976,980, 985, 986, 991, 993, 995, 997, 1003, 1004, 1010: n = A,T,C or G
tgnaccnnncancnnnccgcncccnnnngacnnnnncacancangncncnnntnncncaannnagcnnnacncncntctgnncttcncgngcancnaacgnctcccngcgnnggctcnnntcactnctacnctcntcaccncncannnnagnngnnttgacnngcgcnngacnntancacctcacnanacggctccntccannncgnnctncncnatctccgcgcnggcgnnnnnnnnnnatngggncgnaggncanctattncgtccngacngcccggggnaganacgcnacaaaccttnancngggngtgtcncaggngggnatannaggnttccncncctncatgnggccccngggggggganttcncnactcgnnangtcgcccccacncacnccntgtaccgcanngncccacncaacagnnntgntcnagccccactgccggncncaaatactngacgcacncngnncnncngncccnntnnnctccnnaacannacccnccaccnccncgaacannnnnncnccggcncnagcnnncgnatncagatccncanngcnccnccctnctncnancngtccgactancaagncgnnctnaagnagantncccntntnncncntnnccngcacgncnatgacgncncacgccnnttcgggnagccgcaatccgcacctncnnctactanccatnngcnnntccncaccngtctanncgntgtacncgcgcantntcntatccnncnnttnctnnngaactgtgacccctnacatctcntacgcgcnctcngcncannctncnncanatcgtgnanactnacncnctactcancacntcgncnacgcnnaacgnaccgcgnnccgnnttntccnatgacgacaangcgcntancctcgatctgttgnnntataanncngcgggtatncacncagaanccacacgcgcgccaaacannncgcatagcacactnnntacncgctnnaacgnangncnaccgannactcantcanccgacactnanngngcncngcgcgcgctnctactctacctccgacannnntcngcnacancatcattacgcncacanaccncccatcacncaccccaaanacantncgtgcngncgncngcgcanngcacatnncgananaacnactccgtncgacngacgaatacacgctgtcagactcgctctanccgcgctgancttncgcacnctgcacgcactnnntcncananncgcgtcantngactctatacactgctcacgactcngcgcancgcgctangacgtntcnngccagacacaacaccgcacncannccngcnctgacgganccnctctcanacactccnccaacntccctcnccnnngcnatcngngacagcgacgcataccnncatnnacgctccgactcnnncgacncacnacncnngcatcnnncatncgaacgcaagancnncgcanncgcgcgtncagnncncgcctnacnncacgcncgcg

SEQ ID NO: 8101 - DNA, 878 bp, Homo sapiens
  misc_feature 8, 14, 33, 64, 67, 68, 84, 88, 89, 109, 111, 115, 123, 125,129, 131, 140, 148, 153, 155, 162, 166, 169, 172, 174, 178,179, 180, 181, 183, 190, 194, 221, 222, 225, 228, 231, 235,237, 242, 248, 259, 261, 283, 290, 297, 302, 310, 312: n = A,T,C or G
  misc_feature 320, 335, 337, 339, 340, 344, 345, 346, 347, 352, 356, 358,360, 364, 365, 366, 373, 378, 384, 391, 394, 395, 397, 399,400, 403, 408, 409, 414, 423, 434, 435, 437, 440, 441, 450,452, 455, 458, 463, 467, 474, 484, 486, 490, 491, 492: n = A,T,C or G
  misc_feature 496, 499, 500, 502, 505, 507, 508, 509, 518, 519, 525, 528,548, 549, 550, 556, 561, 570, 571, 583, 584, 590, 594, 599,615, 616, 617, 618, 619, 632, 645, 650, 653, 657, 658, 659,667, 671, 672, 673, 674, 680, 681, 683, 690, 694, 695: n = A,T,C or G
  misc_feature 698, 702, 705, 708, 713, 719, 720, 722, 723, 729, 736, 737,746, 749, 751, 756, 763, 765, 769, 773, 774, 777, 779, 782,784, 787, 788, 793, 796, 801, 806, 813, 822, 824, 825, 826,833, 834, 836, 837, 842, 845, 846, 864, 866, 877, 878: n = A,T,C or G
tagttatncggaanttgctggggggggggaatnaaatatttaccaccactcaacaaggaacccnccnnccagttagtcatttantaannagtaagctagatagatagantnctanaagtttangnaagntnaggaagctntcagatantttangnactcttnattntantanancagnnnngnatttaanttgngggggggggggtgtattattttttatnnaancgnttnactngntaagnaaatcnaacattctgtngnagtatcttatgtatgtactctncaacatnttaatantatantggtcatntntatgatgnttttaaataattgtncntnnatannnntgttnatancntnttgnnnttttacnacatntttttnattttantannanannttnaatannttatntagaaattnatactatattnncnttnnttatttatnanttnttnatttntagnttttacnaagtagttgntntttnnnttanaanntnttntnnntctaaaatnntaatantgntatcatattttattttttannntttttnttatntatttattnntatatatttgannttattnttcntcttnttttttattaattttnnnnnatttttcgtttgnttataaatcatanttttnttnattnnnatctaatnatannnntttctnnanattggangttnnttntganctnaanattgnttctanntnnaaattntattttnnattattttntangnttttnaatttanantatnctgnnttnanccntntannataancanatttntaatnatttcantatcaaatnannnactatcnntnnatccnatnntattatcgtttatataananctttcttatcnn

SEQ ID NO: 8102 - DNA, 711 bp, Homo sapiens
  misc_feature 1, 99, 313, 373, 480, 514, 518, 519, 520, 523, 528, 530,545, 549, 552, 557, 564, 565, 569, 573, 579, 589, 603, 628,630, 644, 648, 658, 676, 679, 693, 696, 702: n = A,T,C or G
nttcgattgacaagacaggttgctgaggggtcggcaagcatctgacttgcccaatcccctggatatggtgagccccgccatgcttttattctgtatcgnttttgtctttattgctgctttcaacatttacgtttggttacagttaactattttcggagtgtggtgattgaagacaatttcatcatcccactgtactttttttttgagagggagtttcactcttgttgcccaggctggagtgcaatggcacgatcttggctcactgcaacctctgcctcctgggttcaagcaattctcctgcctcagcctccanagtagctggaactacaggtgcccgccactatgcccagctaatttttgtattttttagtanagacggggtttcaccgtgttggccgggctggtctcaaactcctgacctcaggtgatccacccacctcagcctcccaaagtgctgggattacaagcgtgagccactgngcctggccttttttttttttttttaaaaaaaaanggcnnnttnttttngncccccagggctgggncttnganccccnggagatnnaaangcangccccncctggttttnaaaaaaaacaggtnaaccgggggcccccccccatttaancntttttataaaaaangganttcctgggcncaaaaggggaattttttnggngggggtttccgcgnaantggggntccaaaaac

SEQ ID NO: 8103 - DNA, 708 bp, Homo sapiens
  misc_feature 6, 139, 140, 142, 143, 153, 154, 157, 158, 160, 165, 173,177, 184, 186, 187, 191, 193, 194, 197, 199, 200, 203, 206,208, 211, 212, 214, 215, 222, 226, 232, 236, 241, 242, 243,248, 249, 251, 252, 254, 260, 262, 264, 265, 266, 270: n = A,T,C or G
  misc_feature 274, 275, 278, 283, 285, 286, 293, 300, 308, 309, 311, 313,316, 322, 323, 324, 327, 328, 333, 336, 338, 347, 352, 353,357, 359, 361, 363, 367, 370, 375, 379, 383, 386, 388, 389,397, 399, 404, 408, 410, 413, 426, 433, 440, 441, 446: n = A,T,C or G
  misc_feature 449, 453, 455, 457, 468, 469, 483, 488, 491, 495, 497, 504,505, 507, 509, 512, 529, 530, 531, 533, 537, 551, 552, 565,569, 572, 578, 579, 595, 598, 627, 628, 646, 649, 659, 663,679, 683, 687, 688, 689, 690, 692, 694, 698, 699, 700: n = A,T,C or G
  misc_feature 704, 706: n = A,T,C or G
gtttcncagatgaaacagaacaagtccatttttattttctttcactgcattgcatatggtactcaagttgtgttgtgtatagctaataggatgccattcacattttatacatcttttttttttttttggaaagggagtnncnntttgcccccnnggnngnagggnaggggccnaatntgggttnanngaantnnccncnnccnggntnaanncnnttttttngccnaacccncccnagaannnggaannanngncccccncnannncccngggnnaanttttngnnttttaanaaaaaanggggttcnncnanggnctaaannnccnnacctnggnanccccccccntaaanntttngncnangganggnaaatnattngggnccngnnttttaaancnaaatngggnanaangaaaaaacccctngtttatnaaaaaannaaaanttncccngncnagtgggggggnncctgaaaccccagntcctnggnaagncnggggcanngnanccncttaaacctggggggcnnngntttnaaaccccaaaaatnntccccctttaatnccanccngggggnngaaaaaaagaaaaaanttnttttctaaaaaaaaaaaaaaaaaaggggnntccctcccggaaggaaanttnaaaaaaaaanaaantttttttttttgtccncaantttnnnncncncccnnntaanancc

SEQ ID NO: 8104 - DNA, 686 bp, Homo sapiens
  misc_feature 1, 2, 543, 603, 620, 638, 641, 663: n = A,T,C or G
nntcattcggacgagtctgggccctaggcctcccaggagcaagtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaataccagtcttgggggcccctgtacatccaagagtctggtgaggagcangagttcgctcaagatccaagaaaggtcccgagattgcaagaatgagtacccagccccganggaatcagccagatganccagaaagggttttgaancanaaggggcttaaaaggggatatnaattttctggggattattcgcca

SEQ ID NO: 8105 - DNA, 1187 bp, Homo sapiens
  misc_feature 1, 7, 14, 23, 26, 27, 29, 32, 35, 36, 37, 39, 44, 50, 52,58, 59, 67, 71, 74, 82, 88, 92, 111, 119, 125, 126, 128,136, 139, 141, 142, 144, 152, 153, 154, 155, 162, 163, 164,165, 168, 169, 179, 180, 184, 190, 195, 197, 205, 216, 220: n = A,T,C or G
  misc_feature 222, 223, 227, 231, 232, 237, 239, 240, 241, 248, 249, 250,252, 255, 258, 261, 262, 268, 274, 282, 294, 298, 299, 300,301, 304, 306, 307, 308, 312, 313, 321, 322, 323, 324, 326,328, 335, 339, 342, 348, 350, 356, 359, 360, 361, 364: n = A,T,C or G
  misc_feature 365, 374, 375, 376, 379, 381, 384, 388, 391, 396, 402, 404,405, 410, 411, 416, 420, 422, 423, 424, 426, 429, 430, 441,445, 448, 451, 453, 454, 455, 458, 465, 473, 476, 480, 481,486, 489, 492, 494, 500, 508, 510, 514, 520, 522, 526: n = A,T,C or G
  misc_feature 529, 530, 531, 533, 538, 545, 546, 547, 549, 550, 551, 556,558, 567, 570, 576, 577, 579, 583, 584, 586, 588, 591, 592,593, 600, 601, 602, 607, 608, 614, 619, 624, 628, 629, 633,634, 637, 639, 642, 644, 647, 648, 658, 662, 665, 668: n = A,T,C or G
  misc_feature 669, 670, 673, 675, 677, 683, 684, 695, 698, 700, 704, 706,707, 714, 717, 718, 721, 724, 725, 733, 737, 738, 739, 754,756, 763, 765, 768, 770, 771, 774, 778, 781, 782, 793, 795,802, 803, 811, 812, 817, 821, 825, 835, 841, 844, 847: n = A,T,C or G
  misc_feature 848, 849, 850, 858, 859, 866, 871, 872, 878, 882, 883, 889,890, 891, 893, 897, 901, 902, 907, 913, 915, 916, 920, 922,925, 927, 929, 933, 935, 936, 939, 941, 942, 944, 957, 960,961, 966, 968, 969, 970, 974, 981, 983, 985, 986, 991: n = A,T,C or G
ntcactntttcgtntctgacacnacnntntcnacnnngncaacnctgacntnactaannaaacgcantctncgntcatactnctcctntcgntatacaagtcgcatttccnctaactcncactcnncncatcgcgncangnngnagtaaccnnnnaccaaannnnaannatgatctcgnncccngtattnagggngnaaccgtgngtcaatataanaccnannagcncccnnaatcngnnnatcctannncnaancanctnnatatangtactnatcattanatcccttaaacntaannnnacntnnnaaannaacggggnnnnantnttaaaanttanganatcgancncataanacnnncanntactcctgnnnaangncanatanaanaatangcaatnanntcaannagtanacancnnntnacnngccctgataanaatntantcnannnctnttaccantcaactgncanaaannatgcnacnaantnacccanaaataagntnaacntactcntnactnctnnnantctanctatttnnngnnntaaancnctgactatnccnatactnncncttnnanantannnatataannnctgtnntttacnctttncccancaannttcnntcncncantncannactgaatcancaanatncannnccntntntatcannactttgaactnagnanatcnanncaatatnatnntanatnnctgacaantaannnagcattgaaaaaagncntcaatantnttnanncanacantannataaagcctgngnattacanntatcactnntacanaatnttanatccaaatanaaattnaanaannnnccactaanntgcaatncaatnnaaattnttanntctaannntnaatnatcnnaaatnaaactnannaatnanaangnantcgnannaantnncnaccataactaaanctnncatantnnntatnccttccncncnnaaacntnccnacctgaatccatanaataatcnannnnnngncacttnnttnannnananagcntnntcanantcnngtaatnnttcanctnntttnnagcaatctatnannanannangnatnggnnaaaaaactnncancagananncttcccnatcnttatcgnnantcaaancaagacnnngttantattanacaccc

SEQ ID NO: 8106 - DNA, 1055 bp, Homo sapiens
  misc_feature 4, 5, 6, 7, 8, 10, 13, 18, 21, 24, 27, 29, 34, 37, 38, 40,46, 49, 52, 61, 63, 65, 71, 74, 75, 78, 79, 86, 87, 96,100, 101, 102, 111, 116, 117, 128, 136, 142, 149, 150, 152,162, 164, 167, 171, 173, 181, 203, 204, 222, 223, 232, 238: n = A,T,C or G
  misc_feature 245, 251, 258, 262, 264, 274, 282, 283, 284, 286, 292, 296,302, 308, 311, 315, 321, 324, 326, 330, 335, 345, 346, 349,353, 354, 355, 358, 359, 362, 363, 365, 366, 368, 369, 378,379, 382, 386, 389, 393, 399, 400, 404, 407, 410, 411: n = A,T,C or G
  misc_feature 415, 416, 418, 422, 423, 424, 426, 427, 428, 439, 440, 444,446, 447, 448, 449, 451, 458, 463, 465, 471, 472, 474, 477,478, 484, 487, 496, 499, 505, 507, 510, 511, 512, 513, 516,517, 519, 525, 527, 529, 533, 535, 538, 541, 542, 544: n = A,T,C or G
  misc_feature 546, 547, 559, 562, 566, 573, 581, 586, 587, 601, 603, 606,609, 617, 620, 621, 623, 631, 633, 635, 641, 645, 646, 648,658, 659, 665, 669, 670, 672, 674, 677, 679, 682, 683, 684,686, 693, 699, 700, 702, 707, 709, 712, 724, 733, 734: n = A,T,C or G
  misc_feature 735, 746, 758, 765, 766, 768, 769, 774, 779, 781, 782, 787,790, 800, 807, 823, 830, 837, 838, 845, 849, 853, 859, 865,868, 898, 903, 911, 919, 921, 922, 924, 926, 934, 940, 945,946, 949, 955, 968, 969, 971, 973, 980, 994, 1000: n = A,T,C or G
  misc_feature 1001, 1006, 1013, 1021, 1027, 1033, 1034, 1043, 1045, 1050,1051, 1054: n = A,T,C or G
tctnnnnntntanaattntcnacnttncnttatnaanntnatatcnccntcntaagtactntntnagggcnaannaanntttaaanntcgcccttnttcnnntttaatatnttttnnatttccttatnaaaatatnatacantcggggnntnactcatatancnagntggnanagccaccntttgaaagctctgatgtaattnnaaaaagaaatcaaattannggggggggnttttanagaaatncctccnaagcttnacangnttgtttatgngcattatnnntntaactngtgntttatnattcanttnatanaggccntantnttcnagatnaaactcaatnnttntttnnnatnnctnnanntnnatatattanncanttantanatanattctnncttnaanaanncgtnnantgannncnnntataaatcttnntttntnnnncncttatanacttnantcatgnncnatnnttaatnttntaacaaaangtncattcngnttnnnntannanaaaatnancnttanancancgnncnanntttgtaaccaanatngggntttgggnttaaacancaccnnatttttttaaattntnctnttnaccaatgnttnngntggtctcnantnatgganaaanncnaaaatcggtnnacattnctgnntntncantnatnnntncctatangcaaanncnctaangnatnttttgtgatctnataaaaccnnncaattcattcngggaggctaaantcacaanntnntatgnagcantnntatanttntatttttatnaccccangtgtaccataaaatangcatatnagaaaannacacccnccancttnggatanacaaantcnacatagtcgcaagagaaaaaatacatcctntttcncaaaaaangatcggtnannantnaaaaaacncacaanatttnntcntatctnacagctccactcnnananagaaaanataagagggacgtnattatnnctagnaatagtntattattncactcnttgtgnnacctccacncngtgtnnttnc

SEQ ID NO: 8107 - DNA, 673 bp, Homo sapiens
  misc_feature 551, 583, 623, 630, 641, 667: n = A,T,C or G
gttcgattcgcacgaggtgcgtctagaggaaatgtactgttttgcagataataagtattgatcagacatgcatttttacctctgctgtgggattttagtctcattactttgttgatctactttgtagttaacctagagaagttaacacagccattgctacagagctttctgccacttgagttccagaattccagaatccagtttcctagggattgtggggagtaaaaagaggtatagggtatggtccctgtatgggagcaatacagtctttattgagtagtgtctatattgtcttgtttactcaggtatttcatatatacattaaaaaaaccgacaataaaaatgaacatatgaaaacttccttatttgtgatacatgagtaaatgttgatgagattagagaaggggtccaaaaaggtttctctgaggatatgagttgagttgcccatcaggatggattgggtagtggatgctgatgtgggcaaacactggaatagacctcagatgctgcatgatgtgcctgtgtaacacagttgaaatttggtgatcaangggacatattacagcagggtagggcaacccgnctaaaaaatgacttggggtcctttaattgggttatgttgnacatggnggaaagaaganaaggccccgaaatgaccatggcatanaaaata

SEQ ID NO: 8108 - DNA, 678 bp, Homo sapiens
  misc_feature 1, 3, 14, 45, 100, 438, 615, 620, 669, 672: n = A,T,C or G
ntncgaattcgcgngagggaatctccaccctgtgctgttttttancaatatataataaaagccaacatttattcagcactgaagtattttatacacattngctcacttaatttttacaacaaacctgtgtgggaagtactgttataattaatcgtcattttcagataagaaaatagcagctgaaaaagtaaaaataatttcctcaaagacagccagggcttaaatcaggcctttctgatgtagaccatgctcttcactaccacagagttccatgctactttctctccctctccctcctctcctgtccctgctacacacacacacacacacacacacacatgcacactcactcacacacactaggaggaacaaatgagatcattcacatgaaagcacttatgtttctgaaatttaagggactgtggtttttatctaggntgacctctcaagctaaaaactgggaaccagaataatggactgaaacttgggtttcacttccagaccagtgttgatcctctgaattgatgaaactgtatagatttccctcttggatgcccctgctaacatggatttcctttcactcaattcctaatgcaaatatttgctgaccactgnttaanaatgttacatgcctgcattacattggatattttactatttggggggttngtntaactt

SEQ ID NO: 8109 - DNA, 658 bp, Homo sapiens
  misc_feature 1, 5, 22, 40, 546, 571, 656: n = A,T,C or G
naggngttgagaaccgagctantaaatcaaccagtcaganaggccctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccanggcgagtgggaagcccgtgtgacanaacccacccttgaggatggcctgtccaaggaaactggtaacttattcatagtcctattgggacagcaggagcagcttctacaggnga

SEQ ID NO: 8110 - DNA, 669 bp, Homo sapiens
  misc_feature 3, 4, 5, 6, 7, 9, 11, 31, 35, 38, 40, 42, 49, 551, 585, 613,615, 618, 625, 643: n = A,T,C or G
ttnnnnnantngccgaggtgacattgtgatngcanganangntaacaanttattaatacaaatagtactgtatatgagagtacacattaggaatgctgtgctttaatgcataaacatgtttacagtggtccacatgtgccaggagatgtgggaatggctacccctgaagtcatatggagaaatggggtcctcatcgcacaccatacacaaacatcatctcacaaatggattaaagacacttaagacctgaaaccaaaaaaactcctaggagaaaacacaggggaaagctccatgacatcagtttcggcgatgatttttttttggacatgacactaaaagaacaagcaacaaaactaaaagtaaacaggtgggattacattgaagtaaaaagtttctgcacaacaaaggaaacaaccaacaaaatgaaaaacgaacctgtgaatgggagaaaatacttgcaaactgtatatccagtaaggggttaatatccaaatacataaggaactcatacaactcagtggcaaaaaccaaatacccattgaaaaatggcnaagagccatagtagacattttttcagagaagctnttcagatgggccacaggtatatgcagangnctnagcatcnccatcccagagaaatgcngtccccacagtgagctgtcactggtt

SEQ ID NO: 8111 - DNA, 689 bp, Homo sapiens
  misc_feature 2, 3, 7, 13, 18, 21, 23, 28, 32, 42, 46, 50, 58, 61, 62,65, 70, 76, 77, 80, 93, 97, 106, 109, 116, 124, 128, 132,138, 145, 150, 155, 167, 173, 175, 180, 199, 208, 211, 213,221, 223, 224, 230, 236, 250, 251, 259, 262, 267, 269, 279: n = A,T,C or G
  misc_feature 283, 285, 295, 298, 312, 317, 321, 323, 328, 334, 336, 340,343, 351, 354, 357, 358, 361, 363, 381, 382, 390, 398, 406,412, 415, 417, 426, 432, 440, 444, 449, 465, 480, 486, 487,495, 496, 497, 498, 500, 501, 507, 508, 531, 534, 535: n = A,T,C or G
  misc_feature 548, 549, 553, 560, 571, 572, 583, 585, 586, 596, 601, 612,613, 619, 628, 635, 644, 645, 647, 649, 650, 651, 661, 664,673, 677, 682, 686: n = A,T,C or G
cnncacnatgagntgtgngtntntgcgntgcnattcacctcntatncccntacgtgtngtnntanccagnactctnnaantgacctggtgatnaagngacggctgnccnctgtgcnaatgttgngggncaanggagcnatttatnatcanttttntaaacctggtgnaatcantntgcgnattgtggataccacccaantcccatgtnttnanggaaaggnanntctctntcccantccaaaatggcctnnggttgganggncatgnancctacgcctntaananccagaaattngtnggccctgcatgcantgtgncaanangaccngtgctngnaccnttnagcccacntgntannccnantctactaacgcttggagnncacccggnccatggtnggcagtgnctgggnaananattctactnagggangctgccgngctnaaaanggggcttttacccccnagacgggaaattgtngggaannggaggagnnnnannaattgnngcttcctggcttggggcaaccanganntggaaaacttttnnttcnaatcccnctccttttagnnaaaaaaaattngnnataaaacccncccanaaataaaaaanntttccnaattttttngttcccngggcaaaannantnnnttttattttntgnatcaaaagnaaanttttnctgncct

SEQ ID NO: 8112 - DNA, 670 bp, Homo sapiens
  misc_feature 3, 20, 571, 575, 577, 582, 588, 590, 592, 594, 597, 600,603, 606, 610, 617, 621, 638, 660, 662: n = A,T,C or G
ttntcgattcgcacgagggnacccacagctctcatcagaagcagacacagatactttttgtaggaaaacatctctaacttaagcctgtaggattcccaaagattaaaagcaggcaaatatgaattcagtcaaatcatagcattcaagtagtctcaacccaacatatttgagaattgttagaaacaatgaatatgtttcccaaagactaggttttggaattatcagatacagaacacagacttcaaatattagaattgtgagaaaatagttacatgtcaaacctaatataaaagaaagatggactcattaaattgagcaacagaaaggccaccaggaatgaggaggaggacctgaaaagaaaatggatgaactagaacttacagaaataaaatatatagctgggtctggtggctcacacctgtaatcccagcactgtttgggaggccgaggtgggaggatggtatgagcccaggagttggggagacaagcctgggcaacatggtgagaactcgtttctgtaaaaaataccccacacccccaaaaaaaaaaaaaagtccttgggtttggggcncgtntntgtancccacntngncnggnggntgnggngggnggatccnttgnctagggggcaagggctngattggccttcccctggaaccnancctggggg

SEQ ID NO: 8113 - DNA, 718 bp, Homo sapiens
  misc_feature 21, 25, 36, 94, 98, 113, 114, 116, 119, 127, 130, 165, 168,173, 177, 186, 187, 198, 205, 206, 207, 208, 226, 230, 233,243, 252, 262, 266, 275, 278, 286, 289, 293, 296, 300, 303,308, 313, 324, 325, 343, 352, 353, 354, 363, 378, 380: n = A,T,C or G
  misc_feature 383, 395, 396, 406, 409, 412, 413, 421, 424, 425, 436, 443,456, 458, 463, 466, 474, 475, 477, 486, 496, 502, 505, 506,510, 513, 522, 523, 525, 535, 541, 543, 562, 565, 569, 580,586, 604, 623, 632, 658, 665, 672, 682, 684, 686, 688: n = A,T,C or G
  misc_feature 694, 695: n = A,T,C or G
ttttcgattcggcgcgagacncacngagagagagcncgagagagagagagagagagagagagagagagagagagagagagagagagagagaganaganagagagagagagagnnanagngagagagnganagagagagagagagagagagagtctctctctcttncgnctctngctntctgtcttnnctcccccccanatagagnnnnctcctcgttcctgggggngtcntcnctctctaccntctttgcgncggatctttntctnataccgggnctnctgtcccnctntgtnagntcanccnctctntgtgnccccctctctnnacgcactctcactctgtntttgtgagnnntaaagatcnatcttgtgtgggtgngngtnccctttttgctnnccttcttttnttnaanntgccttcnctnnaccctttctcncttttanatgccactctctntncctgngcncctccccnnanggcgggganatatatatgngtcccnccnnccgngcntgaaacacnngnctctctcctntggggncnggcaaggtcccctcttctnttntctnggccccccccngaaaangggcttccgggccgcccnctttggcagcccccccttncccccccangacccttggcttcgtgaagtggcgtnttgggtncagggangccccccccncncntntttccnntcttaagggcttggagattcccg

SEQ ID NO: 8114 - DNA, 683 bp, Homo sapiens
  misc_feature 8, 481, 519, 527, 554, 557, 604, 617, 621, 638, 650, 655,659: n = A,T,C or G
gtttcgantcgtgcgaggaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctntccgaactcaaatggaagaaataccttatgaatgtaangaatgtanggggtcatggcttgtaatttacccagngtnaatgaaaccatcctagaggattattgagggaatcctttctatgtganttttcaatcatancaangcaagaaaggcttcccntgttcaaggtanttcancctnttacagggatattaaaccagcccg

SEQ ID NO: 8115 - DNA, 1120 bp, Homo sapiens
  misc_feature 35, 48, 51, 57, 87, 97, 98, 99, 100, 103, 106, 115, 116,118, 121, 123, 124, 130, 134, 135, 137, 142, 144, 145, 150,151, 156, 159, 160, 162, 163, 170, 171, 175, 192, 195, 196,197, 198, 199, 201, 208, 211, 212, 213, 217, 218, 231: n = A,T,C or G
  misc_feature 236, 241, 252, 253, 256, 258, 259, 262, 263, 265, 266, 267,269, 270, 273, 276, 278, 280, 281, 287, 290, 292, 293, 294,295, 300, 303, 310, 313, 314, 319, 321, 327, 329, 330, 332,336, 337, 341, 342, 343, 345, 348, 350, 351, 352, 353: n = A,T,C or G
  misc_feature 359, 367, 369, 372, 373, 374, 379, 384, 387, 396, 397, 399,407, 408, 409, 411, 422, 425, 428, 430, 431, 432, 434, 438,440, 445, 446, 447, 448, 453, 462, 463, 473, 487, 489, 494,496, 497, 502, 503, 505, 506, 512, 514, 519, 521, 522: n = A,T,C or G
  misc_feature 527, 530, 542, 545, 552, 557, 558, 562, 563, 566, 567, 578,584, 589, 594, 598, 609, 613, 615, 617, 622, 628, 630, 632,634, 639, 649, 653, 655, 657, 663, 666, 669, 672, 684, 693,694, 695, 696, 699, 703, 704, 706, 709, 712, 716, 722: n = A,T,C or G
  misc_feature 725, 733, 737, 742, 747, 748, 750, 752, 756, 762, 763, 764,765, 770, 774, 776, 780, 782, 784, 792, 797, 799, 806, 812,816, 818, 819, 826, 835, 855, 856, 860, 870, 879, 881, 882,886, 889, 890, 892, 893, 897, 905, 913, 916, 919, 920: n = A,T,C or G
  misc_feature 925, 929, 934, 937, 939, 941, 948, 950, 954, 960, 962, 964,973, 979, 982, 985, 1002, 1009, 1013, 1015, 1020, 1026,1037, 1039, 1050, 1051, 1057, 1068, 1070, 1072, 1077, 1082,1083, 1086, 1089, 1107, 1119: n = A,T,C or G
gcattgcatatggtactcaagttgtgttgcgtatnagctcacaggagngcnagttcnggattttatacatcttttttttttttttgnaaagggaaannnnctntgncccccaggnngnagngnngggccncaannangcatnanngaaanncccgncgnnannaaatatnncccnttctttggcctaacccnccnnnnnancgggaanaannnggcnnccaaccaataaangaccnggganaatttatttgnnttntnnaannannnannaanacntntnnccaccnatncnnnnctccncangaactcnccnntaacntncttaantnncntccnnttannnanctnannnngcatcnaaacatcncntcnnncacanacccnaancaataaacnnanagtggttnnnanaactaggggancangcncnnncnagancntaaannnnaattnacttcacannatcatctatntatctataacacanangctancnntattnncnntctctntncgcancnncacanctnacacatagcgcnatnctcagcncatcnnatanngtnnagtacttcacngaagancgcgncctcnacanagtatagagancatngntngagangacaananancncgatnataacagtanatcntntngtacancgnagnccncggcatatatcncaccgatcnnnngcncacnnancanatncacnccggtnagnatacaaanccanaaacntcgtnncncnctanctcaannnntaaantgcncnatcncngngtccaccncacantncgtcgtntcgcancatntnnacacgtntagcgatcntgcgcacatatcaccgcaanncganacatactatngatcgcacncnnaacnggnntnntcancgacacanctaccatncancanncgttnaagnactancanananagatggntntacncatcgnancncactgcagntcatanagnganatatatacttttatacnactctcntgantncagancacatntgcacacacanangtacatatacnnactagnacacgacatantntntatanataanncanacncactgtacacacactganatatcgcataanc

SEQ ID NO: 8116 - DNA, 1361 bp, Homo sapiens
  misc_feature 3, 7, 9, 10, 14, 15, 16, 21, 23, 24, 35, 36, 50, 52, 58,62, 71, 74, 85, 86, 87, 92, 98, 100, 108, 117, 124, 129,132, 140, 147, 157, 161, 174, 185, 187, 191, 198, 201, 203,206, 207, 213, 214, 215, 220, 221, 223, 232, 233, 238, 240: n = A,T,C or G
  misc_feature 241, 244, 245, 248, 251, 253, 255, 258, 260, 261, 270, 271,273, 276, 277, 285, 290, 293, 305, 310, 311, 317, 326, 328,332, 333, 338, 347, 351, 361, 364, 367, 372, 375, 381, 384,393, 398, 399, 403, 412, 418, 422, 423, 425, 430, 432: n = A,T,C or G
  misc_feature 434, 436, 442, 445, 449, 457, 460, 463, 470, 472, 473, 475,488, 491, 494, 495, 496, 500, 502, 503, 506, 507, 516, 518,521, 522, 523, 524, 534, 535, 538, 540, 542, 543, 544, 550,554, 555, 557, 558, 560, 561, 564, 565, 567, 571, 573: n = A,T,C or G
  misc_feature 575, 576, 578, 585, 588, 592, 596, 597, 598, 602, 603, 604,605, 608, 613, 619, 621, 625, 627, 628, 632, 633, 634, 639,647, 655, 663, 665, 679, 681, 682, 686, 691, 692, 694, 696,697, 709, 713, 715, 719, 723, 725, 726, 731, 733, 744: n = A,T,C or G
  misc_feature 745, 746, 752, 759, 760, 762, 768, 769, 770, 774, 776, 777,779, 780, 784, 788, 792, 794, 799, 802, 804, 807, 812, 814,819, 826, 827, 837, 843, 844, 850, 853, 856, 857, 858, 862,863, 864, 875, 877, 884, 888, 895, 901, 906, 912, 920: n = A,T,C or G
  misc_feature 927, 934, 935, 944, 945, 956, 958, 961, 966, 970, 973, 977,982, 984, 999, 1002, 1005, 1008, 1013, 1016, 1021, 1023,1026, 1028, 1029, 1031, 1041, 1042, 1046, 1048, 1052, 1060,1062, 1067, 1068, 1079, 1084, 1091, 1093, 1095, 1097: n = A,T,C or G
cantaanannatannncgttncnnacttaccaacnncgtacttacgaatntnctaagntctnacaaaaacncgnacttgcagtcnnnctctntctcananaaaataancttactccncgaactntatcngcntctaacgncatctcntcatatcacncatntctcaaatctaancatagctgctnantcanttacatntcntnatnnttagtnnnatatnntncatcactcnnctcancnngtnntcncantntncgnanntcggccacnnangtnnaatccctnatggnacncccacccagctncctcnntacttnatcgtgcancntcanntaaantcattgaangatntattctacanacntantttanccnccaatnacnaaaaggggnatttnnaaantatcacacnttaacncatnnanctacntnananccctanaanatanttcactcnctntcnttcaatncnncntcaacacttaatntcntannnacantnntanntcgaacctnanctnnnntctgactgtnntanantnnncattanaaanncnncnnaannantaantnannanttctaanctnttcnaaannntatnnnnatnccttncttttntntatntnnaacnnnttacnttatattnttttcaantcacaatnancaacacatattatnannactnttaanncntnnactacaatctanaacntnatanatanannacatnanattaatacccnnnatgacncgttttnnanattatnnntatnannannctcnattnaccnanagtcnaanantcnatctncnacttncggagcnnagaataaccntaatcnntctctntantcnnntatnnncacatccatcnangtagtancacnctacaancctctnaacangcacangtaacgcnctatatntcataanntcataactnntcactacaccntncanatctnactncgntatnaatananctgactatatctctncanatngantactngancactntnatncnntnaccctcactnngatntncgcntacacgcncntaganncaacacattcngatanactcacngntntncntagcnatctcacatatctcatctnaccncncatcanncncnaatncancntnncnnanatnnctatctnatatntacaanncntttatnactcacgtcncncaaanagatcnacatttaannncatnancantatcntacacanatacatcnnattncncntccntacacnttgggatatattnatctccacgtnaganacatcgccatatctncgaatcanntnncntcatatctnatnacntacaccnntctnagnannc

SEQ ID NO: 8117 - DNA, 845 bp, Homo sapiens
  misc_feature 10, 16, 17, 34, 35, 36, 37, 38, 39, 40, 51, 71, 72, 75, 78,82, 98, 102, 110, 129, 137, 161, 187, 212, 245, 263, 331,449, 458, 513, 532, 547, 557, 565, 570, 588, 608, 619, 622,623, 643, 650, 685, 691, 704, 730, 732, 742, 743, 753: n = A,T,C or G
  misc_feature 756, 758, 766, 771, 776, 777, 785, 795, 800, 814, 832, 836,841: n = A,T,C or G
atatcctttnaactcnngtctttttgcaggatcnnnnnnntcgaattcggnacgaggatgcacgggcactnnggnggntttngcggccactctgagtnagancatccagntggcggtggaactgaaggnttccatgngggacctctattccttctcagctntcatgaaagccctggaaatgccacanatcacaaggttagaaaagacgtggnctgctctgcggaaccagtacacccaaactgccnttctctatgagaaacagntgaagcccttcagcaaactcctgcatgaaggcagagagtccacatgtgttcccccaacaatgtatcantcccactgctgatgccgcttgtgacgttaatggaccgccaggctgtgacttttgaaggaaccgacatggtgggaaaaaaacgaccagagctgtgaaatcatgcttgaaccatttggcnacagcgccnattcatggccgaggctgcaagacagctccggatgaatgctgagaggatctggcanggtttcaacccagatgaangaaatgaatgaaaanttgcaagacntgaatttnaaatnccaattgctttgggggcnagccaaaaggtgccccaaantccaattcaanacnncagaggattttgaggaaacntcaaccnagatttttaactggccccttttcgccgttaaaatngggaancctccccccctgntaaaagcaaggccagaacttttttantnactcttccannaaaaaccccnttnanaatattcnttttnaaagnnttcccccncctttaattnttttngggaaaaccttacntgttttttggataaaaanaatnatgtnccaa

SEQ ID NO: 8118 - DNA, 805 bp, Homo sapiens
  misc_feature 33, 34, 35, 36, 37, 38, 42, 46, 47, 48, 50, 76, 100, 104,105, 109, 112, 154, 163, 171, 176, 193, 207, 215, 225, 386,404, 498, 573, 574, 575, 579, 581, 583, 586, 587, 588, 591,593, 594, 595, 597, 598, 599, 600, 601, 602, 605, 606: n = A,T,C or G
  misc_feature 608, 610, 611, 612, 616, 617, 620, 621, 622, 623, 624, 625,626, 628, 629, 630, 631, 632, 634, 637, 638, 639, 640, 645,646, 647, 648, 649, 654, 659, 689, 693, 695, 696, 707, 708,713, 715, 718, 720, 722, 726, 727, 728, 730, 752, 757: n = A,T,C or G
  misc_feature 766, 768, 779, 780, 786, 787, 791, 793, 798, 799, 800, 805: n = A,T,C or G
tatccttcaactcttgtctttttgcaggatccnnnnnntctnttcnnncnagggcagacttctcatccgtaaaatnaggaagataacatgattccaaggncgtnntttnggnttaaaggaagtcatgctcctaatttactgcctggcacacagncagtaaaangctcaatncattnatggaaggaatgaaggnctctggcagaaaancaggtcanatgtgtctgntgtggacaggtggctctgtcggtgcccggtgagtgccctgggagtctgcagtcacctcctccgcagccgtgtccccaggctcacaggagccacctcaggtgggaagctctctgccagccttgggaagaccagactcacagctccaagccacgtgtgagcanggagtgcttgcatcccanaaagtgtctgcctcagcaggctggagattgggatccccctatgaaatgggtgggtgtgtgggcactaaaaaaggaagattggctctgtttcaanaaacttttaaaattcactgtactggtttttattattaccaaagtaatgtatgctgattatagaaattttaccccnnncccncntnccnnnccncnnncnnnnnnccnncncnnnctcnnccnnnnnnntnnnnncnccnnnnccccnnnnnaaaanccccncccccttaaaaaatttgggggggccttttnctcncnnccccccccctnnaaacncnccntntngggnnntngggccccccccccctcttgaanccgcngggaaaaananttttttttttnnaaaaanntcgngnacccnnntcttn

SEQ ID NO: 8119 - DNA, 1335 bp, Homo sapiens
  misc_feature 6, 9, 12, 17, 19, 23, 25, 26, 27, 38, 39, 44, 48, 50, 52,55, 73, 75, 76, 77, 78, 79, 85, 91, 94, 95, 98, 106, 108,112, 116, 121, 138, 151, 154, 166, 167, 175, 176, 177, 179,181, 185, 188, 194, 203, 206, 221, 222, 228, 230, 232: n = A,T,C or G
  misc_feature 240, 242, 247, 251, 252, 253, 254, 260, 261, 262, 264, 267,270, 274, 276, 277, 279, 286, 287, 292, 294, 301, 304, 305,311, 318, 323, 325, 327, 329, 336, 337, 339, 340, 351, 358,363, 364, 378, 385, 390, 392, 395, 399, 402, 409, 411: n = A,T,C or G
  misc_feature 412, 414, 423, 426, 431, 437, 443, 449, 452, 468, 470, 476,477, 480, 492, 495, 496, 501, 515, 518, 520, 525, 527, 530,534, 539, 541, 545, 548, 549, 550, 552, 555, 557, 559, 561,565, 567, 574, 575, 576, 587, 589, 606, 607, 612, 613: n = A,T,C or G
  misc_feature 614, 620, 625, 626, 632, 634, 636, 640, 652, 654, 655, 669,670, 679, 680, 692, 697, 699, 700, 703, 704, 706, 713, 714,716, 734, 735, 736, 753, 755, 757, 760, 771, 781, 784, 787,788, 789, 793, 794, 795, 806, 807, 810, 814, 815, 816: n = A,T,C or G
  misc_feature 823, 833, 840, 845, 848, 851, 854, 855, 857, 859, 863, 866,868, 869, 872, 874, 879, 881, 890, 893, 905, 908, 920, 922,925, 926, 944, 951, 952, 953, 954, 956, 962, 967, 970, 973,974, 978, 981, 982, 985, 988, 991, 993, 997, 1007: n = A,T,C or G
  misc_feature 1009, 1015, 1016, 1024, 1026, 1028, 1034, 1037, 1038, 1042,1044, 1063, 1064, 1065, 1073, 1075, 1091, 1095, 1096, 1110,1112, 1113, 1119, 1121, 1123, 1126, 1128, 1132, 1133, 1137,1138, 1140, 1145, 1147, 1150, 1157, 1158, 1165, 1166: n = A,T,C or G
aggggnggnggngaccntngggngnnnagcgggggccnncaaanccanancnatngggatctgggcccactcncnnnnncgatcncttatncgnngangtaggaanancggnagtnaaacnccgccccaacgagagangacgggggggggnttntttctatgtctnncgaacgcnnngncncccnccntatctnccgcctccntancacacatatgtaganncactantncntactacancncgccncatnnnngcatgnnngnganctncgancnngncacacannggggntngagtacncanncgggangataagngcacnantngngccatgnncnnaaaaccggacntggcgcncccanngacaccggagagtnggcctgncaacngncgnacanagngttgctntnnangccccgcanacncttanagcacngcaccnagaggngangcgggaacacaaacgngnacccgnngancgggagcggatnganngaaanctcgggaaaagganggnancaatncnaancagngtagngnggcnccnnncnccnancncngtangnacctgannnccgtaccactncncgccatgtgaaaacgtnngagtnnnaagacnacggnngcgganangnatcnactccgccccgntnnacgcgcgacgcacnnagactcgannccgcgcaatggncgcangnnaanncncctgcgnngntagacatgagcgaatgannncacgggcagatacacangntngcncccgggatatngcacccccanccnatnnncctnnncgccgcacganntancccnnncggcgantcaagatgcnctatccncaacnaanggnccnncnancatngantnnaananagagncngtatatctnctnagggaaagcaanatncacacaagacgnancgnntgactgccaccaccgtgngacacannnntncgatancgctnatnccnntacntgnnganttngcntncatntgcgcggaancncgactnntaatgaancncngccgcngcnnatancncacggaaccgcaatacggnnncgcgtacngngacgagagacgccganatannaccgccgaatggtnannacccantngntgncnactnnaggnncnacccncnacngtggtgnnctcgcannaagatnncgtntcgcccnntncncnnccnncccntgagnatgcgancgncccacggaccccgccnacganacanncgnnccnccntcaaaaacncgncngcgcnnnccacnncgcncgngnngtgnanangtacagcntttaccgcggaagcnggnnntntntnagagn

SEQ ID NO: 8120 - DNA, 877 bp, Homo sapiens
  misc_feature 4, 10, 33, 34, 35, 36, 38, 39, 40, 41, 43, 46, 49, 50, 51,52, 68, 77, 82, 111, 113, 137, 146, 150, 160, 166, 185,187, 220, 238, 260, 283, 347, 382, 388, 413, 432, 463, 472,476, 487, 564, 608, 638, 656, 657, 692, 695, 710, 730, 751: n = A,T,C or G
  misc_feature 755, 757, 772, 773, 779, 783, 784, 788, 790, 796, 803, 815,838, 842, 846, 849, 856, 869, 872, 876, 877: n = A,T,C or G
ttancctttnaactcctgtctttttgcaggatnnnntnnnntnganttnnnncgagcctaagcaggcntctgcagcnttttntttccagaaaagaaattctcaaactaatntnaactgaggaagtgaaagaagaaantcttaaaantgtnttatctgaanccccanctatatgtcctcctcaaancnctgaaaaccaaaggccaaagaccgggttccagntgtggttagaagaaaatngaagtaatattttgtctgacantcctgacttttcagatgaagcanacataataaaagaaggaatgattcgatttagagtattgtccaactggaagaaaggaaaggtgtnggggcttaaccaaagcccaaagggagaaaacggcnaaggtngaaagggaacctggaagccaaaagnaagccgaaaaaccgtggtnggttggatggaaaaggtggatggaaaacacnaaaaacccngggnaaagaaaaaangccaaaaggagaaccctggaattttggttcttaaaaagccaagaaaaccctttaagattttttcttaccaaattcanaaaacctatccagctttttgcctttttaaagcagggagttaaanggaagaaagtgacccctaggggaagtcatnggattttttttttactcnnctttttgaatatagactcgagtctttggggaaacntcntcttttatatttctnttaaagaagtttggaagccncctgtttggcctttataagantaangnagtaattatattggnngtaggntacnnggcntnttgttnaaacctntcatttttgcanaattcttctgcctccaaattgcngggncttncanagatgcnttggggattgcanttnctgnn

SEQ ID NO: 8121 - DNA, 708 bp, Homo sapiens
  misc_feature 1, 5, 7, 469, 470, 475, 477, 488, 492, 493, 496, 497, 500,519, 521, 527, 528, 540, 548, 554, 565, 568, 570, 577, 592,595, 602, 609, 612, 613, 614, 618, 625, 638, 641, 642, 656,661, 668, 680, 686, 687, 695, 697: n = A,T,C or G
nttcntnggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttnnaaagngnacaaaattttnatcnntcnngtnggggggttaatttttttgngnaaaaannaaaaatgggttngtttttanttttanagggggaaaangcncnctttccncccaaatgggttttngcnaatttantgggggnggnnncgcntttgggnaaaaaaaaaaggnccnntttttaaaaggggnaaacnttccccnttttaaaaaaangcccgnnttttgggngntttaaaaaaaa

SEQ ID NO: 8122 - DNA, 673 bp, Homo sapiens
  misc_feature 6, 13, 34, 35: n = A,T,C or G
gtttcnctgactnttaccttcaagtatggaaatnncagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggttcaaaaacaactgtacacatacatatctgcagtgtcttcactgaaaattagagatagaattagttgaagagacttccttaattgctacattgttttactcactgagcaatatcagaaactaaaaacatagattaataattcactcactggttctattcttcttaaaaagagtgaaatctttta

SEQ ID NO: 8123 - DNA, 678 bp, Homo sapiens
  misc_feature 19, 22, 23, 539, 558, 655, 659, 672: n = A,T,C or G
ttttcgaattcggcgcganganngctccacgtgtagctgagctgcatgcaccaggcctcagtttgccccaagtcccctgtgtactctctcatggcctgtggccaagaaatgtattctctcactttggacttaggagtccaaagagaagcccagaaacaaaattgcttgaacttgaatttgtgtgcgtgcgcacgtgtgcacgtggtggtgaaggtgtatgttttcggctgttctatgcgtcactgtcaccaaactcccaaataatagtaacatttgtttagatgatgtctgctgacaaatcacaaacacgacgctaactcgcaactctctgctccactggcacagaatagggcatggagcctggtgctgggtgtcagcccatggtgttgggtgtcagttcacaggctgggtaagggagggaaaataatccattctttgatattagacatgacccaaaatttcctgctggcagccaaaggcctcctcgctcagagaagtcatctgaaaaaagctagcccaggggcaggaaagggcctcangctggcgccccaaaaaggnggcccatcagtcactctgggaagacagatagacatcgtcaggtctctttttacaagtcaagacagtaaaatcaaaagtaatagtttctggcaggaanaaanaaaattgctgganccgttg

SEQ ID NO: 8124 - DNA, 698 bp, Homo sapiens
  misc_feature 1, 2, 9, 20, 34, 38, 102, 612, 637: n = A,T,C or G
nntttcgantcggcacgagncagtcaggcgatgnctgnctcattgccttggttctcacctcagagactagtgtttcaccattaagtgtgatatagcttagtnttttataaatacttgggagtgaatttttaactgggtcatagaggattgttggatttcagcaagtagaaatcagtggaaattagttctccagacacagggaagagacactagtagtaaaacaaatggtctcctttggctatagattaaagggagatagtggaacacacacatttgtcatgataaccctggctcaaagatagaagattaaaaaaagttatgatggggccaaatcatggagataagacagttgggaataactcttctttcagcgctaggaggagaatggagccaacatcaacagaattagagaagtcatcaagaaaagttagttatgtgaaggaatgcctcttgtggcaattttttaaaaattgcattttatgatttggaactcaccgtcttaaaataattggctcttagaaatggtgtactgctacttaaccagaaaattcaggggcaaaaggggtaaatggtggggtatcatttacatggttgggagggacatgtatgaanaagtttggaagaaaatgttttggantaaagaataaatttaaattctgctaccttggggtctggggacatttgggaaaatttggttt

SEQ ID NO: 8125 - DNA, 802 bp, Homo sapiens
  misc_feature 3, 9, 14, 18, 22, 23, 27, 28, 29, 30, 34, 38, 48, 50, 91,108, 119, 121, 132, 136, 162, 165, 169, 248, 278, 281, 282,308, 309, 311, 314, 322, 324, 330, 337, 343, 352, 353, 372,375, 386, 387, 388, 389, 391, 398, 402, 404, 408, 410: n = A,T,C or G
  misc_feature 419, 427, 430, 431, 452, 454, 455, 457, 458, 465, 469, 471,474, 479, 489, 499, 503, 504, 508, 520, 521, 533, 534, 538,541, 552, 554, 564, 565, 566, 567, 568, 570, 571, 573, 576,579, 583, 594, 600, 601, 608, 610, 611, 627, 631, 642: n = A,T,C or G
  misc_feature 644, 646, 647, 650, 655, 657, 660, 668, 674, 680, 684, 686,689, 694, 697, 705, 706, 716, 719, 720, 724, 725, 728, 729,733, 734, 742, 743, 746, 747, 749, 753, 760, 777, 782, 785,786, 790, 792, 794, 801: n = A,T,C or G
ccnttgagnactangggncttnngaannnnccantcancatgaaactntntggcttgcaagacagggcaatagaggggaccgtcacggagncaggcccttccacactntggcgtgcagnantgaagcacggncacnggccctgcctacacagagccaacctntgntccnacacccctccactgtaaaatgagaataagcactcaggatggtttgtgaggattcactaacagactgagaagaaatggtnacctaggctggcacatgggacactccccanttnntcttttttattttccttaagcccagnntnaancccttctncntccttnggtttcntgacangccatttcnntttaaattttcactttcanaantttttaaaatnnnncnaaatttntttnancatntnaatggattnataaaaangtnnaaatttttcatagtattaaantnntnntttcggncccntntanttttntaaacaaaanaatttctccntttnnttcntaaaataacccnntttttcatattnncccnttngcctttttttnantttttcttcnnnnnanntntanccnttgnttaacttattntttttnnttccccnanntttataagtttttgtntttntgtcgtactcncntnnatnattcntngtnttagtcanttttcnttttancttnantgntcttnctntttccccnnatttcttttnttnnattnntannaaanncatatttnntanntntatncctctcnctccctttaattaatcnactcnccnncctncntntttagtnc

SEQ ID NO: 8126 - DNA, 822 bp, Homo sapiens
  misc_feature 1, 15, 18, 24, 86, 88, 89, 149, 195, 261, 285, 294, 296,311, 315, 316, 318, 321, 327, 332, 335, 336, 339, 346, 351,353, 355, 357, 358, 360, 366, 369, 370, 371, 373, 379, 398,403, 409, 415, 430, 431, 433, 436, 438, 450, 458, 460: n = A,T,C or G
  misc_feature 464, 471, 473, 494, 499, 517, 527, 531, 545, 546, 549, 555,557, 572, 573, 584, 593, 597, 602, 609, 615, 623, 624, 629,630, 637, 638, 639, 640, 642, 644, 645, 648, 658, 663, 666,667, 668, 673, 674, 675, 682, 683, 685, 688, 689, 693: n = A,T,C or G
  misc_feature 696, 698, 700, 705, 706, 710, 727, 747, 763, 774, 775, 777,784, 799, 802, 813, 815, 816: n = A,T,C or G
ngtgacattgaaggntcngccaangaaaacaagttattaatacaaatacgtactgaatatgacagtacgcattaggaatgctgtgntnnaatgcataaacatgtttacagtggtccacatgtgccaggagatgtgggaatggctacccntgaaaaatgctacttaaatggggtcctcatcgcacaccatacacanacatcatctcacaaatggattaaagacacttaagacctgaaaccaaaaaaactcctaggagaaaanacaggggaaagctccatgacatcnagtttccgncnaggattttttttttngacnntnacncctatngaaanaannatnccatacntattntncngnncnaatccnatnnncnggaaangccttttataagcaatttngcccntttttngaactntatgcataactttgnncnaancnttcggacaaaantggttaantngttnctccaantntaaaccccctcttattggaantggtncccaccaaaaaatccctnggaaaacccncttnaataaaacctgganngtnccccangncccaaaggccacaannggggcgtcaanggcccttgnaaantcccnaaaccanattttnggaaaggnnttganngtccggnnnngnanntgncccggaaaantcggngannngttannnaaacccnncnctnntccnaanantnggggnnaaanccccccgtctttttatntaaaaaattaccaaaactcnatttaggcttgggggngggggggcaanntngccctgnggggtccccaaatcnacntggggaagggntnnaaaccg

SEQ ID NO: 8127 - DNA, 674 bp, Homo sapiens
  misc_feature 1, 20, 21, 25, 26, 27, 590: n = A,T,C or G
nctttcgggatctgcacganntttnnntcatctggtttttgcatgtttgatgtgtttgtgtgtgtgtgccgtttacagttttaactgatattaagtgaagatagattaatgtcacccaggttttacaaaatcaaagaaatagaaataattttaaagacttttggtacttgaattactttgttgttttctggtcatttagtacatttatggaacctcagaaggtttgagttgaacagaggcaagttacagcagttttttgggtgggagaattcataagtcagcatgtgaatcttttgatctcatatatttggagtggaatgtcattaattgtgtttgtcacggttaaggaatagagaattaatctccatcccagtcttgctattcttctgaaagcctttagctgccgacaccatgggcataaggaggtatctcttctggcttctctttgggtgtggtagctaagttacagcttaccttggaaagatgagcagcttgtaagcaacaaaaaaacagtatagttaacaaatgcatcgtcaacaaacaaaacaacccaatcaaaaaatggacaacagctttgaatagacattctncaaaacaaatatacaaatggccaataagcatgtaaaaagatgctcacatcattaatcattagggaaatgccaattaaaatcccg

SEQ ID NO: 8128 - DNA, 698 bp, Homo sapiens
  misc_feature 2, 23, 458, 550, 573, 585, 614, 624, 643: n = A,T,C or G
tntttcgaactatgttagttgtncccacaggtgcaggccctggtgcttgatggtccgaggccatctcctgggccgcctggcggccatcgtggctaaacaggtactgctgggccggaaggtggtggtcgtacgctgtgaaggcatcaacatttctgggaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttngctggaagtaccaggcagtgacagccaccctggaggagaagaggaaagagaaagccaagatccactacccggaagaagaaacagcttatgangctacggaaacaggccgaaaaanaacgtggagaanaaaaatttgacaaaataccacagaaggtncttcaagaanccacgggacttccttggtnttggagcccaataaaagaattgtttaatttcttcaaaaaaaaaaaaaaaaaaaat

SEQ ID NO: 8129 - DNA, 673 bp, Homo sapiens
  misc_feature 544, 548, 607, 632, 658, 672, 673: n = A,T,C or G
ttttcgattcggcacgagcttaatgtttttcaattgctcaacgaactgtcagccctgtcagatatcatatatctggtaaaattaccccttaggaatgagggggaaataaatacatactagatgaaggaaaactaagagagtttgttgctagcagacctaccctaaaagaaggctaaagaaagttcctggctgggtgcagtggctcacgactgtaatcccaacactttgggagactgaggcctgccaagctgaggccaggtggacagcttgaagcctggagttcaagataaccctgggcaataaagggaggcctcattctctatttaaaaaaagaaagtcctgaaacataaaggaaatcataaaagaaggaatcttggaatattaggaaagaaggacaacaggaaagagcaaaaatgtgaccaaatacaagaccgggtatgttgactcacacccgtaatcccaacacttagggaggttgaagcctgttctcaagaccagtctgggcaacatggcgagactcttgtctctacaaaaaataaattanccangcgtggtgtcgtgtgcctgtagtcctagttactaaaggagcctaaggcagcaagattgncttgcccaggaatttgaggtattgngagccatgatcaatggcactgcactncccctgggtggagnn

SEQ ID NO: 8130 - DNA, 677 bp, Homo sapiens
  misc_feature 630, 643, 644, 652, 674: n = A,T,C or G
ttatccactctcaccagcataatgggacccagcatccctgccaaaactcgggaggtgctcgtcagccacctggcatcttacaacacatgggctttacaaggcatgtatggagtttcttgtgggcttggcaggtggctgtgaaggccatcagtgtctgaagcctgtacttgcccctccccaggtcctgtgagtggagaggcacagagtgttctgggctagctgagtgtggaggctgggtggctctgatgctagccaatcactctacgctctaggctcacacctttccaccttcgacttcgccagcagaagtcttgagttcaatctcattgccctggcttgggtcacatgtccatccatgaaccaatcactagactgggtgcggaaagctctgatttgccaagttcgggtcatgtgtctcactaggtaagagcagaggaggatcacccccagggaagaccagagtgctctttcaagaagagtgggacaatcgctggatggctctttgcaccactcactcctgttctctgctaagggcttgctgggactcacaaaggggtaaggttgtggcaactgccctgttttggggttcttgactttggcttgtgtccctgcagggaatgaagtttgtanctgcccactcaanntccatggngctaaccttgggcctgaatganctg

SEQ ID NO: 8131 - DNA, 670 bp, Homo sapiens
  misc_feature 14, 27, 28, 571, 593, 614, 618: n = A,T,C or G
ttatcaattcagcncgaggactctttnntcctttgcattttctttctcagtctgatctgcttcctgacttcctggaaaccctccaaatttcttgatttctaatggcactctttctagatttctagccctgtacgataatattctttcatcatttcagtgggcttttggagggaggcggagatccaggtgatctgtctacactattcagtcagaaagctggatggtttttctcactgtttagctgtgactcatacttagaaagtggtttaaatgtgaatatcttagttctggttgtacaattgaggtaatcctcaattcaggttgctgtctggacatttcatgactggatttaaaaatatttttaaggccaggtgcggtggctcatgcctgtaatgccggcactttgggaggccgaggcgggtggatcacctggggtcgggagttcaaggccatcctggccaacatgctgaaaccccgtctctactaaaaatacaaagactatccgggcgtggtggcgggtgcctgtaatcccactactgtggaggcaggatggatcacttgaatcccggangtgggggttgcaatgagcccanaaccgtgctgctgccttcatnctangtgactgagcactacttcattctaaaaaaaaaaaaaaaaactcggcctttta

SEQ ID NO: 8132 - DNA, 682 bp, Homo sapiens
  misc_feature 484, 485, 486, 487, 490, 499, 501, 505, 506, 508, 524, 525,527, 530, 531, 532, 541, 548, 551, 552, 569, 577, 579, 582,583, 599, 601, 603, 604, 612, 618, 621, 628, 630, 631, 632,633, 634, 635, 636, 637, 638, 639, 640, 641, 642, 643: n = A,T,C or G
  misc_feature 644, 645, 646, 647, 648, 649, 650, 651, 652, 653, 654, 655,656, 657, 658, 659, 660, 661, 662, 663, 664, 665, 666, 667,668, 669, 670, 671, 672, 674, 675, 676, 677, 678, 679, 680,681: n = A,T,C or G
ttttcatggaatttacttttcttctagactttcttttgcaatggaacgttgctttgtgtgtgatttggtggaataacaaccaatacacaatgagcagtctaatgtgtagtcatttggtgctctgtgttcaagtgtgaaatctctatcagtgcccaatagtaagccagggtctgcttttcatatagaaaatggttgctgacagaagaagatgtggccgtactccagggtggttctctatggaggcttgtgagagtctctatacagcatccatgactgccaccggcacttccaataccattagttatcctggtaataagagtctcactcaaaagtagcaaccttacaagttaattaaattggtcatttcagctcattgagctgtggtatctgtcacctcaaaaatgcagaggcgctccaagtcttgcacctccttgcaatggtaacatttgggtagagctataaatgaagtgagaaaacaagcccnnnnaangaaaaaaananaaannangggaaaaaaaaaaaannanaannnccccccccnttaaaanttnngggggggggtttttccngaaacccncnttnnaaaaaaccctttgggngnanntgggccanaccccnccntaaaaanannnnnnnnnnnnnnnnnnnnnnnnnnnnnnnnnnnnnnnnnnntnnnnnnnnc

SEQ ID NO: 8133 - DNA, 670 bp, Homo sapiens
  misc_feature 1, 606: n = A,T,C or G
ntatcattcgacgagggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggaaactncgcaagctcagaatcattcatgctaaaaaaacagcaaaaaaacacttcaggtggcattgatctt

SEQ ID NO: 8134 - DNA, 677 bp, Homo sapiens
  misc_feature 530, 546, 558, 572, 582, 608, 615, 621, 628, 632: n = A,T,C or G
gttcattcgcacgagggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaanaactgaccggggccanggctgccatggncttcttgcctgctncaaggcacangatacaagtgggaatctttgagactnttttggncatttnccatggnttanactaaacttcaagccctttaggaagttccaagggaacactttgaa

SEQ ID NO: 8135 - DNA, 677 bp, Homo sapiens
  misc_feature 629, 663, 669: n = A,T,C or G
aggtgagcctagggacccatttctcctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctcttcctgtggaaaagaaccagcttgacaatcgacttcatcgacatttgtcaaaagacccttgttgccccacaaccgaggtnttaagaacagaaagaaggacccccaagcttgttncaagtncaaccaaa

SEQ ID NO: 8136 - DNA, 686 bp, Homo sapiens
  misc_feature 36, 37, 150, 307, 364, 367, 436, 518, 607, 629, 637, 638,656, 661, 663, 665, 669: n = A,T,C or G
ttttcgattcggcacgaggggaaaacaaaaggtaannggaggggtgctgggagaacaaataggaagaaaagggaaaacccagaaatagtaattgttagtacccctgctacttgactgttgaaaatgctttaaaagtttgttctgaattangagaaaaggcgctccctcaaccaggctgaaactaccaccagtgttgttgccagaaacctggagcaggaaggagctgcttctcccctccgccttccagtcacccaccattaatacctgctattggcaaggcccatctggatggcagatggcaaagcancctggaaagtggagtttaccaacttctacctcctacagtatatagtggagcacagcnaantggaaaaggaggccgggcgcggtggctcacacctgtaatcccagcaatttgggaggccgaggtgggcanatgacctgaggccaggagttcaagaccagcctggtccaacatggtgaaaccctgtgtctactaaaaatacaaaaattaactnaacgtggtggtgggtgcctgtaatcccagctactctggaggctgaggcaggagaattgcttgaacccgggagtttggaagtttgcaatngagcccaaggtcacgccactgnactttcanncttgggcaacaaagccanggaantncntctnaaaaaaaaaaaaaaaaa

SEQ ID NO: 8137 - DNA, 710 bp, Homo sapiens
  misc_feature 2, 3, 8, 13, 32, 53, 100, 101, 105, 183, 197, 282, 347, 353,373, 378, 403, 411, 419, 425, 438, 445, 468, 492, 496, 529,542, 555, 587, 588, 597, 599, 645, 667, 670, 682, 686, 692,694: n = A,T,C or G
tnnccggntgacnttgcccatgatggtgcctncccctgatatctggagagatnataaaatacattacagttagagtcaacaatcaccacttgaagaaatnncttnaacacaaagcctgataaaatttacatctggtaaatgtctatttaagctactgcgaaacacatatacttaaaaaaaaanggccttttcattgnctcaatgtcttgaaggctggagattgtaaagcacttccctaaagttcctatgagcaggatgaggctatttgcctttatagagctntagaactaataagcaatcaaaggggattttgaaaaaagcctataacttccaaagtgataaactgnggaaanattcattggacctgtcccanattanctgaagtatccagatgctaaagctnatgtgtanaggccaantacggnggctcatggctgnaatcccncactttggaaggcccgaggcggncggatcaccctgaggtcgggaggncganaccactcttgaccaacatggagaaaaccccgtntctactaaaaatncaaaattctccanggcgtgggtggccgcatgccctttaaattctnnagcttcttnanggagggcttgaggccaaggaaaaatttgctttgaacccccggaaanaaagggaaggtttgccggtganccntaaaataagccnccanttggcncntcccaaccctggggcc

SEQ ID NO: 8138 - DNA, 1022 bp, Homo sapiens
  misc_feature 2, 4, 35, 44, 79, 84, 95, 99, 106, 108, 110, 119, 121, 130,131, 138, 147, 148, 149, 151, 156, 158, 160, 162, 166, 171,177, 179, 180, 184, 186, 190, 196, 198, 207, 215, 216, 217,219, 222, 224, 225, 226, 227, 231, 232, 233, 234, 235: n = A,T,C or G
  misc_feature 238, 239, 243, 246, 247, 248, 249, 253, 255, 261, 264, 265,267, 271, 273, 275, 279, 284, 285, 287, 289, 294, 295, 299,301, 307, 316, 318, 331, 334, 338, 343, 350, 351, 352, 355,359, 361, 362, 363, 366, 367, 375, 379, 381, 384, 387: n = A,T,C or G
  misc_feature 388, 390, 391, 392, 393, 394, 395, 396, 399, 400, 401, 402,404, 405, 408, 409, 415, 417, 424, 427, 443, 444, 452, 453,457, 460, 464, 465, 466, 468, 479, 485, 493, 497, 502, 503,505, 506, 507, 511, 516, 521, 533, 536, 538, 543, 544: n = A,T,C or G
  misc_feature 554, 555, 558, 562, 563, 565, 567, 569, 570, 571, 577, 579,580, 583, 586, 590, 591, 595, 598, 603, 604, 605, 607, 612,614, 616, 618, 621, 624, 635, 636, 642, 643, 644, 650, 652,654, 656, 660, 668, 678, 680, 681, 688, 690, 695, 698: n = A,T,C or G
  misc_feature 700, 705, 711, 730, 732, 735, 739, 744, 746, 749, 754, 757,761, 766, 775, 776, 779, 780, 788, 792, 794, 796, 797, 799,816, 818, 819, 826, 829, 831, 836, 839, 840, 841, 842, 843,847, 865, 876, 880, 882, 887, 888, 892, 898, 906, 909: n = A,T,C or G
  misc_feature 913, 914, 915, 916, 921, 927, 930, 952, 955, 963, 964, 965,966, 968, 970, 973, 981, 983, 991, 993, 996, 1001, 1003,1007, 1019, 1020: n = A,T,C or G
cntntcgaattcggcacgagaattgatttgctacntgccctagnaatgatacacgtatgcctcagtattgccaccaagntaccnctgtgttcttntaanaatgagncntnaaggggggnanttttgaaanngtaatanaaaataccnnnanatgtncnangntatnaaaangagtananncccnantaanacaaananttgtatatnttttcttnnntnttncnnnntgannnnncgnntaanttnnnnagcntncaactntanngntgtnancnttcntatanngntnatatnnattngntaatcnttcattttnancaacttatacaanagntcanttacntatggannnatnttantnnnttnnttattaancagncntanaanncnnnnnnnagnnnntnnatnntatttntncttggtntcngtctctaatgtcatanngcttgatnnaccnatnattnnncnaatttatgttnatcttnttcatacnaatnttttnnannnacangtcantaatncattttctattngtncnaatanntcttcactannatncatnnantntnnntacatntnnatntcngtgnnctcnctntactnnntnatttnangngnatnganaggacattatnntatttnnnaattcntncntntgtnaacaacangatataagtntnnttataanantcccnatncntagtntacganatgagattattagctgtgngntangatntattntntantatanacncatncaacnttctgctanntanncatcagtntatncntnntntcatcgcgctacctctntnnccacaantancnctatngtnnnnntatntcgcaatatatacatacncgttcaacatncacngnctaanngaantttcantcttcgantancatnnnnaattntatctntcncattttatcacgatacttctcnacnctgtcatnnnnantnttncaatatgntntgctacantnganaacgngntatnctggtcacatcnncg

SEQ ID NO: 8139 - DNA, 681 bp, Homo sapiens
  misc_feature 2, 664, 680: n = A,T,C or G
tnttttcgaattcggccgagaattgatggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaactggaaaagaagacaaagatgaaaaaggggaagaagatggaaaagaggataaaaatggaaatgagaaaggagaagatgccaaagagaaagaagatggaaaaaaaggtgaagacggaaaaggaaatggagaagatggaaagagaaggngaagatgaaaagaggnt

SEQ ID NO: 8140 - DNA, 649 bp, Homo sapiens
  misc_feature 1, 10, 13, 15, 19, 21, 22, 23, 24, 25, 26, 28, 30, 31, 33,36, 40, 43, 45, 50, 51, 52, 530, 538, 541, 550, 556, 568,596, 602, 608: n = A,T,C or G
ngagaactanggnantganannnnnnantnnantgncctntcngnatgcnnnacagggcagagaggggacgtcagccccaggcccctccacacctcatgtgcagttctacagcacgggcacaggcactgcctacacagagccaacctctgagcccagacccctccactgtaaaatgagaataagcactcaggatggttgtgaggattcactaacagactgagaagaaatggtgacctaggctggcacatgggacactccccaagatgctcctttttcatttccctcaagcccagagtaaaccccttcgacctccttgggtttcgtgacaggccattccagtttaatttcacttcagatcttgaaatgtccaaattcttcacctggaggatagaaaggaaatctcaggataagtttgttggcctcatttgaagaaaagtaccttatagaagagccataagaatgacgtggctttcattcactcagcagatacattgggaccatctcttgtgcccaccttgagcttggttangggtacanganatggggtcnggcacnctgggaactaangaggtctgaacccacctgggggatggangactgnctggangtggaggccaaactgaatgaatcacacaggctaagtgggga

SEQ ID NO: 8141 - DNA, 654 bp, Homo sapiens
  misc_feature 4, 6, 11, 20, 23, 26, 27, 32, 39, 43, 47, 524, 546, 562,578, 589, 614, 619, 632, 634, 648, 651, 653: n = A,T,C or G
ttgncnattcngcacgaggnganatnnaaggntaggccnatgnagangaggaaatgaaggctaaaggtcatatatctacaaagtggggaggtcagactttgaacccacaacctgactgtggagccacttcagtatactctctccccataagaaagttccaatagaaaaaaaatgctacttaagtagggaaatcacaaaataagtgccaatgaacaataaatgttcaacctcactacagttaaaatgtatattaaagcaagagttgagatgacacttttccttataaaacagacagggattcagggacattgggactctaatgctgctggtaagacatgaataaatacataccatctctggcaatcaataccagaagctttaagcattgccttttgactttgaaattgtacctggaaatgtatgtttcagtaaccatcatgaatgtcacaaaatcctgaaactcttaaaactgatgtcacaggccaggcacagtggctcatgcctgtaatcccacactttgggangctgagcgggtggatcgctganatcgggagttcgagancacctgacaatatggngaaccccgctntctaaaaatcaaaacaattactggngtggngggatgtgcctgngnccaactcttggagntgnang

SEQ ID NO: 8142 - DNA, 708 bp, Homo sapiens
  misc_feature 1, 11, 15, 78, 499, 529, 536, 540, 545, 551, 554, 598, 610,619, 623, 627, 631, 644, 651, 665, 668, 681, 683, 688, 699,708: n = A,T,C or G
ntttcgattcngcgngagagatggctcttaagacactcaataaatatacttattgaattagtagaacttttcccatgnatctcctattactacattaggatctttgttcccttagtgtgtctttagcctgtgctctcacaagctttgtggtgtcgtgtggatcacaggatcgtttaagataaagatacttttagctctttaattctggtattctattattggtacagggaacccatacattatcttaatttcagagtaacacacgtctcggcatgggacagggggtgtcctaatgaaaagagggctaacaggtggaatactgactatgtgcaggcactgtataaagcaagtagtttttaaatcccatttgcaggtgaggaaaccaaggctcaaagggattaagtcattgtccaaggctatgtagttgttaatgagtgaatctgggttttaaaataaatgtgttaaattccagggttgatatttgcactgggcatttatntacttttatttgaattttttttttttgcantttactngccngccanaatttntcntttgttcaaccaccaaaacatttttggttccccacttggctttncccactttggcnttcccctantttnacanaaanggggggggaaaanaaaacgnggggggacgggatnttntaaaccccctgtnanagganccacaaggggnattggcttn

SEQ ID NO: 8143 - DNA, 676 bp, Homo sapiens
  misc_feature 17, 83, 99, 104, 114, 115, 551, 628, 634, 657, 663: n = A,T,C or G
gttcgtacccccatacnctccgtcccccgccggcctaccactatctagacacctcctgccctctccatatggctccgggggantgtttccctccctagnccganttctccaatnnacagcaacttcctgcttctccagcaagtcgcataagaagaactggaatcttgacactacaactcctgacaggacgcccctgcggcatccagagacagggaagccagtgctgctctgcatgttcagggcgagtagctgagagtctccttccggcctggatactgaggaaggtgacttagactttctctccgtcctctgagtcgtaacggacggacacgcaagggccgaggacgggtacaagcagcagcgactagaactgatctgggtgagatctaggcctcagcaacaactgacgcaaaaagattttgttctaggattggctacagctgaaactaccgcgcttgattcaaagctcggggcttgcagcgggaggcagctggctcctcctctgaacccgcccctttggctggcccaatccgctgatcccatcctcttangccctgccccaaacttccaaatctaccagaattaatgcttccagcgcttgtttgacccactcctgcctatgatttgntggggngactaactactccgggggggggncccgcnattagaacgcttt

SEQ ID NO: 8144 - DNA, 656 bp, Homo sapiens
  misc_feature 444, 461, 495, 562, 586, 594, 610, 656: n = A,T,C or G
tatcccacacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcacttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccanactgtgatgactgccancacaaggcatctcgggcttggctggtcttgcgangccttgccctgtggaactctgggttcctgttttctcatctttttgcggcttttgctgtgggtggganctgccgtattcagcttgtgtcggncactaaangaggctgtggtgcgancatgcaagaaactgccttggaatgggccctctctgggctggcctcn

SEQ ID NO: 8145 - DNA, 669 bp, Homo sapiens
  misc_feature 5, 11, 20, 90, 589, 636, 640, 651: n = A,T,C or G
tttcnttggcntaggaccantgacttccctgcacgttcagctttctcctttgtgaaatggtaatagaagcacgctgcacttgggattctngtggattacatgtgagggtcttagaaacacttgatgtgtaagccaactattatgtattactgtatatggaacacaagggatgtagccaaaactaaatgcaagtttgtgcctcagatgtcttcctatcagaacagagtcaaatccagattttgatgcttaaatgtgacagcttattcagatttagaaaaacttttggtatgggccaaagaaaacatatccttaaggggatatggcccctaggccctcattttccttttctgctgagcaattaaaaaaagcattaagtaaattccacaaattctttggaatacctagagataaacagatatcatgttaactgtatgataataagttagaatacttgcaacaaaatgcagagttttctaggaaaacaagtaatcattcagaaataagaatatgaatagttcctcagttctccccctttgtggaatttgtgcagtaaatgctgctccaaagctctgtggaaaacagaagcttnccatgaaaaatctgacaagggtatctctcaaaaagagagctgtaatnccancactgtgggangctgaggtgggagtattg

SEQ ID NO: 8146 - DNA, 674 bp, Homo sapiens
  misc_feature 1, 619, 652: n = A,T,C or G
natcgcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttctcctccacccctgacaaccactcaccattttactacttctatctttttgactttccaagaatgtcctagagttggagtggtacagtatgtgggtttccagactggcttctttctagcattatgtactttaagttccttcatgtcttttcatggcttgataacttgttttttaaaatcagtgaatcagatttccttgtatggctacaacagtttgtttattctttcgcttggtgaaagacatcttgggcacttccaagttttggcaatgatgaataaaattgctgtaagtatttctgtgcaggattgtgagtgaacttaagttttccaaagtgactgtacccttttgatttccactagcgatggaaagttctcgttgctcctcatctttgacagcatttggtgtgtcacctttttgaattttaaccattctaaacagcttatctgcccctactgnggaatgatgtgacagacatagaatacacttacngtggattctagttcaaaatgag

SEQ ID NO: 8147 - DNA, 673 bp, Homo sapiens
  misc_feature 6, 437, 580, 597, 605, 609, 648: n = A,T,C or G
ggtcgncctatcctccccacctgttagaattctatttatctttccagtcttagttcaaataccacttgtttctatgaaactttcttaactttccaacacaaattcacctcttcatttctctattcccttagcagtttgctcataactttattatataatgattgcactccaacttggatcttagctaattacgtacctgcattccacactagactgcaaacttgaggaagatgggtgctgtggctgccctcaaaccgtatgtgcctcccataggacacaagagttggttatgcaggtgttgtctagatgaaattatatagcatctatccttcttgaattggctttttgcctcagcacagttccggggagattcagcgaggctgtggtgtgtactaatcgttctttccttcataaccaagtggtgctccgtggtgcanaggtgctgcatggtaaccatccacctgctgagggactcggtggtcccaatttggggctattctaaaataaaactgggggaacattcatacacaagattttggttggaacataagtcttcatttcttttgggatgaatgggcangggttcaatttttgggncttatganaagnatatgtttaagttttaaaaggaactctcaaaccattttncagaacaaaatttgacattcacagt

SEQ ID NO: 8148 - DNA, 1282 bp, Homo sapiens
  misc_feature 6, 9, 13, 14, 16, 23, 24, 26, 27, 28, 29, 30, 32, 34, 35,39, 40, 41, 42, 51, 55, 58, 60, 61, 67, 68, 72, 81, 83,84, 85, 86, 87, 88, 93, 126, 127, 139, 140, 144, 147, 151,154, 160, 161, 168, 169, 178, 184, 185, 186, 189, 193, 197: n = A,T,C or G
  misc_feature 199, 203, 207, 214, 216, 217, 219, 223, 224, 226, 228, 236,238, 240, 247, 249, 257, 259, 262, 265, 271, 274, 275, 276,281, 284, 290, 293, 294, 318, 358, 391, 407, 409, 413, 414,436, 449, 458, 462, 473, 475, 476, 486, 488, 493, 497: n = A,T,C or G
  misc_feature 499, 507, 514, 516, 517, 518, 519, 520, 522, 523, 529, 534,535, 541, 543, 547, 550, 551, 554, 557, 560, 561, 562, 573,575, 583, 588, 591, 594, 596, 604, 607, 615, 619, 622, 625,626, 628, 632, 633, 634, 636, 638, 640, 642, 644, 647: n = A,T,C or G
  misc_feature 650, 654, 655, 656, 659, 662, 663, 669, 679, 682, 685, 689,692, 696, 698, 702, 703, 705, 707, 708, 709, 710, 714, 716,719, 723, 724, 726, 729, 731, 732, 740, 741, 744, 745, 746,749, 750, 762, 763, 764, 770, 771, 781, 784, 790, 795: n = A,T,C or G
  misc_feature 799, 801, 802, 818, 821, 825, 826, 827, 833, 850, 852, 860,869, 878, 884, 890, 893, 894, 898, 905, 906, 912, 916, 920,924, 934, 936, 944, 956, 957, 959, 960, 961, 967, 970, 974,975, 977, 986, 1000, 1001, 1005, 1006, 1008, 1013: n = A,T,C or G
  misc_feature 1015, 1017, 1023, 1026, 1030, 1032, 1037, 1041, 1043, 1045,1046, 1048, 1052, 1063, 1067, 1069, 1077, 1082, 1094, 1098,1105, 1107, 1108, 1110, 1114, 1122, 1129, 1134, 1139, 1147,1148, 1177, 1182, 1189, 1190, 1196, 1214, 1218, 1225: n = A,T,C or G
taaaantanccanntncaatttnnannnnnangnncatnnnnttgttcacnttantantnnaccatnntacnttactccantnnnnnnacaantattactatatcacatccacgagtatcactaanncactcatcacanngcgnagnacgnctnaatgcnntatcaannattatattnatctannntcncatnatananacangcanagaacananncncatnnantnatacatanantntctatanancagatagntnaanaantggggntgnnntaccnacngtaccnccnntcctcctttgacagggtacatcantggagccttctcagtacccacaggggtccttggtgaattntgtcatggttatttaaggaaccttgcctagaantcccaacttgcagttncncatnnaagggaaggcttggactccaanatgattataaaangaatatttnttgncctttgtttangnntgcacttgancntcctnacgntnactcttcnctagatncnnnnnannagcccnaaccnntcaccntnatcntcnngantcngannntctacactctncnattcaatnttcgncantcntnggacacgntgntagtctanttangcnttnntnattnnncnanantnancantantctnnncangtnnacaatnccccaaatcnagngtnatangantttnantccnntnannnnaaantnaancacnncnttncnncatattanntannnaanntataatatattnnnacaagnntacctattancanattatnacacnactngnnaccccatatatctatnccntacnnntcatanttctagacaatcttcancnctattacncatcatcancctatgtcntctaancttatnatnntcanagactannattaanttanaganatcntatacatatncnatcctcanctaatcatatgnnannnactctncancatnngntcatacttntaccatatcaactnnatcnntnagttngnanggatantcntaantntccanatcnantnnanacanactctacttcntatntntagatctnacaancgtttactacanatgntcacatncnnanctcncgaaatcnttccatncactntacgnattctccnnatatatctcacatactcacacacacactncatanacacatnnctctcntatacatttcatacatanatanttactcnctctnatcccnttngncannnacctctncatctacgtatcgctcanactctttctcc

SEQ ID NO: 8149 - DNA, 726 bp, Homo sapiens
  misc_feature 9, 11, 23, 102, 172, 177, 181, 184, 189, 345, 350, 491, 538,565, 570, 608, 617, 625, 627, 632, 637, 646, 654, 660, 662,671, 675, 680, 698, 703, 713, 719, 726: n = A,T,C or G
tttcattcncncgagggtatcanaagccaagcccgagctcaggtgttttgattcacagccctttataaccattatcattttgaatgaaaagtaaatcactgnttcttagtgatttgggcatgtttcctgagttaagggatctgtctgacatccgtggtaagccttgtcttangtganttgnggntaaanacttgtcccagatggagtgggaggacatgaaggatgaggaactaccttcaggaccttccagtccataggcagaggtgggggaaattcacagaaaaacaaatgagttaaagggatactgcagtagtgctgggaaattcagagctgtttaagacctancattncccctggtaggaaaggcaatcaaacacacatctgactgtcagactgcaaagttctacagcggaagaaagaaaagggtgattgtgaaatgaatagactttccacagaggaagcagaataaccagtggaagtggggagatccncattttggggaaaggaaagagccatgaaaaaaagaaggtagaggccncaaaagtaccaagggtgtgcttcaaanaaaanacttggggactttttgattgtgacttgggacttggganttgaaaaanggtgccantnggaanttggnaaggggttngggaaggntgaaananttgaaaganccangaaangggggaaaattggggagnccccnccccagtggnaagccncccttcn

SEQ ID NO: 8150 - DNA, 640 bp, Homo sapiens
  misc_feature 1, 2, 3, 4, 5, 6, 7, 13, 381, 460, 488, 521, 552, 600, 617,629: n = A,T,C or G
nnnnnnntagacnttcccatggtggggcctggccctcatcttgaccaaagctgctgtgtggcagctcggcctctctacgaccccatcttggtggctgcacacttttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttggagacaagccaacaaaccctgcactccaaaaaagcaaaacagaccctaatttttttgtgccaaaaactgtggacatgctggctcagcatcctcaggaccaagttgttgcttaatttattgntttttaataactaatccagataaaaaaagttgtggggcttcaagggtgacctgggcccaaaggttctgaagggcagttnctggcagccccagcttgcttgtgggaangggccgtgccgcacttttcatattccatggggnggtctgctgggccaactctgatgagaggcanggtggggacagtccatttgcaccctctgccttcaccaccacttatgtntgctgaatgggatcggnaccatggtatgnggactgggaac

SEQ ID NO: 8151 - DNA, 692 bp, Homo sapiens
  misc_feature 3, 532, 606, 612, 635, 647, 656, 677, 678: n = A,T,C or G
ttntcgattcgcacgagaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaaagtgctttgtgatactatgcatttgttcaatgcagattgggaaacttaaaatttgaatggagattatgttgatgggctttggcaagttcatttggatagactgggatganaagctcttgggacttgtgactgggccaaaacattccagtattttaaaataaaaattaagcccttattactcccnttcatnaaaaagccaatccctatgggtanggaacatggganggtttgggnaataatggcaccggaaaaggnngccaccttttcttt

SEQ ID NO: 8152 - DNA, 679 bp, Homo sapiens
  misc_feature 4, 7, 23, 25, 50, 462, 557, 567, 602, 654, 666: n = A,T,C or G
tctnaanaattcggcacgagaantnatttgctacatgcttaaaatgatanaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagatngggaaacttaaaattgaatggagattatgtgatgggcttttggcagttcattggataaactgggatgaaaaactctttgggacttgtgactgggncaaagcattncagtatattaaaataaaaattaagccatattactncactcataaaaagcaatcctatgggaaggacatggaaggttggggaataatncaccggaaaggnggcagcttttttt

SEQ ID NO: 8153 - DNA, 535 bp, Homo sapiens
  misc_feature 10, 11, 15, 17, 26, 30, 33, 44, 46, 47, 48, 60, 72, 73, 74,101, 136, 138, 141, 152, 196, 200, 257, 312, 321, 331, 373,388, 393, 405, 482, 496, 520: n = A,T,C or G
tcatcctgannctcnanagtcgaccngcangcntgcaagctttntnnncaaagaaggggngtgctggccggnnnggattcccccagccaaactgtctttgncagcacgtggggctcacttgtcatccttccccaantntcntagcccccgtnctaggttggacagcccccttcggctacaggaaggcaggaggggngagncccctactccctcttcactggggccacagcccccttgccctccgcctgggatctgantacatattgtggtgatggagatgcagtcacttattgtccaggtgaggcccaaganccctgtggncgccactgangtgggctggggctgctcccctaacctactttgtttcgcactnaccattcccctctanatggnacaatacaagantacctgccgtccaccctctgtctctgcccagttgtcattcttgtaaatacttgaagtggtgtttgtatgcatctcancgatgtgtgtcacncaatgtatctatgtctgctgcagncctccaaatttggga

SEQ ID NO: 8154 - DNA, 682 bp, Homo sapiens
  misc_feature 9, 10, 11, 17, 35, 60, 100, 101, 123, 135, 161, 174, 209,314, 384, 401, 426, 429, 444, 476, 502, 515, 525, 560, 568,571, 577, 591, 593, 611, 612, 614, 662, 675: n = A,T,C or G
aaactgcannnaagatncttccagttcttggattnctaggtggagtaatattttcctgtncaaattatttccatgttatcctccatggtggtgttggcannaatggatccactatagcaggcnccagtgtcttgncacctggactccacataggactaatnattatactggcantaatgatctataaaaagtcagccactgatgtgttngaaaagcatccttgctttatatcctaatgattggatgtgtctttgctaaagtctcacaaaaattagtggtagctcacatgaccaaaagtgaactatatcttcaanacactgtctttttggggccacgtcttttgtttttagaccaggactttaataattttatagacgaatatgntgttctatggatggcantggtgatttcttcatttgatatggnganatactttaatgcttngagcctgcaaatttcaagacaccttctttaantatattcaaaactgcatgtcatcaancacctgaacaagntcaaagttcnttcttcaaagaagtcatcagaaataaccatgggantggaaganacntttccnaacacttgctatcntnttgctgctgctggtttcnntngaggggaaaattaaaccatttggttaaattttaatttaaggggtattncctattttcaacnaaataaa

SEQ ID NO: 8155 - DNA, 699 bp, Homo sapiens
  misc_feature 2, 4, 6, 13, 15, 20, 22, 33, 34, 40, 43, 45, 53, 54, 65,67, 68, 70, 71, 74, 75, 78, 81, 85, 95, 98, 100, 102, 116,146, 167, 173, 178, 180, 181, 208, 214, 217, 260, 273, 279,285, 293, 294, 296, 298, 305, 309, 311, 313, 314, 316: n = A,T,C or G
  misc_feature 322, 323, 324, 338, 339, 342, 360, 371, 374, 381, 388, 389,400, 411, 421, 439, 450, 451, 457, 464, 472, 476, 478, 487,500, 501, 506, 510, 521, 523, 531, 533, 540, 548, 553, 575,577, 588, 591, 606, 612, 616, 619, 622, 624, 636, 637: n = A,T,C or G
  misc_feature 638, 652, 663, 666, 687, 691, 694: n = A,T,C or G
cntncncagcggnanagacntntccaataatgnnggatangcntntactaagnncacaagacttnanngnnatnnatngcngagnatcactcgcnctnanangattaccacgtgangagctatatcctcagcactctagtctgganaacctgcgaataaaaattaangatggnctacntnncttaacatttaacacctgtatggcccnaaaatnttnttgcttgctactatgcacataactaatgactatcttgcgcatntgatacctctggncacaanccaaanactgggtnntncngggaccngacntnanntnctagcnnngggcgttggacacnntanccttgtggaaacaataanaaaccattacntgncccatgnccctacnnacccatgatangccaaggaggngccaggtacntgagggtgactagctacntgaggtgggcnncatacnttacttnctcactgnagtngngtttgggtnaaattttaacccnnttacnccantggtagtcatncngtgatggncnatcacancagcaagnatganctcaagtagccctaaatgctcnangcaacctcttnttntgaggaaagaccttnactttntggnggnggnanaaactttacagnnntttttgggaacganttaatgtgggnctngcttttttgagaaggcccagncttncantacca

SEQ ID NO: 8156 - DNA, 701 bp, Homo sapiens
  misc_feature 9, 298, 327, 360, 371, 398, 409, 410, 412, 423, 427, 431,433, 446, 469, 483, 487, 492, 493, 507, 526, 559, 562, 565,596, 608, 636, 637, 638, 646, 647, 658, 675, 685, 686, 688,700: n = A,T,C or G
ccagagtcnaggctgagaggatgcaggtgtcctcctaggaggtttgagtcagaaggcacgaggcagaagcagtgggggaggactccctcagtagagcgaggaggaggcccctcatccaagaggaggttggagcacaggggggtctaggtttgcagtttcgggaccggtagctgaggggtcccagggcctttcttctgtgaaggagaatgtgtccaccgtggggagggggtcgggagagagagatacttcagagtggacagggctgagaaagctttatgggccgcgaaaggcagagtanttgttggtggatgagggtgcttgtggcangtggcgtttcatgtgagacagctcggggcccanaaagacactgngaggaggagagctcctgctcttcaganaaacaggagcnnanaggaaaaacangaancgcnancgagccggcttgnggtcttggggatgaaacccaagntttacagcattctnttgnctttnncttggtgggaggtnggggggccattatttctcnccccctggtcttgggtccttttcccttgcccanccnaangggaaaaacaagaaccccttccccctttttncgcttcaaggantattccaaaaactgtccaaaatcttttnnngttggaannttaaaatttcnttaattcccctttgtanttttaaaaannanggtttcaagatnt

SEQ ID NO: 8157 - DNA, 738 bp, Homo sapiens
  misc_feature 3, 35, 40, 43, 51, 109, 441, 457, 652, 706, 718, 731, 732,735: n = A,T,C or G
agnttcgattccgcacgagatacatccaccttcangcaancgnaaactggncaaccagtatgagaaattccacagtccaagggaaagagaagagtatagtgactgaggngggtctctctgtccaacatgcaggcagcactccctcatcctgctcagtgagagaattcagggggaatagaaaagctgctgagagttggtaaagaggatggtcgagtgagatggtgttgacctccctggatcttatgtcactacatcctggacctcaagagggtcatccaagctttttgaaagctgaactccttgactggagaaacctagacaagaggcggggccaggtgcttgatatctaggaggcattcttcctcttcccttgccaccatggagctgggcacagtaagccatattgtttcctgaagcaggagtcccaggccttggctaganagggaacagatgtctnacaaaaagagaagcaattcgaggaattgatgaagcacaattaaaatcctctctggctagtagctctctggctttctgttcatttgaagaataaatctttggcttgacagtgggaagcaccaggtttgaaatcagatggctttatttttcttttttttggcatttaaatcagtgaaataaaattattactggaganccacagttcgatttaaagagattcctcaccctgtttttcaaagtccttcttttnaaattccatgcnttggggggttaannggnaaa

SEQ ID NO: 8158 - DNA, 743 bp, Homo sapiens
  misc_feature 2, 23, 30, 32, 59, 71, 90, 533, 536, 591, 634, 705, 711, 743: n = A,T,C or G
antttcaattccgcacgaggaanatatatncntgaaggcctgtggcctaggaaaagganacactgaggtgnttcctacccaacatgtggnccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccanaantgagccgtctgaactgtgggaagggaagtgctaacagcccaacctccaacctggncttttcctccttcccctttgaacctcctgcaaccctgaacccntcaggacaattcatacccccttcctttttttccacccaatttgttgccaattaaattggggggttgagggntgaccntaggcagcattaagaatcacttattttatttn

SEQ ID NO: 8159 - DNA, 672 bp, Homo sapiens
  misc_feature 4, 32, 78, 477, 492, 500, 501, 516, 534, 570, 624, 636, 662,667: n = A,T,C or G
gaanccactgctgcgcaccctggagatgggtnggggaccctgggctcccgttaatgttgttgtggctccagatgcctnagaaataacttccagagtcaacaccatctgcggaagtgccgtgagacggtgcatgggctggagacagagacagccggcgccgaacatacctggggctgcccgtgcaaactggggcaagcccttcagcctccatgtggctgctttactatggagaacagaaatgactagaacctgacttgtggggttatggcgagggtggcatgagatgagctttgtaacaatgtgtttgtttatgggcagcaaaaccctgactcattgtctgggttactaatatccaagagttcatcatcagcgataattattgtcaatagtcgtaactgcaaaagtctcttttaaagctaaaatggatgccgggccagtggctgtaatcccaacactttgcgaaggccgaggcgggtnggatcacttgaggtnaggaattnnagaccggcctgggtnacaatggcaaaccccgtntctactaaaagtgcaaaaattaacccagggtgtggngggcaagtgccttgttaatcccactacttcaggaaggctgaggcaagaaaaatnactttaaacccnaggaaggcggaatttttccattgagnccaanaatcg

SEQ ID NO: 8160 - DNA, 746 bp, Homo sapiens
  misc_feature 5, 14, 17, 36, 40, 47, 53, 60, 61, 66, 71, 72, 81, 93, 94,95, 98, 102, 104, 105, 124, 125, 126, 129, 130, 134, 137,143, 146, 148, 152, 156, 157, 158, 162, 167, 168, 170, 201,211, 225, 230, 232, 258, 277, 284, 298, 303, 395, 422: n = A,T,C or G
  misc_feature 515, 560, 578, 586, 596, 628, 632, 637, 645, 674, 676, 686,703, 708, 728, 746: n = A,T,C or G
acctncgcttcaanaancttattctccttctcagcngcgncgtctgnacgctnattcctnnatcantattnngtagacggnccacccctttannnacntcgnanncatccatcacgcttcagcnnncgnngctntgncggagnatngncttntgtnnngcgnttcgnnangttcctgcaaaaagaacaagtagattgccanaagaactaangttaaagaacattncttcnanacactattaatgggcttaataagcanaggcaactgtttttgtcanaaaacanaaggaaagaacttntccanaggataattgtggagcttgttgaatttatatctcccaaaacccctaaacctggagaacttgggggaagaatatctgggtcagtggcttgganagtacccgaggtgaaatgggtctacanagaaaagaaaccttgtttattccctgtgaaaatgagaagatttttaaacagcttcccctttgttacaatattgtgaaagatcgttattgttcnagtttcaaatacaatcaaaccatttcttggatggggagaatggcntgtggaaaatggaatctntatttcanaaaaagttgnaacagactggcacatggtattttttggccccnaaanggaanggatcatntttttcttatttttccttggaagtttgantnttgggtcaanttggccttaaaagtaantaccnttttctatttaaaacaagtnttcaaaactttttaaacn

SEQ ID NO: 8161 - DNA, 1005 bp, Homo sapiens
  misc_feature 3, 4, 5, 6, 7, 9, 10, 11, 12, 13, 15, 19, 24, 25, 26, 27,28, 29, 30, 32, 33, 34, 35, 36, 37, 38, 40, 41, 42, 43,44, 46, 47, 48, 49, 50, 51, 52, 53, 54, 55, 56, 60, 62,63, 64, 65, 66, 67, 68, 69, 70, 72, 74, 75, 76, 77, 79,80, 82: n = A,T,C or G
  misc_feature 83, 85, 86, 87, 88, 90, 93, 95, 96, 99, 104, 106, 108, 109,110, 111, 112, 113, 114, 115, 116, 117, 119, 124, 128, 130,131, 132, 133, 135, 136, 137, 139, 140, 146, 148, 150, 152,153, 155, 156, 157, 158, 160, 161, 162, 163, 165, 166: n = A,T,C or G
  misc_feature 167, 168, 169, 170, 171, 172, 173, 181, 184, 186, 191, 192,193, 194, 195, 201, 205, 206, 208, 209, 210, 213, 214, 215,216, 218, 219, 222, 223, 226, 228, 235, 248, 253, 254, 255,257, 258, 262, 333, 510, 608, 636, 708, 760, 776, 793: n = A,T,C or G
  misc_feature 813, 817, 822, 848, 867, 888, 897, 927, 934, 940, 949, 953,966, 979, 985, 989, 996, 1003: n = A,T,C or G
ttnnnnncnnnnncnattncccannnnnnntnnnnnnntnnnnnannnnnnnnnnnttantnnnnnnnnntntnnnnannanntnnnntnttntnnttnatgtntncnnnnnnnnnntntgcgncgtntnnnnannncnntgttananantnncnnnntnnnncnnnnnnnnnttcgcccnccntnccatnnnnncccccntacnncnnnttnnnntnnttnngantntacagtnggaaacaatattnttttnnncnntggnggcctcccttcatttacctgggtgttttggctcaccaaagagttgtgttctgcaaatgtctgggcaatccntggagctaaactggcattagagtcaagtaacactcctcctctctccctgttcttttccttaaaatcttcaaaggcattgggggttttaccttagcaacttgctatttcgtcttcttagtttgaaccttcaaatatagctggatataataaaatgctcctcaaatgaggaagtaccanaaagaccagatgcatggtctcatgcttcccttgtgctggggcacaagatctaaacaaaaacaatgttgtgtccatattaaagagcttcataaatacanatgggagtgaatgaatgatttatgacangtgttaggttgtggaagcttggtagtaatacacagaattctcagaatcatgcctgtcccgtggaataaaaangaaaacaaccttttctttgtaagggttagaagatttgatggggaaaatccangaaaccatctaaggangctaaaagaaaagaaanttccttattaccccagaatngttnggatngtatttttgccaacattccttctcanttgcctggacaacgataangatttctattttggaagaatnaatgtggtnttaaaatcaagaaattcttgaattttttcnttggcanggcatngaggacaanagtngaaaaaaaaaatnaattgggaagaanaatccntatntggtaantttttcnca

SEQ ID NO: 8162 - DNA, 1022 bp, Homo sapiens
  misc_feature 2, 10, 14, 15, 16, 17, 18, 20, 22, 25, 28, 31, 32, 33, 35,37, 38, 41, 42, 46, 49, 51, 52, 54, 56, 57, 62, 65, 66,67, 68, 74, 75, 76, 77, 79, 88, 95, 96, 98, 99, 101, 103,105, 107, 109, 113, 118, 121, 125, 127, 135, 137, 141, 153: n = A,T,C or G
  misc_feature 154, 158, 159, 160, 161, 162, 163, 164, 165, 166, 167, 168,172, 174, 181, 189, 196, 204, 205, 206, 213, 214, 216, 217,218, 228, 234, 242, 246, 247, 249, 258, 269, 270, 276, 278,279, 286, 300, 308, 309, 318, 329, 344, 366, 368, 378: n = A,T,C or G
  misc_feature 379, 380, 385, 388, 393, 408, 422, 452, 460, 465, 467, 469,485, 488, 508, 510, 513, 524, 527, 532, 543, 545, 550, 554,560, 571, 604, 622, 629, 630, 649, 651, 671, 672, 675, 676,677, 682, 683, 689, 691, 692, 698, 699, 703, 704, 705: n = A,T,C or G
  misc_feature 706, 711, 712, 722, 724, 731, 732, 741, 747, 757, 758, 761,763, 764, 769, 775, 779, 784, 797, 801, 808, 810, 812, 816,818, 819, 821, 835, 838, 842, 851, 853, 857, 866, 870, 888,890, 896, 899, 900, 902, 905, 914, 924, 927, 931, 936: n = A,T,C or G
  misc_feature 942, 955, 957, 962, 964, 968, 975, 980, 985, 987, 990, 999,1002, 1008, 1013, 1017: n = A,T,C or G
cnctcctttncctnnnnnantntcntantcnnnantnnttnnaaantancnntncnnatatntannnntctagnnnntntttctttcnctcatannanntntntntntntctntgtanttnattntncccccccntnactnaccccccctctnntctnnnnnnnnnnntgancntcagtcngacacganattctgngccccctnnncccctgnncnnngtacaatacncatggntctgttcnccanntntccccctgnagtggatgctnncctgcntnngggaggntttctcctaacttncattcctnnacttcccgnaagcagccccnaacacttacttatanagccatctctatctgaattagnanatcatggatnnnctcantanctgancatttccttatcagntaccaccaatatantattttaacactgtctccttttcacacacnctagcttnctaanancnagctggggggctggcntgntgatccacgcctgtaatacnancantctgtgtaggnagncgtgncggatcacttnangtcanggantttganacacagcctgnctaacatggttgaaaaccccttctcttctgaanatgctaaaatatactggntggtgtnnggcatgctctgttgatccnanctacctcactgtaggctcgnngcnnnagaanncccttnanncccatnnggannnntatgnntgctattcgngnccatggnntcaacaccnaacttngacttcctannttntnnggggntgtatnaaanctganaatactcttcctncaanatataananantaananntngtccaataatcccnctntacngtgacttcntntacnctctctccncacntatcattacatctgcctncnccccanctnntnaantatatgaanaatacaccanttntgtntctanattctnattcggccccttncnttggntncacntatttantttcnatttntnacnccatattcnttnatcgtntctanctcnttccc

SEQ ID NO: 8163 - DNA, 991 bp, Homo sapiens
  misc_feature 2, 3, 4, 5, 6, 7, 8, 10, 11, 13, 14, 15, 16, 17, 18, 21,22, 23, 24, 25, 26, 27, 29, 30, 31, 33, 35, 36, 38, 39,41, 42, 43, 44, 45, 46, 47, 48, 49, 51, 52, 54, 55, 56,57, 59, 60, 62, 63, 64, 65, 66, 67, 68, 69, 70, 71, 72,73, 74: n = A,T,C or G
  misc_feature 75, 76, 80, 82, 84, 85, 87, 88, 89, 90, 92, 95, 96, 100,101, 102, 103, 104, 105, 106, 107, 109, 111, 113, 115, 117,118, 120, 121, 123, 126, 127, 130, 131, 132, 133, 134, 139,142, 145, 146, 147, 148, 149, 150, 152, 161, 162, 163: n = A,T,C or G
  misc_feature 165, 166, 167, 169, 171, 172, 173, 175, 176, 177, 178, 179,181, 186, 196, 198, 212, 219, 225, 226, 227, 242, 253, 267,295, 561, 597, 649, 697, 713, 718, 730, 811, 812, 817, 819,858, 861, 870, 875, 884, 886, 898, 911, 913, 917, 926: n = A,T,C or G
  misc_feature 927, 928, 945, 950, 953, 958, 964, 979, 983, 990, 991: n = A,T,C or G
tnnnnnnntnntnnnnnnttnnnnnnntnnntncnntnntnnnnnnnnntnnannnnanntnnnnnnnnnnnnnnntctntncnntnnnntnggnntatnnnnnnnntntntntntnntnntnttnnttnnnnntcccnccnccnnnnnntncccctcccnnncnnntntnnntnnnnntnagttnacagtaggangnggaggctcttcttnacgtgtngggacnnncatcctggggcattntcaactgcgtnttcattgtgtactntctgatggagatgctgctcaaggtcttnggcctggtcctgcgagggtacctgtcctaccccagcaacgtgtttgacgggctcctcaccgttgtcctgctggttttggagatctcaactctggctgtgtaccgattgccacacccaggctggaggccggagatggtgggcctgctgtcgctgtgggacatgacccgcatgctgaacatgctcatcgtgttccgcttcctgcgtatcatccccagcatgaagccgatggccgtggtggccaatacccgtcctgggcctgggtgcanaacatgcgttgctttttggccgggatcctggtggtnggtctactacgtatttgccatcatttgggatcaactttgttttagaggcgtnattgtggctcttcctggaaacaagcatcctggcccctgccaatggctnggcgcccctgtggganctttncagcagctggantacttggggcccaaacaacttctaatgaactttgccgggcttgccccttggtccacttcttgtgggaaactttgattgggnngggtngnaaccaacttggccaaggtgtttttcttgggaatgcattnttngggcgcttncttcnaaggccccngnggtcccaagaancttaatttttgtnanttgnggggggggnnntggtggttcttatttgncattnttnggggncaaccntgtttttttgggccncttnaattttnn

SEQ ID NO: 8164 - DNA, 1054 bp, Homo sapiens
  misc_feature 3, 4, 7, 9, 10, 15, 19, 20, 24, 27, 30, 36, 38, 47, 49, 51,54, 55, 56, 57, 66, 82, 83, 85, 90, 102, 103, 112, 120,122, 127, 131, 139, 147, 150, 154, 155, 165, 166, 168, 170,171, 172, 184, 188, 192, 203, 214, 215, 226, 227, 234: n = A,T,C or G
  misc_feature 240, 248, 251, 252, 262, 268, 269, 286, 287, 301, 316, 320,328, 330, 331, 332, 333, 335, 341, 346, 352, 361, 365, 367,375, 377, 382, 389, 394, 397, 407, 414, 419, 421, 425, 427,429, 435, 437, 445, 452, 454, 455, 466, 468, 478, 479: n = A,T,C or G
  misc_feature 484, 497, 501, 518, 524, 531, 534, 539, 550, 554, 558, 561,568, 581, 591, 592, 596, 597, 598, 603, 610, 626, 632, 633,635, 642, 643, 659, 661, 663, 684, 687, 688, 689, 691, 693,699, 715, 717, 718, 723, 734, 738, 742, 752, 753, 754: n = A,T,C or G
  misc_feature 769, 770, 773, 774, 783, 787, 799, 804, 807, 809, 812, 817,830, 831, 832, 834, 843, 844, 846, 861, 863, 865, 869, 870,880, 881, 883, 884, 897, 900, 916, 920, 922, 924, 932, 937,940, 953, 954, 958, 964, 965, 966, 970, 979, 981, 982: n = A,T,C or G
  misc_feature 992, 1000, 1008, 1013, 1017, 1020, 1022, 1023, 1026, 1029,1030, 1033, 1038, 1039, 1052: n = A,T,C or G
ttnnctntnnttctntttnntttngtntcntctctntntcgtttgtntntnttnnnnttggttgtngtttcttttctgttcnntnttttncccctccccttnncccccctcncttctttntnttttngttncagtgganggtttttnttncctnngggcccgggnntngnnntttttttttctnctcntttnattcctttttngtggtgttganncttggggaaannggggggntttttncatgctcntcnnccacttttcntttacnnggcttgcttcctttgtnngtttttctttttcntcttttctatctttnttgnttttttcntnnnntntttttntggcngttttnctcctcccncctntngctttttncntctgngtctttnttggntcntctctcattntttgtgnactcntnctgncntngtttcntntactcttntcctgtntnngctatcttctntnacttctattnnctttntttctctgttctnttcntttcttttgttctgttncgttcntcttttntcnttttnctctcttctcntttncttnctntccttcntgtcctcctcttntctcttttcnntctnnntcctncgtttcncgttttttttttgtcnctcttnngnttcttcnncgttcttgcttcttcntntnttttttccctctttcctcttncgnnntncngtctcntttatcaagtctactntnntttgntctcttttctnttcnttgnctgctttctnnncctgcttttcctctnnttnnctttctttntacnctttttcgttanccttnctntnctntttcnttgcttttctttnnntnccctctttnngntcttcgatttttccntntntttnncgttccattnntnntccttttatttcnttntcttttatttctggtntctntncntttctctntgtanctnttcttttacttcnntttnttggtnnncctnctttttctncnncgatcgcttnttgttctngctcttcntctcnttcnttntnntgntannttntactnntttctcttcttcncg

SEQ ID NO: 8165 - DNA, 711 bp, Homo sapiens
  misc_feature 5, 583, 655, 676, 684: n = A,T,C or G
aggtntcgaatcgcacgacttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattaactattactcaactttacaatgcaaacatcttatttctcatctttaaacatgtcgacaagtttaattgaaaagtattctgagactgcaaaatggggtgttaaaaaatactgcagttacngactgtgtaaaccagttctcattgcataagatcagatgtaaatgcatggagaggtgatatgcactgtacagnattcactccccatttcacatnttgcaganaatagtcttgtcatactgagtgtctaa

SEQ ID NO: 8166 - DNA, 825 bp, Homo sapiens
  misc_feature 3, 46, 47, 49, 56, 57, 60, 61, 66, 67, 71, 81, 82, 84, 85,89, 90, 92, 93, 98, 117, 123, 128, 131, 144, 147, 152, 213,219, 221, 241, 245, 257, 280, 284, 303, 415, 452, 467, 473,475, 480, 482, 490, 509, 513, 516, 523, 526, 531, 533: n = A,T,C or G
  misc_feature 537, 541, 543, 553, 554, 555, 556, 558, 559, 564, 572, 582,589, 590, 597, 599, 604, 615, 616, 625, 635, 643, 645, 650,654, 656, 663, 664, 666, 679, 686, 698, 700, 703, 704, 708,711, 714, 721, 724, 727, 729, 730, 737, 740, 742, 744: n = A,T,C or G
  misc_feature 746, 752, 754, 755, 758, 763, 764, 775, 776, 784, 803, 804,805, 806, 808, 815, 818, 819, 823: n = A,T,C or G
atncttttcgaattcggcacgaggttgttgttaccgtgtgcccccnngncccatgnnggnngtgcnntgtngacacacagnnanncaannanntgtgncagtctgtattctggagcnttgctncttgncanttgatttgtactntanttagnagaagcctgtacactgtagcgtggccagatgtggagttcagaggcatgctcacctggctgncttttnantacttaccttatagccattnttanactgagagcttnaactgaacatataatcaaatttngtgntaaggaagtgagattttancagtatttttcagttttgaagttcgaaaccatcccaaggcataggagccatagcctcaactgaaattgaatttttgtagggactgttaattgccatttgtacctaatactgnatatatacatatatataccgtgtgtatatatatatanatatatatatatatntatatntntatananatatatanacatatatatatatatatntatntantacatanttngtctntntcantgantntacaagagannnntnnttcantagaacantcttcaatcnacactcnnctgtccncncgctncgctcaataannctcctaacnatcacttcancccctttncntctcncctngnatagacnnanaaatcttactcancttcttnttatcatagtcntnttnnatantanaanacctctnttntancnnatcatcnttncntncntgcttngnntanaacgnnagaaatatctnnacatcttntcttatctccaattcttcnnnntncttacanccnngcgnct

SEQ ID NO: 8167 - DNA, 729 bp, Homo sapiens
  misc_feature 3, 7, 11, 14, 15, 16, 18, 25, 35, 41, 42, 47, 53, 59, 63,66, 67, 69, 83, 87, 88, 94, 95, 96, 98, 101, 103, 104, 112,116, 135, 137, 141, 171, 292, 312, 330, 374, 420, 441, 480,484, 489, 522, 548, 563, 575, 581, 584, 600, 628, 650: n = A,T,C or G
  misc_feature 656, 661, 664, 674, 677, 683, 688, 699, 706, 714, 728: n = A,T,C or G
ccncgancccnatnnnanaaataanattgaagatncttccnnttctnggattnctaggnggantannanttacctgtccaaantatnnccatgnnnanccncnntagggcangggnaagaatcatggctcatgantngtgngggacaagtggtcgcagagcacaggctctnggtaaggagacctggtttgagtttataaccagagacaggcagttcaccaactgagtctcaaatccttatctggaaaatgggaataatttgtcttctctggccgagctgctgggaagctcanagatattactgcataagaangtgctttatacctgtgangcgagatgggaaatgaaggatgattgtcttgatgatgattttgngctggagctggcttacaatcccctgacagtgacacctgtaccatanaagtgagagaacccagcgacnccaagtgagactgggaaggataggccctgggtttgaatncccnctgtnctcgttgtgggcccccttgacttttttgacaancctcatcacattccttaaccctcaanttttgccctgtctgntaaaaaagggtncacaantgntgcctttgtgccccanttaaacccaaggaactggggaaaatgcnttggccttgaggggacaatgantaaccncaatnggngggccttgtnaangaattnggccntgggacccttnagggggntcccctantaagggggccaaant

SEQ ID NO: 8168 - DNA, 749 bp, Homo sapiens
  misc_feature 3, 6, 13, 14, 16, 25, 26, 27, 37, 39, 40, 41, 43, 54, 58,65, 69, 71, 73, 75, 76, 77, 86, 87, 91, 92, 105, 111, 114,121, 125, 140, 141, 146, 495, 507, 607, 660, 676, 683, 686,699, 731, 748: n = A,T,C or G
acnttnacgagtnngnccgaggtcnnnatcaatgtcnannncntcaacaggggnatanctgaccntaanantncnnnaacgtctgnncatnnctgttgaatggcnctgctnatnatagtantgtntgccgaggaaaactnngaatntgacgaggcttataaaaccatggtagccaggcgtggtacgtagctcacacctgtaatcctcccaaagtgctgggattataggcgagagccaccacgctcagtgagtatgacatttttaaaagaacagtataaagcataaaatatcccatgtggggcaaactcccagattattttcctaaacaaatagaaaaaatgcttcctgaaatagggtaagagaggatgagtcatcaggatccctgaaacaaagatctcaaacaggagaccttacgtatattattcatcaatatcttcagtgcaaaaatgcaaagccatttacagaaagggcacatagtaagctttacatactttncttaggaacagncttaaaacttaaaaatctcatggtttaataaagagtaataattttatggggaagcaattttaagatttaaaatttcagagtatcttccataccagcagtnttatttaaagtagtggaaaaaataagacaatttaatattcccatggatggatngattaaaaattgggtntggtcanggnggaaaataaaccntgccccccaatttaagacttcctggccaaaantttgggggaaaaaggtnt

SEQ ID NO: 8169 - DNA, 1498 bp, Homo sapiens
  misc_feature 2, 3, 4, 5, 9, 10, 12, 13, 15, 17, 18, 20, 21, 22, 23, 25,26, 27, 28, 29, 30, 31, 32, 33, 34, 35, 36, 37, 40, 41,42, 43, 44, 46, 47, 48, 49, 51, 54, 55, 56, 58, 59, 61,62, 63, 64, 68, 70, 72, 73, 74, 75, 76, 77, 79, 81, 82,83: n = A,T,C or G
  misc_feature 84, 86, 87, 88, 89, 90, 91, 92, 93, 94, 96, 97, 102, 103,107, 109, 110, 111, 112, 113, 114, 115, 117, 121, 122, 123,124, 126, 127, 129, 133, 135, 137, 140, 144, 147, 148, 149,150, 151, 152, 154, 155, 156, 159, 160, 161, 165, 166: n = A,T,C or G
  misc_feature 167, 168, 169, 170, 172, 174, 175, 176, 177, 179, 183, 197,200, 201, 202, 203, 205, 211, 212, 213, 215, 217, 220, 222,223, 224, 226, 227, 228, 229, 230, 231, 232, 233, 234, 235,236, 237, 238, 239, 240, 241, 242, 243, 244, 245, 247: n = A,T,C or G
  misc_feature 248, 250, 252, 261, 268, 271, 298, 301, 305, 306, 308, 309,312, 316, 317, 320, 321, 326, 336, 338, 345, 348, 350, 351,352, 353, 360, 361, 364, 366, 377, 380, 385, 389, 396, 401,403, 416, 422, 424, 442, 444, 448, 463, 471, 476, 494: n = A,T,C or G
  misc_feature 498, 508, 513, 526, 527, 529, 530, 537, 538, 550, 556, 561,562, 565, 567, 575, 578, 591, 596, 598, 599, 600, 601, 605,611, 612, 615, 616, 620, 621, 622, 623, 625, 629, 630, 633,638, 642, 647, 655, 656, 659, 666, 668, 670, 676, 678: n = A,T,C or G
  misc_feature 682, 687, 701, 702, 705, 707, 710, 711, 713, 714, 719, 722,723, 732, 740, 741, 749, 750, 753, 755, 756, 760, 761, 764,769, 774, 782, 783, 784, 797, 798, 806, 808, 811, 814, 818,821, 822, 823, 829, 831, 832, 833, 836, 837, 838, 844: n = A,T,C or G
tnnnntctnnanncntnncnnnncnnnnnnnnnnnnncannnnncnnnncnacnnntnnannnncttncncnnnnnntntnnnncnnnnnnnnncnncgctnntctntnnnnnnntnggtnnnngnnangtcncngntancccncannnnnnannnatnnntatnnnnnntntnnnntncgcncccccccgcccccntannnntncccccnnncncnttnannntnnnnnnnnnnnnnnnnnnnnanncngntttaccaanattcccnccncggggggggtcctataaatgcctatcnacnaggnncnnccncctnnatnnccccnatttctagcngnccccttnaanannnncccagcnnttntnttatgctggangangggantgcnacgttgnccctncnggggggggttttntagtcnanaaagggcccgacggccanangccngtgggggagggactncactcagnataancgaggaggaggccccttnatcnaagaggaggntggcnccccaccggtgcnncnnaggttcnnccttcttacgcncctggntactnnagntnttctttgntcntaacttatttgcntcatnannnntctntctccnnctnnttannnngnttcnntcngctancatntttancatctctnnttnctactanantntctccntnttcnactangaacttccgatcannggntntanncnntctcntcnntgactaacntcatctgnnatcttaanntcntnntttnntgntttcnactcnttttttgnnntctcactgtcatnncactctananagntcncttnctnnntatctnannntcnnnttcacnncttctntnntccttntnatcgcnnntcatctacgacctctatgcnatcanatgcgcgngnatcatatgtgccnttctnacaagtntanntcntcgnntaattacnctcncatantatctcacnnctttcntttcannactantatgntnggtgaggctatatagnacttngtgganggggtcntctcttntacntttnatcgtgnggnacgntttncttnnctatnatctntancaantttncttanatnctggggtcnaacnnnananncnaancntcncgcncncnaanatacnctgctatnnncatgcttnanacatatntatnaactcntcatcttntancgcttcatntgnatctctcntctgtttctntnatacatcanaatccatnnctgcnacnctcntntacnnctcctatnatatgcnnttcttcacanttntacctaccgttcaccatntatnnaactatanntcacatnttanatgnncnnntacnnncctcnntgancaatnctgttttcttnctctctctcatctntntatgngtnttacntcttannatctntctncacgcntntatcntangcgtctntncaaaaatntacgnntctnncncatcctcacnctctnganccgatctannnctgncca

SEQ ID NO: 8170 - DNA, 947 bp, Homo sapiens
  misc_feature 1, 3, 31, 32, 38, 79, 87, 88, 95, 97, 100, 101, 103, 110,122, 157, 225, 228, 237, 258, 263, 266, 268, 274, 275, 282,288, 297, 304, 308, 324, 326, 337, 339, 346, 353, 354, 362,363, 364, 366, 367, 370, 375, 376, 379, 382, 391, 395: n = A,T,C or G
  misc_feature 396, 404, 410, 412, 413, 416, 417, 418, 422, 426, 428, 429,432, 433, 437, 439, 440, 450, 459, 463, 466, 467, 469, 475,476, 477, 480, 485, 489, 490, 492, 496, 500, 509, 510, 523,526, 530, 537, 546, 549, 553, 555, 560, 561, 562, 563: n = A,T,C or G
  misc_feature 566, 568, 572, 573, 577, 581, 583, 596, 597, 600, 606, 609,610, 612, 620, 628, 629, 631, 634, 635, 636, 641, 646, 649,658, 661, 667, 668, 672, 681, 683, 684, 687, 688, 691, 692,693, 695, 696, 704, 707, 726, 727, 732, 736, 741, 754: n = A,T,C or G
  misc_feature 765, 771, 776, 778, 783, 789, 797, 804, 816, 817, 818, 830,832, 839, 862, 865, 866, 867, 869, 874, 898, 912, 916, 917,919, 925, 928, 929, 934, 935, 947: n = A,T,C or G
ncntcaattccgacgagggtacttaataagnngacaanccagaaacaatattgaagatctgaaaaatctagccgaccanctctaggnnggccctntntcnnanagtgggngatgggcattgntttaactattaccttaggtccgtgataatatcccntggcccagcagaaattatatacttggcaacacatatttttcaccaggaagcttcacccagacactgancanaatggtctnttgcaccaataaaggctcacntaaanggntngtggtnncccaagnaaatanacatttctnaattgcnaaantggtaaactgctttancnccatacaaggngnctatctngaaacgnntttttctnnnanngcntcatnngtntcntcttctatngccnnattaactnattgantnnttnnnatgncatncnnaanngcgntnnacatctcctncttatatcnaatnccnntnatctcnnnatnctacntccnncnatcntttnttcattcanntttattaccttgntcnccanctgctanccgtcttcnganatcnanccttnnnnttntncaannctantttntntcaaaatgggccnnctnttttanatnncnactactgngatatatnntntcnnntgacngtttnatncccctaacnacnatatcnnactnttctctccnannaannaannngnncatttatnttnacgggaaaaaaaatctcannctccngcgnccctngattgggctttcnacccccttggnaaatcncccancnacctnttgggnaaaggccnaagggtnggcccaaaaatnnnccttgaagggtntnaaggaanttttctaaaaaccaagccttganccnnntnttggngaaaaacccccggtttttttcttnaaaattcccaaaanttcnncnccagcnctnnaatcnngcccccctctgn

SEQ ID NO: 8171 - DNA, 689 bp, Homo sapiens
  misc_feature 3, 485, 509, 536, 564, 583, 650, 669, 675, 686: n = A,T,C or G
aanttcaatccgcacgagggatcttcttcaatcagcaataacaggtggctctatagaatggagggtagaagggatgtgggtgacttactcagtttttagttaaagaggaccctcttctgttagcatggtgaagtgcagtttctttaataaattgtgcatggtgggggtgggatttggattctgtgatacaatcttgtttctttaggaatcttttacttttggccacttgcctttctttccaaggaatcccactccctttcaaggtgcctcatgaactgttttcatgaactttccaaacattggtttctgcttgtttctaagcctgattcttggccttctcattaattttcaaaacttccaatatccttccaaataattcccttttgcttacgttagcgagtactagtttgttagccagtggtaagttctggtgatcctaaccaaaaaaccctaactgagatatcagctcttaacgcaaaagttgngaatcggcatcctcatatgaagangggagtgggaattgggtgtgggacttncgggatatccaacagtggatgctaaagnccttacataaaatgcatanattggtatatcctcccatcatcatctctagatattatagacttatacaatgaatgctgggagcatcnggattttactggattttgnggttgnggaattaaaanatt

SEQ ID NO: 8172 - DNA, 888 bp, Homo sapiens
  misc_feature 1, 6, 23, 26, 37, 49, 52, 59, 62, 106, 110, 112, 117, 133,147, 178, 210, 221, 225, 245, 263, 267, 271, 278, 292, 310,318, 326, 329, 335, 340, 342, 346, 357, 375, 380, 381, 383,387, 388, 389, 393, 396, 402, 409, 412, 414, 420, 423: n = A,T,C or G
  misc_feature 424, 425, 429, 435, 451, 453, 454, 456, 458, 466, 474, 477,481, 495, 496, 500, 513, 514, 515, 517, 518, 520, 527, 533,536, 540, 545, 548, 550, 552, 555, 565, 566, 568, 575, 576,577, 579, 581, 585, 589, 600, 605, 607, 608, 609, 614: n = A,T,C or G
  misc_feature 615, 621, 625, 630, 631, 632, 637, 638, 641, 642, 646, 650,676, 685, 691, 696, 698, 703, 707, 715, 719, 722, 728, 732,733, 739, 741, 743, 745, 752, 787, 804, 808, 809, 810, 811,817, 823, 827, 828, 835, 837, 838, 839, 840, 859, 866: n = A,T,C or G
  misc_feature 873, 879, 884: n = A,T,C or G
ncttcnttcctcgaggacactgnctnctgaaggccgntggcactaggcncancagacantcnctgcaggtgcaccaactacagactcacactaatggacaaggagntttncncaatncagtcccacgcctttncaggtaggggccangggggctgtgaatgggatgcagccccatggngtccctgataaatccagtgtgcagtcttgatnctccaggtggncagncagattatagtgcagcctgngctgagtattatagacancaancatnctattgntgtccagacaagtncccaggggaatgccacanctttcttnagcacctnatngtctanttttnanaacncggaccgttancagtttttgcttcatttntttgnngngaannnacanacntttttnttaaacnatntnagattnctnnncganctttcnttaacgcatccttctntnngntntttcggtntataaaancgnttgnctattttttttttnntctncgacaatggtccnnnanntnttttttntctttnttngagnggatnggntnanatntcttcttgtnnancaaaatnnnantntttngtcnttgtttttttnacctnannntgcanntggaantttnactannncttcnntcnnattncttnacaccattgggcccttttccctactntttaccacntcgtanaacantnctctngtanctacttangtanctncttagngtgnnaatatntntntncaccctntttctacagctctgtattcatcttcctcagtattntccttactctttacatntatnnnngtttantacgtntcgnntcttatngnnnntaccctcctactatttgtnacttatncacactnttctcntcatnaccc

SEQ ID NO: 8173 - DNA, 721 bp, Homo sapiens
  misc_feature 2, 8, 566, 570, 596, 601, 634, 666, 671, 675, 696, 698, 718,721: n = A,T,C or G
anttcgantcgcacgaggtgcctcctgcctctccaatcctgatcccccattcccagccaaggagaggttttcagcccttggtcaccctgatgacctgcagctttccaggccctaggctgagaagtttaagtccagtgtctcattaatcctcataataatctagggaggccgggcacggtggctcacacctgtaatcccagcactttgggaggctgaggcaggtggatcacttgagttagaagtttgagaccagcctggccaacatggtgaagccccgtctttactaaaaatacaaaaattagctgggcgtggtggcggatgcctgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatttttaaaaaaaaaangaangaaaaaaaaacccccttcttttaaanaaaanacctaacaaattttaatatagttatctctaccnctttctttttaagtttcttgattttaactcangctgnattntaactcatctgggaaaacaangngttttgattaaaaaaatatnaan

SEQ ID NO: 8174 - DNA, 733 bp, Homo sapiens
  misc_feature 3, 12, 19, 22, 24, 25, 26, 29, 41, 60, 67, 80, 100, 104,422, 490, 507, 541, 592, 625, 627, 644, 659, 664, 675, 691: n = A,T,C or G
acnttcaatcgnacgaggnctntnnnctnatagccgcgggncccagaattcccaagcgtnggattgntcacccactaatngggaacgagagccgaacagntgangagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctctttgaaataaaaaatatgagtnaaaaagaccaatctgatcgtggacagcagaaagctgggctacctaaataaaatggacctgccatacangtgcatggtcagattcngagaagtattcaatttcttgatggagaaaggaanatggcgagtcattggaattttttgagactcaatttattttatcttccaaancactctttgcagaaaacaactgggcccacacangnccataccggagtattgnacttattcgctctgntcctnccaaagcagtnttccgacagaaatggntgaaaatgagtcatgaacccccgaaaggctaaaaggagaaat

SEQ ID NO: 8175 - DNA, 808 bp, Homo sapiens
  misc_feature 3, 4, 32, 44, 489, 529, 543, 576, 594, 616, 648, 691, 699,706, 721, 730, 740, 780, 798, 799, 800, 801, 802, 803, 804,805: n = A,T,C or G
acnncgctttactagcttattatcattcgcanccctgctctctnacccccagcgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagagagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacagtgtcttctangaagcccagacacatggagaaattcttgagtgtttttggncgataagtcccaanatgaaggttccagccaacaagcttggggatcancccattaaaatgttgaantgaaggaaagcttttgaaaatnggtttcaaaccccttaacccccccacctgganccttcattaaggaagaccccccaaggaaatggaagaaaatcancctggggncccaaancccttaaccaaaaancctttcaanaaaatttccngaaaaattaaaaaattaatttccaattctttaattttttnaaaaaaaaaaaaaaaaannnnnnnnccc

SEQ ID NO: 8176 - DNA, 1361 bp, Homo sapiens
  misc_feature 2, 4, 6, 7, 11, 12, 19, 21, 22, 23, 26, 29, 30, 31, 34, 35,37, 38, 41, 46, 48, 49, 50, 51, 52, 54, 56, 58, 62, 64,66, 67, 68, 70, 71, 72, 73, 75, 78, 80, 83, 84, 85, 87,99, 102, 107, 108, 111, 115, 116, 120, 124, 128, 129, 131: n = A,T,C or G
  misc_feature 133, 134, 136, 138, 140, 147, 151, 154, 155, 171, 172, 173,175, 176, 177, 179, 180, 182, 183, 186, 187, 188, 191, 192,194, 196, 199, 204, 207, 208, 209, 217, 221, 230, 233, 245,250, 254, 259, 266, 268, 269, 270, 271, 288, 292, 293: n = A,T,C or G
  misc_feature 299, 300, 302, 307, 311, 319, 322, 324, 325, 332, 335, 341,345, 355, 359, 362, 372, 380, 394, 401, 402, 417, 420, 421,423, 438, 443, 448, 464, 467, 469, 476, 478, 490, 494, 500,503, 508, 526, 528, 538, 544, 548, 549, 554, 555, 556: n = A,T,C or G
  misc_feature 558, 567, 568, 570, 576, 581, 582, 585, 586, 587, 591, 603,612, 632, 639, 640, 641, 647, 648, 658, 667, 668, 676, 680,685, 686, 690, 697, 704, 713, 714, 717, 723, 725, 728, 731,737, 750, 762, 764, 772, 774, 780, 796, 799, 800, 807: n = A,T,C or G
  misc_feature 808, 823, 824, 827, 829, 836, 838, 851, 852, 854, 861, 867,872, 875, 884, 892, 902, 923, 924, 930, 932, 933, 934, 937,943, 944, 957, 959, 961, 965, 971, 974, 991, 992, 994, 996,1003, 1007, 1009, 1018, 1022, 1033, 1037, 1041, 1048: n = A,T,C or G
  misc_feature 1071, 1082, 1083, 1091, 1094, 1095, 1098, 1100, 1104, 1105,1121, 1126, 1133, 1145, 1153, 1161, 1163, 1168, 1175, 1176,1182, 1185, 1190, 1197, 1210, 1214, 1218, 1220, 1223, 1228,1234, 1260, 1267, 1278, 1281, 1299, 1301, 1305, 1312: n = A,T,C or G
tntntnnctcnnctttttncnnnccntcnnntcnntnntcnttctntnnnnncncntntctntncnnncnnnntntcncntcnnntncttcccttcttnttnctctnnctnctcnntctntctncctnncntnntntntnccccccnctcnctnntcctccccccctctcnnntnnntnntnnttnnnccnncnangtnggaanccnnntttttctnttancttttctcnccncccttttgtctncttcntatnccttntccaccncnnnnttttttttgttggcctngatnnctcccnncncttgnggtncacttttnttntnncccttcnccnccttancttnccccctctcntctntcnttcttgcctncttctctntcctctctcacccnccgttcnncttctcttttacttntcnntncccctctccccttcnttctnccccntctctcttttccgacntcntntcctccncnttctctttgctncctncacttntcntctcncattcttctctctctccntncccttccggncttttncttnnttcgnnntncctccttcnntntctccnttttnntcnnntacntcccctctcccnttactcccnttcctctctctctcctcctnctccccnnncctctnncctcttcctnttctcttcnnctctcccntttnttctnntgcntctctcncctcctntcctccttnnctnacctcntnctnctntcctcntcttcttcttctncgacctcacctncntccctctncntctctntcctctcttctctccntcnntctctcnnttctcttttcttctnnccncnctttgcncnctctccttttggnntnctttccnattctnttttntcntcccctctnctcctttntttttctccnctctcttctctctttcccatnntttttncnnnctnttcccnnttctttcttatcntntntccnccttcnctntctcttctctcttccanncntntctctcntttncnctccctacncttntccctctcccnctcnttcntctcttnctccctctctctacccacttctnttctccttacnntctgctcnacnnttntntctnnctctgtacctatctantttcnccttcanttactccccctnttctcctntttctctntnctctnttctctnnctcctnttncttcnttcctcntttctcctctacntctnctcncntcnatctnctcccntctctgtctcccttccctttttctcntctattnctccttcttcnttnctccctctgctcctctcntnattntctgtcntctctctcctcttcttctctttctcgtcacnccgcttcancnctttcct

SEQ ID NO: 8177 - DNA, 740 bp, Homo sapiens
  misc_feature 77, 84, 300, 324, 331, 332, 333, 339, 345, 348, 349, 352,356, 358, 359, 360, 365, 373, 380, 382, 388, 389, 390, 391,402, 405, 406, 411, 415, 423, 424, 431, 432, 433, 434, 435,437, 443, 445, 456, 458, 462, 465, 467, 479, 488, 489: n = A,T,C or G
  misc_feature 490, 495, 497, 501, 504, 505, 507, 511, 514, 516, 517, 520,524, 528, 532, 534, 543, 548, 554, 562, 565, 572, 573, 576,581, 588, 589, 594, 595, 597, 599, 602, 604, 607, 608, 614,616, 626, 642, 649, 651, 657, 658, 665, 675, 676, 682: n = A,T,C or G
  misc_feature 683, 687, 690, 692, 704, 705, 706, 708, 714, 715, 726, 735,740: n = A,T,C or G
ctgcactgcaagggaggtgagtgagaccaaggaactacacccaccaagatcccttccaagggtctaagttgcttctntaatcanaaacctctcaaacctttgcgactgtgcacataggtcccatgatggctttggcaacatttacctgggaccagggtgaacttcgtaccatgtattgcatatgagaaaagaaaagaatgtttgtcaaacaaaccactatgttttattttattttattttagtgttgctggtaggtgtgtagtgagttctcagtgtgtgtgtgtgtgtgtgtgtgtgtgngcagtttttttttttttttggganggggttnnncttttncccccnggnnggngggnannnacccnattttggntacccanancctgtnnnnccgggttaaangannttctnctgnctaaaccnncccaaannnnntnaaattncnggggtgttccntncccnccnanttaattttttgnctttttttnnnaaaancnaganttnncncctnttngnnggncccngggntggnanaaaaaaatnttccngggccnaaaaaggnaanccccccnnccnttaanccccatnnaaggnngngnggnanttnnaggggngnggaccccctnggctctcggttttaanggggggntnaaaaannggttttnccttaaaggnnccttgnnaatnccnanaaaaatttttcnnncngggaanngcttttctggnccccttttngggan

SEQ ID NO: 8178 - DNA, 727 bp, Homo sapiens
  misc_feature 25, 37, 38, 40, 41, 628, 646, 676, 704, 717, 727: n = A,T,C or G
aagttcaatccgcacgaggttcatncataatgtagcnngnntcagaagttcatttctttttatggctgaacaagattccattgtgtgattagattgcattttctttatccgtctgttgatggacgtttggggttgttccactttttggccattgtgaagaatgattctttgaacattgatgtaaaagatttcatgtggatatgtattttcatttctgttggctgtataccttgcagtagaattgctgggttgtacctttaactttctgagtaactgctcaaacacagtaaacacacagttttccagttttgcagcactattttatgttcttaccagcaacctgtaagagtttccactttctccacatcctcgccaacaattgtcattgtctatctttttcattatagtcaccatagtggctgtaaagtggtatctcattgtggtattgatttgctttaccttgatgaagtaatggtattgaacatctttttcatgtgcttattagccctttaaataccttgcttggagaaatgtctattcaaataaatctttttgcccattttctaaaggagttaattgcctatttattggtgagttttaaaaaggctttagatgtgctacataccanactcttaccagaagtganttaattgcaaatattttctcccattctatngggttttcttttcactttcttggatagnggcacttggaganataaaatggn

SEQ ID NO: 8179 - DNA, 727 bp, Homo sapiens
  misc_feature 7, 43, 669: n = A,T,C or G
aagcctntcgaatcgcacgaggttgttgttaccgtgtgccaangtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgcttacttggggttgataagatttgagtgtttgcaattttttactaaatgtagctccaaagtcttaaatggcttggttgttcttaaactggtaattgatgaaactgtgcataagtttacaatgtactaacttattttgcttattatatataggggtttattgggaaattgtaccncacacttcagcatgatgaaaataaaaaataagtggttccatttaaataaatggtttat

SEQ ID NO: 8180 - DNA, 1126 bp, Homo sapiens
  misc_feature 1, 2, 4, 5, 7, 8, 9, 10, 13, 14, 17, 18, 19, 20, 26, 27,28, 31, 32, 34, 36, 39, 40, 41, 42, 44, 45, 46, 47, 48,50, 52, 54, 56, 57, 58, 59, 61, 64, 65, 69, 70, 71, 72,73, 74, 75, 77, 78, 79, 80, 83, 85, 88, 89, 90, 91, 93,95, 96: n = A,T,C or G
  misc_feature 97, 99, 102, 104, 105, 106, 107, 108, 109, 110, 111, 112,114, 115, 116, 117, 118, 119, 122, 123, 127, 128, 129, 133,134, 137, 142, 143, 144, 150, 151, 155, 156, 157, 158, 160,162, 165, 166, 167, 172, 174, 177, 179, 180, 182, 183: n = A,T,C or G
  misc_feature 184, 185, 188, 189, 196, 197, 199, 200, 202, 203, 207, 209,210, 213, 214, 215, 216, 217, 219, 222, 224, 227, 229, 236,247, 256, 264, 265, 266, 268, 269, 271, 272, 282, 306, 307,357, 377, 384, 391, 419, 422, 482, 501, 545, 549, 563: n = A,T,C or G
  misc_feature 564, 585, 587, 595, 596, 597, 608, 614, 624, 625, 628, 630,633, 639, 647, 655, 666, 670, 673, 674, 676, 680, 701, 715,718, 719, 725, 731, 733, 761, 766, 774, 775, 776, 778, 792,793, 794, 795, 800, 803, 805, 807, 810, 811, 813, 823: n = A,T,C or G
  misc_feature 830, 834, 835, 838, 843, 847, 849, 854, 866, 872, 880, 882,884, 917, 918, 921, 923, 931, 932, 937, 939, 942, 943, 948,949, 950, 952, 953, 958, 962, 964, 977, 984, 987, 1009,1013, 1014, 1024, 1025, 1031, 1037, 1038, 1043, 1048, 1050: n = A,T,C or G
  misc_feature 1059, 1060, 1071, 1072, 1080, 1082, 1084, 1090, 1096, 1097,1101, 1110, 1125: n = A,T,C or G
nntnntnnnntanntcnnnntcttannntgnntnantcnnnntnnnnnantnantnnnntnttnntttnnnnnnncnnnntananctnnnnantnnnangangnnnnnnnnnannnnnnganntatnnnatannctnataannntctacnnattnnnncncnaannncgccncnccnannannnntanncccccanncnntnntctncnnctnnnnnanagntntananatacccngggggggttcnatattcatnaaccaggnnncnngnnaaatacatanttccagactgatacttggtggggnngcccacccttctaccttggggtgcctcatggcctaccccaggcttttttntccactgggtcccactgttncctgganacaagangggctagcatgctgtcatttatctgaanggntgtggctgacccattctcctgggatttcccaggccacctcctccctttccctttccctcnacttaacccaaactttgcntcagctggatgctattgtccctggatgttggcctttacttggtncganggttaattggctgnntcttgccttgccataggaaantnttggctgnnnattttggcaanatgtgnggaagaaacnngtntnaangaaaangggaaccnaggagtanttggatcaaanaatnaanngngggngaatggggggacaagaagganaatatgggggaacnttnntccccntttggnancttcttggcccttttggggccccctttnggaanattgtggnnncncgggtaaaaataannnntttanacngntnggnnancccctttgtnaaaaaanatannganaaaantggnanaattnttttaaaaaaanccctgnttttccanananaaaaaacacattttttttcctttgggtaaaaannaancnttgtttannaaaancntanntttcnnntnnaaatncatntnttattaaaaaaanaaacggnttntattttttaaaccctcccctgntacnnctaacaaaannttttcntcttgnncccanaaaananaaaaaaaannttactccagtnntattgccncntntcaccntgatgnnggcnctttcttgngctttttaataaaana

SEQ ID NO: 8181 - DNA, 721 bp, Homo sapiens
  misc_feature 2, 12, 607, 613, 631, 633, 636, 651, 666, 676, 689, 713: n = A,T,C or G
angttcgattcngccgagggtaattaataagcagacaaatcagaaacaatatagaagatctgaaaaatagagttgaccagctctaatgggtccctgtatccaatagttagagatgggcattgtttttaggcacatgtgaaataatggcccccccgttctggcccagcagaaattatatacttggcaacaagtctcatcacattttaaataaactgtcaaaaagataacattctcatgtttccgcaatttaattttaaaatgaaattaaatttttttgaaggtaaaatacattttggaaatctaaactgtttaactcttagaacgaacagtggaaaagagaaaatataactgaatgataaggaaaatatatacacatcagattgatgtgatgcagccaagtggcatgtagaagaaactctagtattagtataggtttttcctatactttccatgtagtatgaacattttatataagtattttaaatgcttatttaaaaaaggaaattacagagttaaccaaaacaaggatttgtagagaaaaggcatatgtaaggaaagaagtagtctgggcgtggtggctcacgcctgtaatcccacaccttgggangcagangtgggccagatccctgangncangagttcgagaacagnctgaccaacatgganaaccccgctnttctaaaaatacnaaaattactgggcgtggtgatgcncccctgta

SEQ ID NO: 8182 - DNA, 1036 bp, Homo sapiens
  misc_feature 2, 6, 13, 14, 15, 16, 17, 18, 19, 21, 23, 25, 26, 29, 31,33, 36, 38, 45, 46, 48, 49, 51, 55, 56, 58, 64, 66, 74,77, 79, 81, 82, 85, 86, 87, 88, 91, 93, 97, 99, 100, 101,103, 105, 106, 111, 112, 113, 114, 117, 118, 120, 123, 125: n = A,T,C or G
  misc_feature 128, 129, 131, 132, 134, 135, 139, 143, 145, 147, 148, 149,151, 152, 155, 159, 160, 161, 163, 171, 175, 179, 184, 188,189, 190, 192, 193, 194, 197, 198, 199, 200, 201, 202, 206,211, 218, 219, 220, 221, 224, 226, 227, 233, 235, 237: n = A,T,C or G
  misc_feature 238, 239, 240, 241, 242, 243, 244, 245, 246, 247, 248, 249,250, 251, 252, 253, 256, 259, 265, 277, 283, 305, 311, 321,323, 333, 345, 353, 357, 359, 368, 372, 382, 383, 388, 389,391, 393, 394, 403, 410, 415, 416, 420, 427, 429, 431: n = A,T,C or G
  misc_feature 434, 436, 438, 445, 446, 447, 448, 451, 452, 453, 454, 462,464, 467, 470, 473, 474, 476, 477, 479, 484, 485, 486, 492,495, 498, 499, 502, 505, 506, 507, 511, 513, 517, 521, 525,528, 529, 532, 533, 539, 544, 548, 550, 551, 552, 562: n = A,T,C or G
  misc_feature 564, 565, 570, 573, 574, 577, 580, 582, 585, 589, 595, 601,607, 608, 609, 612, 617, 618, 619, 620, 622, 629, 635, 638,639, 643, 645, 648, 654, 655, 657, 659, 663, 666, 667, 669,671, 672, 673, 682, 683, 688, 690, 698, 699, 703, 708: n = A,T,C or G
  misc_feature 709, 712, 714, 715, 721, 722, 723, 724, 726, 734, 735, 738,749, 750, 752, 759, 762, 766, 774, 779, 781, 782, 784, 786,788, 789, 796, 798, 801, 802, 811, 814, 815, 816, 820, 822,835, 837, 839, 840, 842, 845, 850, 851, 858, 859, 863: n = A,T,C or G
cnaccncccttannnnnnntncngnntancntngcnanggttttnntnngnaatnnanctaccntnctttacgncgntncnntannnnttnancccnannntntnngctgnnnnaanncnggngncannanncnnactnttangngnnncnnttntctnnntngtacgctntctnatanatgtncgtnnnannnctnnnnnngccnccccncctccgnnnntancnncccccncntnnnnnnnnnnnnnnnnntangangatcgnattccgcacggnggggtntcttcttcaatcagcccccccnggggtngggctctatngnaatggaaggngttcaacgcatnttttttgnctgncnctttttccnacantacggggggnnttttnntnanncaccccctnttgtacncatanngtgngaattcngntnganancnctttcannnntannnnccttgttntnacnccnctnntnntntttcnnngctcanatntanntcngtnnnttcntnccantctnaacngtnntcnnccacantttgnattntnnnctacaacatncnnttatnttnnccnctntntcncacnttttcnattcanccacannnctntctannnncnctcaccnttcctnccnnttcntncgntactcnntncnctcntcnncnannnctcacttgnncgtgngnatactcanntaantctanntcntnnttctgnnnnantcattctnncanacgttccagannangtctatnccntacnatatattnacatnannancncnntccaccntngtnnatgactacntcnnnacgntnataactactcacntntnngnaanactannttactgnngcgnatctaactcaccttcctccaacataacnntatcnaanngtntanngtatgcactantctatctctatngcncanaanatnnctntatncgtaantncacancnanctattntacgctnctnacnnanncattcgtanatctacatatncttactatcacaatcgacntagncc

SEQ ID NO: 8183 - DNA, 1694 bp, Homo sapiens
  misc_feature 2, 3, 8, 9, 11, 12, 14, 15, 19, 20, 21, 22, 23, 24, 25, 28,29, 32, 35, 36, 38, 39, 43, 44, 48, 49, 51, 52, 54, 55,56, 57, 61, 62, 72, 73, 79, 81, 85, 87, 88, 91, 93, 96,99, 104, 106, 108, 109, 110, 113, 114, 121, 122, 124, 128: n = A,T,C or G
  misc_feature 129, 133, 135, 137, 139, 141, 142, 150, 154, 155, 158, 159,164, 172, 173, 174, 180, 181, 184, 188, 191, 192, 193, 194,196, 197, 201, 206, 208, 212, 218, 219, 220, 222, 224, 225,227, 229, 232, 241, 242, 244, 246, 247, 248, 249, 251: n = A,T,C or G
  misc_feature 253, 254, 262, 264, 266, 273, 274, 277, 278, 283, 285, 286,287, 288, 289, 291, 293, 294, 298, 300, 303, 323, 334, 335,336, 345, 355, 357, 358, 367, 372, 382, 386, 388, 394, 400,408, 410, 411, 413, 416, 418, 427, 444, 446, 449, 451: n = A,T,C or G
  misc_feature 454, 466, 482, 492, 498, 499, 502, 510, 512, 525, 529, 530,532, 534, 540, 547, 551, 552, 553, 555, 559, 562, 565, 570,572, 573, 591, 598, 602, 612, 625, 632, 636, 639, 640, 641,643, 647, 650, 651, 653, 655, 663, 667, 669, 671, 676: n = A,T,C or G
  misc_feature 678, 680, 683, 689, 690, 694, 704, 709, 714, 720, 721, 723,740, 753, 757, 759, 764, 766, 771, 774, 777, 778, 780, 789,790, 801, 804, 806, 815, 818, 821, 827, 829, 831, 833, 834,835, 845, 851, 864, 868, 872, 875, 880, 881, 886, 889: n = A,T,C or G
  misc_feature 904, 907, 911, 917, 922, 926, 930, 932, 933, 938, 944, 946,948, 957, 961, 962, 968, 970, 971, 972, 973, 976, 978, 980,994, 1027, 1032, 1038, 1050, 1053, 1054, 1061, 1063, 1078,1079, 1081, 1082, 1085, 1089, 1090, 1101, 1108, 1112: n = A,T,C or G
cnnccccnnanntnncccnnnnnnnttnnaanccnncnnaccnncccnntnngnnnncctnncccccccacnnccttcntnctantnnccncnctnctnccccntncnnnccnncctaccnngnaaanncttnanantncnntacctttnttcnncannctggngtctttcnnntccaannctntttnccnnnncnnaccnactcncntacnctctcnnntntnntncngcnccccccccnncncnnnnananntccccccncncncccttanncanntcatntnnnnntnanngccntnccnaatccgcacgggaggtttcntactgcctctnnnacccccggngtcaacattntnnatccacctnccccnctataccacntcancntttttntaggcnctagtctnannanctncnctacatctngggggggcttttttttntnatntntantctccccccacntctcaccccccccctncatcaaccantcatannccnctctaccntntcctttttctccnctcnncnangctatnactcctncacnnnanttcntcnganagacnannccctacatatcatctacntactatntctnctactactgnaactccttcctanacgatcnttcnctnnncncatnatnnancntctatctntacntncnctaantntnctntctcgnncacnctctacaaantcatntcaancactcnnancccacttactatcgcantatatacctagtntgcnancatcntncactntcnatnntntcctacatnnctctcatctcnctntnatcctcacntcncgntcctcncntntnnnactcctcatnactctnactatcgctcatnctanactnacnctcgnntttcnctntatccacgttctatntcncttnactacnatctncttntctnannaactnaatttntntnacatctctntacnnatcccntnnnnacncntntttaccttcggtcnatctcctttcctcttctctcttacgtatctctncctancacttnaccttgcattcnccnngtcatcntnctacctcactctcanntnnatntcannctaagctaccncttatancctncannnatnctccnaaactnctcacatccnnctctattntcacntccngtctacngnnancgtccntntcttcactntntttatcagacatcagactanntctcnccncccanactttntcttatctctnctcttacntccnaccnctacgtcagtatctctcccacntcnacntactatatcccnntctccntctcntnnctgntatntctcgaatacnacaccgnctccatnntatntcnttatcattancntctctctacgctactcnccacnctnaccntcctanttnnccnctctacttgttctntaccntgctnncgtccactctgncctctnatctcttcnntatttactctaactgntctatcctccncctcacgntatcncncgntcactntcttannaaatnatgcnaccaatctctctcnnnantattcngtatatccgtcactatncttacnctcncatntcatcntaccacntctctgttnngtcactcnnncnccctcaactctcctccccataatntncacctcanactncaactntncgtccttcccatacctncccncttncccca

SEQ ID NO: 8184 - DNA, 920 bp, Homo sapiens
  misc_feature 1, 5, 6, 7, 8, 9, 14, 15, 19, 23, 25, 26, 29, 43, 45, 50,51, 52, 57, 60, 65, 92, 107, 113, 114, 118, 123, 127, 151,154, 177, 190, 200, 207, 236, 237, 240, 248, 257, 258, 274,301, 305, 312, 313, 331, 332, 333, 347, 350, 353, 355: n = A,T,C or G
  misc_feature 370, 378, 379, 397, 400, 402, 405, 409, 411, 434, 435, 436,439, 448, 450, 454, 456, 461, 466, 480, 485, 497, 519, 520,522, 528, 536, 538, 542, 546, 551, 560, 562, 578, 590, 591,597, 604, 619, 625, 636, 648, 661, 665, 674, 679, 681: n = A,T,C or G
  misc_feature 685, 689, 694, 697, 701, 731, 739, 751, 773, 780, 785, 789,790, 793, 808, 813, 823, 824, 827, 832, 834, 837, 838, 839,847, 850, 859, 875, 881, 886, 889, 890, 898, 903, 916, 917,919: n = A,T,C or G
ngtannnnnaaggnnttgnatcntnntantgaattttgaatgngnaactnnngcatntgnttganaccttccaaaatggccccagtgatccnatctcctaataagtncatgtnngtgnggccntatncaacactgcttaggaatgggcttncgnaaacccaattggtcccttgaggntgtgatggcaatntgaccttttnaaggctnaaaattgtaaaggaaaagaacactggggnnttncccttccnttggttggnnttggggaaccgctttngcttcttgggaataaagcccattaagntcantgttccnnggaagggataccctctannntttggcccattttnggnaanangggtggccaccaatnggtggaannaaaaaatggaaggccctnacntngcnccantngaacctattggttaaaagttgannnccnatccaccgngnaagnantaccnccccncattagcccccttnaatcnagccccctttcngaatttacttggcccccctttnngntaagcnatttttgngnactncaantcccnattgaaatntnggccccaaagcccaanaattttccccannaaaaangcccttnccccaaattttctgnttcccnaccaaaaaaantggttccaaaanaattaaaaaaatnatgnccccttaanttttntngganttanttttngtnggcnttggcaggttactaataacctaaatctttnccctcccntttggaaaaccnttttttttttggccggggcaancgtgggntttanttgnnttngtaagccccaattanttttngggggcccannggngggtngnaannncccccggnttnggatttagnaaatatcccaccctantttgtnaaaanctnntttatttnaaaanacaaaaaaccggnngng

SEQ ID NO: 8185 - DNA, 769 bp, Homo sapiens
  misc_feature 2, 3, 6, 7, 8, 9, 10, 87, 89, 111, 117, 119, 121, 144, 211,341, 352, 473, 533, 539, 549, 575, 578, 587, 600, 602, 606,622, 632, 651, 653, 664, 677, 684, 693, 706, 709, 710, 737,742, 747, 760, 768, 769: n = A,T,C or G
cnnttnnnnncgaggcacgcccccttttctccgccacttcaccagtttctgaaatccaacctcccagacttcacaggaagatagatntncttgagataatgaaaagtgatntcttcncntncgaaaggaaaaaaggttgaggtntatatgatttttaactgtattaggggtgtatgaaccagtttaaaaacgaggttttatttactgtagnagatgaatgcaaatcagaaccaatgatcccttggcctacttagttaaaaccagttcatacatcccttagggtttttattattatcattattatcattacagctgttatcgttgtttttgctgttattatnatttggggttncttggtgttttttctttgcgactctccacacttaaacttgcaatattgtggggagaagctgtgactaaactctacgctgcggtgagatgtagcagcaatcagctcccaccgacgtgtgtanctggggctgccgctcgcaataatcctattgatttaaagcttacttaccccttgatctgtnccctcntagtccatanggtcttgccacattttatttagtganggnggagaaacntatttatttgttngntggntttgccccttcccccnccccccaaanattaaactggggaaaattngngaatttgcttnaacctctcggggngaaatcnatacccttnattttgccatggnccnncctaattgggtttcctatacaattttngggtngaatnctcttttctcccnttccctcnn

SEQ ID NO: 8186 - DNA, 1058 bp, Homo sapiens
  misc_feature 6, 9, 19, 20, 21, 22, 23, 24, 25, 26, 28, 29, 33, 35, 36,38, 54, 61, 69, 70, 71, 72, 73, 74, 82, 85, 86, 91, 92,93, 94, 95, 96, 108, 117, 126, 171, 189, 190, 193, 216,245, 247, 251, 254, 258, 259, 261, 262, 338, 358, 409, 431,444: n = A,T,C or G
  misc_feature 476, 517, 520, 528, 600, 624, 684, 765, 789, 847, 873, 874,875, 878, 881, 882, 886, 897, 901, 903, 904, 905, 908, 909,914, 919, 922, 929, 930, 935, 940, 941, 945, 946, 947, 948,957, 965, 974, 977, 980, 982, 985, 987, 989, 990, 998: n = A,T,C or G
  misc_feature 999, 1000, 1003, 1005, 1007, 1010, 1012, 1023, 1028, 1030,1032, 1045, 1047, 1057, 1058: n = A,T,C or G
ttttgnaancccctttttnnnnnnnntnncttngnntnctttttttttggcaangggaatncccccatnnnnnnattcccgngcnnaaggnnnnnnaaaaaaaacggnaaaaacccnaaaaagggngggaaaagggcccaagggggggtttgggggggcccccgtggggcntttgaaaagccccggggnnttncccccaaaaccaaaaaattggcntttgcaaacccaaaaaagccttttggggncngccngcngggnncnnccgggcttggtttggcaaagtctttttcccagcccttggggccctgggcaaaggggggggccggggggtgggggcngcttgccaaggccgggggtngctttcttcgaacgccactttggcttcccggaagggcttgcgcccccggcngcccttgggaaacccgaaggtngggaaaggaaccnggttgggtggtcaacccttgcttcggcccttnagcccttgccgctgttggggggcgccgttggcaccggaacnttncttgcctnttctgttccgaacacccggcaatgcaagccggagacaaaacgcctttaaaagcccccggcccagccctgcangtatattgcaggggcctgggggcnggccctggaactggcgggccggttccccaatgggggtgccctggaaggctgcccgggcangagtggaagcactttggggcccgtgcccaaggccggtggcttgtgaagtctagttttttggctttaccaaattgttacaanaaatggcattttaacgttttcttnttgatgcctccctttgaaggccataagaatttaagggggcttttttttaaaaaaaaantaaaaagaaaaaattggaaaccccannntcntannaaanttctcactacntctntnnnttnntaacnctctntcnttctttnncacanttctnnattnnnncctctcttncttcctanaaacctttnttncangnccntntnnaattcacnnntcncntnttnanaaacaatcccntctcntntntctttggtcaccnanactccttttnn

SEQ ID NO: 8187 - DNA, 811 bp, Homo sapiens
  misc_feature 2, 4, 18, 20, 34, 35, 36, 37, 38, 40, 43, 46, 47, 51, 53,61, 68, 73, 83, 89, 93, 94, 95, 102, 111, 122, 127, 143,155, 187, 194, 226, 251, 260, 276, 314, 343, 373, 420, 428,452, 463, 467, 476, 486, 490, 510, 512, 518, 524, 525, 530: n = A,T,C or G
  misc_feature 545, 548, 576, 579, 590, 596, 604, 617, 626, 630, 664, 670,683, 684, 691, 693, 700, 705, 718, 731, 734, 739, 749, 754,759, 765, 769, 771, 775, 782, 785, 811: n = A,T,C or G
cnancctttgaactcccngncttttgcaggatcnnnnngnagnggnncggncngagatcanatggggntgaanagattttttnccagtnatgnnngcccggnctttccagntgggcccagtnatcanccatacatagttcatngatacacctccnccagcgggtgaggaaatgatggaaaaaggagnaagaagnggccatccgttttaaccatccctcctggattngtcctcaagtccccaactgccaagnaggatgtgnccatgtataaatgtgnggggcatgactaaagtacccgtagctgtcctttatatncattcacctagaaagatctgcaaagaacncaaagaaaattgaccatttaatcagtaaangtgtcccctgggctagcatggcgctatagaaagtggacaggctttanagttaagngaatctgggctcatatggtagtgntgctattcatnagcnctatactgntgaacaaatngctnaaactatctaattttggggntntttttnccatcnnaaaanaggggataataatanctncctcataaggattaatcggggagaattnaantaaccttcacntatagncagaaaanttcacctacccantccctttcntctnacttcccttggccccttcattaaaagactaaatnccaagntaagccattccannatggggnanaacattntttantccaagtaaaaanaacaaccctttanctnatcangtcttggaanctttnaaaangccagnaccncncccnaaagggnctntcaaaaaaggcaaaatccccagcccn

SEQ ID NO: 8188 - DNA, 796 bp, Homo sapiens
  misc_feature 2, 30, 36, 37, 38, 39, 40, 41, 49, 52, 80, 81, 114, 555,600, 677, 685, 708, 715, 727, 732, 735, 739, 741, 743, 761,763, 768, 790, 796: n = A,T,C or G
tnatcctttcaactcttgttctttttgcangatccnnnnnntcgaattnggnacgaggttaattcattcctttccctganngagactgggctctgggctccctgcgtggttttnatgaggagcagaatagagctgcagtcagcagggagcagggctcattctggggagcagagacaaatagagaacagtatctcttgctatatgcagggcactgcaacttacaaatcacagcgcatggcgaggacgagggttggggtggtacctctcaccatgtctccagctgttccaacccgtggtcaatgggagctctgatgcaggctttttgctgctgggccttccactcctccaactttgcagcagtagctcgattagggtagttaatccggcctagcagtgctttggaggcatccagcacctctgggaaagagataatgtgagtgttgagcatctttccctttcaccctccaccacccaactggggatgaagaaacaaagaagccagcgcttagaggaccagggtccccacatcccctcatttttccaagtccttgttgnccacatgttctgtcctctgtctcccacctttctcttttgtccagntcattgagagtttcctgcagaatcttctgcctttggtctgatgggggtccaaaaaagggtggcttccctggattggnggggaacnaggagtcaatccaaggcctttanaactatnagtgagtcgtanttacntcnaatncnanacctgaaaaagatacatngnattangtttggacaaaccccaactagnaatgcn

SEQ ID NO: 8189 - DNA, 946 bp, Homo sapiens
  misc_feature 4, 5, 8, 18, 52, 55, 56, 71, 97, 116, 160, 165, 175, 244,246, 266, 283, 286, 321, 346, 355, 356, 357, 358, 359, 378,386, 387, 391, 437, 478, 558, 567, 587, 608, 666, 673, 687,699, 710, 732, 740, 746, 761, 772, 775, 778, 785, 792: n = A,T,C or G
  misc_feature 804, 808, 811, 834, 853, 863, 872, 875, 894, 903, 921, 923,927, 944, 946: n = A,T,C or G
ggcnnttnaaacccttcngctacttgttctttttgcaggatcccatccgatncgnnttcggcacgagaatncctttaaatccctgggcagcaccgtnggggacaggatttacccgncaacagtggtgattctactttctaaaaaccctgagcccttttgnggggngcaccagatnaaacccggggggcatcattgaacatgcaggggcagattgcagaagcttcagttctgggaaaaagagaangngggggactttgttttgctgngcccctctcttccccgnggngaatggatctactggtgtagggggagggactttgngcttctactggtttcaagtacaagncactgggcnnnnntggagaagaaacttttgancaggtgcnncgangaagggatgtgatttgggtatttggcaccatcacccctcaatcagnaaccttggattgcttaccctaccaggtggaaagaatggggncttccttaaaagcctcttggggaaaccccttaaatttccaaccttttttctttttttaaaatcaagccttccgaaaaggncattggttncctttaaaaatggaaaagcnttatttccatgggtaaatggnggccttttttttttttttttggccccgccttttttctttaagcccaaaataaggattngggcctnggaaattaagtccnccaggaattaantttttgggggnaaaaaatttccattgggttttnaaagttancccaancttaacccccttttnccttttttttnaanaanaaatttntttaaangggggaatttangggnttnaatcctttcctttcctaaaaccnggggggggcccgggtcccncctttaaaanggggttttncanttttaaaatccttccgaancctggggangaaggggggggaaaaaanancctngggataatttttcctancn

SEQ ID NO: 8190 - DNA, 827 bp, Homo sapiens
  misc_feature 30, 31, 32, 34, 35, 36, 43, 44, 45, 46, 73, 92, 107, 397,414, 527, 609, 620, 662, 690, 694, 695, 718, 725, 743, 747,757, 758, 799, 805, 811, 815, 819: n = A,T,C or G
ttatccttaaactcttgttttttgcagatnnntnnnacgattnnnncgaggctgcttcggggactcagccatnttgctactgaggtgctgancgccgtcctcaaggntctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagcccgtgcccaggtcttccagcaggtggccctgctgcctcttgagtgctggcagcatggctgaccctcggggtggttttatggtgcangtcacttgggtcttcanggtcccttccgagggcatgtgttcagcactcccgcgtttcagcctgaggggtgtacagttaagaagaagacagttacagatctcattaatctacatttttcactgtcctctancattgaaagaaggatgtctacctggtgaaagtatattttaacatgactgatggaatttcactaattgcccactcttcttggnacttgaagganaaagcgggttggccaccccattttgtcacctaacctctatanttcttttcaggcctgaaaaattctttcnttcnnggaaaaatgaaggaaccagaacntgggccnccctttggcttggttcanaaangcattttcannaattaaggaaaatgccaattttggaagttgggggaaggggnaaaggnaaatantttnttcnaaataaat

SEQ ID NO: 8191 - DNA, 961 bp, Homo sapiens
  misc_feature 8, 9, 10, 11, 12, 13, 14, 15, 16, 17, 27, 28, 36, 39, 56,179, 270, 294, 410, 442, 466, 520, 528, 567, 591, 596, 599,614, 616, 626, 663, 670, 675, 678, 679, 686, 699, 700, 704,710, 717, 752, 756, 763, 781, 784, 787, 791, 819, 837: n = A,T,C or G
  misc_feature 839, 844, 858, 864, 872, 877, 880, 884, 902, 907, 913, 915,916, 917, 922, 923, 930, 931, 933, 935, 937, 939, 940, 942,943, 944, 945, 947, 948, 949, 950, 952, 953: n = A,T,C or G
gcaggatnnnnnnnnnncgaattcggnncgaggctnacntaagtcaaatgcagtanacaatggatagtcatcacagatttttgtacatgggacttcacataccttaattgaatatccatcgtgtacaaaatattgctcaagcaatgtaggaatcaagggaataaaagcttattctgatnttatagagcatataacagccatgtaaatatgcatggtatagagaaatcagtctatgatggatgtccagcaaagttgcagagcattatatanagttgcttttgatatgagccctanaataaattgggatagagagggagttggggaatttgagataattttcaaagaaaaataaaatatggggacaaaaaacaatagataacaatcaggtggataagctatattttgaggtntttaaaaattgttttttacaaattaccccctngtttttggagtattattatccttngcccaaaattcatttccttaaataaaaatattttggcctggaataaaccctggnggtggggnaaataaccattaaaaatggggttaggggtaaggaaaaanttttggggaaaagaaaatcccctnaccantanttttttccaaggttnanccatttcctntggggggaaaaaattccatggccttttaaaaaaaatnttggaanaaagnttnnaaaaggngccctttggggannactnaatttnttaattnccccctaataaattttgggggccccccattaattngggnatttggnccccaaaattttttcccnttnggnaaanccccccctttaaaccattggcttttggnaaaataagggcccattgntnggggnaaaccctttccttnaaatanaaaaatanttttnggngggnaatcccaaattggggaanaaaancccccntnnntcccnnctccccnncncncncnncnnnntnnnncnncccccccc

SEQ ID NO: 8192 - DNA, 828 bp, Homo sapiens
  misc_feature 5, 7, 8, 9, 10, 11, 14, 17, 18, 19, 20, 24, 25, 48, 50, 79,155, 246, 256, 298, 355, 374, 424, 431, 444, 514, 524, 526,531, 537, 545, 546, 549, 552, 557, 562, 577, 582, 584, 590,597, 606, 623, 632, 633, 640, 645, 649, 653, 660, 661: n = A,T,C or G
  misc_feature 667, 668, 695, 706, 720, 721, 729, 730, 731, 745, 762, 771,772, 781, 787, 789, 791, 813, 825, 826, 828: n = A,T,C or G
atccntnnnnncanttnnnntttnngagcagggatcttataaagggcntnaaataagatgtgtggttcacatagatagngagcgtaacatctgtattaaacataggagagaagtttataaagggcattggcaataaactctttgttgcagctgtnttccaagcagtgtaaatactttttcctgtgattatgtatagccttggaatggcaccttttaactaacccatatgtgtttggtttcaatggntttttatatncagatgtatatatggtgctcacttttaggatcagcagtgttnaccatttatgctgcatagctgtattattagccttattagttgtgtggttgacccctnggggtataccaaatgtcantctgagtggtgtcttactcctttgtttataagtgaatgattgccatgttntgtatgncatagtatgccgncacataaaaagggagggagccgaaaaaccattacattaaagataatatttggacccaactactttacttnctctaaacantnctttntccccnttaacctnnccntcnaaaanttgcnatatagttaccagcnattgntntaaaantaaaatnttggtgggnaaaaacagcccttgggnctcttcccnngaatggnggggncttnttcntaatttnntcaaannttctggtcccctctcgggccaatttcnttttctgggtnttttaaaaaaaagnnggaccaannntttgcacccccctntttttaaaaaaaatatncttgggcgnnaaccccatnttaaananantaattccccccccacgtggaanaattggacgttnncn

SEQ ID NO: 8193 - DNA, 868 bp, Homo sapiens
  misc_feature 5, 9, 10, 11, 12, 13, 15, 16, 17, 18, 19, 20, 21, 22, 24,29, 34, 35, 36, 37, 38, 39, 40, 46, 48, 49, 50, 52, 272,372, 421, 497, 521, 557, 563, 566, 581, 582, 623, 662, 675,700, 730, 750, 753, 811, 818, 849, 858: n = A,T,C or G
taatncttnnnnntnnnnnnnntntgcangatcnnnnnnntcaatncnnnangaggggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctnccctcagggacacggtgctgctgcgtaaggaatctcggaagctcattgttcaacccaacactcgccttgaagctcagacgtgcagcttctggaatacgangcgtcagcttgctggcctcatccgatccttctctgagcgtttcccagangatggacccgagttggaggagatcctcacacagctggccacagcccgatgcccgattctggaagggccccagtgangcccccatctgggccaagcttgangaaaatgtgttggccttgccccccaattccatccanaccaanggntgcaaagtggccctnncattcctgtgtgtatttaaggggcctgggggaagggggaanggggcaaggaaaccttgggacctttgggtacttaccttnaacttgaagggtnggtggaacaccaaccccctttccantttgtcaagcaacttttttccaacccttgnccaaattgggttttcccccntcntgggggaatcctccaattttcatttttggcacttgcccattacccttgggaggtggangccaaanaaaaaaggggcctttaaccaattccttgttnttaccccanattggaaggg

SEQ ID NO: 8194 - DNA, 812 bp, Homo sapiens
  misc_feature 3, 13, 21, 23, 24, 34, 40, 41, 42, 43, 44, 45, 47, 52, 56,58, 133, 144, 260, 367, 461, 489, 506, 547, 555, 562, 583,597, 617, 626, 659, 675, 677, 678, 683, 718, 732, 735, 739,752, 765, 768, 771, 780, 785, 791, 802, 806, 812: n = A,T,C or G
aangaaccctttnaactcccngnnctttttgcangatccnnnnnnancggtncggncngagattttcaatttggagcattaactttttgctcatacacagttaaataaatagaattagttctatggagacttngctgttactgnttctcttgggcagtgttagtattcaccctgggcagtgagtgccatgctttttggtgagggcagatcccagcacctattgaattaccatagagtaatgatgtaacagtgcaagattntttttttaagtgacataattgccagttataagcgtatttagactgtggccatatatgctgtatttctttgcagaataaatggttcctcattaaactctaaagattanggaaaatggatatagaaaatcttagtatagtagaaagacatctgcctgtaattaaactagtttaagggtggaaaaatgcccatttttgctaatnatcaatggggatatgattggtcaagttnttttttccagagttgtngtttgccaagctaatcctgcctggttttatttatatcttgntattaaangttcctnctccaatctgaaatacttttngagtatggctatcnatacctgcccttttaagttngaaactaanctcatacattgcaaaatattgggttagtatttnaactaccatctggccncnnctcancaaatttccgattagaaccttttatcccagctagnggcccaaataattngancaanaagcctgaattgnaaaaaaaaaaaanttngangggccaccntcctngggggntaaattaaaancatntcgggn

SEQ ID NO: 8195 - DNA, 744 bp, Homo sapiens
  misc_feature 1, 575, 609, 649, 696, 743: n = A,T,C or G
nctcaatcgcacgaggccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataaagaaaataacctttatatgatatactatgactaggctgngtatttcttttcaaggggatttttctaccttcangggttgggatgtaggttaattactattaccattagcccanccggtaggttttacatatacaattttctttggggagccaataaaagntcttccattttaccaaaaaccatttttaaatgtaagttttggaatant

SEQ ID NO: 8196 - DNA, 725 bp, Homo sapiens
  misc_feature 3, 12, 38, 39, 531, 576, 590, 609, 626, 627, 628, 630, 634,635, 637, 638, 639, 641, 642, 644, 645, 646, 647, 648, 649,651, 652, 653, 654, 655, 656, 657, 658, 659, 660, 661, 662,663, 664, 665, 666, 667, 668, 669, 670, 671, 672, 673: n = A,T,C or G
  misc_feature 678, 684, 690, 691, 695, 702, 706, 718: n = A,T,C or G
agnttcgttccnacgagaggacatgaaaaggagtgaanngctaagaaaccttagctgtagtgtttggaattaacacttgggaagtcatgattgacaaatagagaaatataaatttgttttatatcagttatatatacatatttataactgatataaaacaaattagattttgacattagaaacacatatacacatactgtaatatgtactttcttcattctctttaacctatattctggttttaagtttcctggagcccgtggagtaatgggacaggaaggctcagagggtctctttactgatagttaagatacaaaaaaaactaggccaggcgcagtggctcacgcctgtgatcccagcactttgggaggccaaggcgggcggattatgaggtcgggagtttgagagcagcctggccaacatggtgaaaccccatctctactaaaaatagaaaaattagccgggcatggtggcaggcacctgtaatcccagctctaggtaggctgaggcaggagaatcacttgaacccangaggcggaggttgcagtgagcccgaaatcgcaccactgccttcanactgggtgacagancaagactctgtcttggaangcgggggaagattcccnnnanaaanntnnnanntnnnnnntnnnnnnnnnnnnnnnnnnnnnnnccccncccccntaaaanntttnggggggntttntcaaaaaacccnaaaaaaa

SEQ ID NO: 8197 - DNA, 925 bp, Homo sapiens
  misc_feature 2, 3, 4, 5, 6, 7, 8, 9, 10, 11, 12, 13, 14, 15, 16, 18, 19,20, 21, 22, 24, 25, 26, 27, 28, 29, 30, 31, 32, 33, 34,35, 36, 37, 38, 39, 40, 41, 42, 43, 44, 45, 46, 47, 48,49, 50, 51, 52, 53, 54, 55, 57, 58, 59, 60, 61, 62, 65,66: n = A,T,C or G
  misc_feature 67, 68, 69, 70, 71, 72, 76, 78, 79, 80, 81, 82, 83, 84, 85,86, 87, 89, 90, 91, 92, 94, 95, 96, 97, 98, 99, 100, 101,102, 103, 104, 105, 106, 107, 108, 109, 111, 112, 119, 126,129, 130, 132, 133, 134, 144, 145, 146, 148, 149, 150: n = A,T,C or G
  misc_feature 151, 152, 153, 154, 155, 157, 158, 159, 160, 161, 162, 163,164, 165, 166, 170, 171, 176, 177, 186, 194, 196, 203, 210,220, 225, 263, 264, 298, 299, 358, 454, 655, 714, 826, 925: n = A,T,C or G
cnnnnnnnnnnnnnnntnnnnntnnnnnnnnnnnnnnnnnnnnnnnnnnnnnnnntnnnnnnctnnnnnnnntttnannnnnnnnnncnnnntnnnnnnnnnnnnnnnntnntcgcccnccccccnctnntnnnccctcccccnnntnnnnnnnntnnnnnnnnnnttannattannacaaggtangaatccgnantttattncttacanatgaagaatncatgnggagcttgcttaataaatcccttcccaccccaagcttnntttatgactgataactagctccagctggctttannttcagtatccctagtgagctgactttccccatcttgctctcttctgcctacttttctgntccttctaaacattgtttgcactcattttgcatctggttactactaccttcttccccacgtaccattttaaagaaaactttccagccttccttgtnataaacttcagccttgccaccattacacagattaaattatagcaagaggttagttaatttcctcaggggtctgtaatccttacttaggtccggtttgccagaccaacactctttctgcaagtactaacctgcttcctacattggggtgggtatttaagaccctttaatggcatcttgcaattattaagataaatgagcaanaattattaacccaatttacattggccctgcatgttttttccccctgcataccacactanccctacccaaagccactgtccctgttgctcactggtgtaccatcatgctgacctttcaagttcttgggacatactatactatattacttcctaccaaccagactttgctcanttggttgcatgtattataataatccttggaactatgcccctccacttccccttcattgccaattaaagtcttttttccccttaaaaatcagcttacatn

SEQ ID NO: 8198 - DNA, 1296 bp, Homo sapiens
  misc_feature 2, 5, 6, 9, 10, 11, 12, 13, 14, 15, 16, 19, 20, 21, 22, 23,24, 26, 27, 28, 32, 35, 39, 41, 42, 43, 44, 47, 48, 52,53, 57, 59, 60, 62, 65, 68, 69, 70, 71, 72, 74, 75, 78,82, 84, 85, 86, 87, 92, 94, 95, 102, 104, 105, 107, 119,120: n = A,T,C or G
  misc_feature 121, 128, 131, 135, 137, 139, 141, 144, 146, 149, 159, 167,180, 182, 186, 187, 189, 191, 192, 193, 195, 198, 200, 201,203, 205, 207, 210, 211, 214, 215, 225, 233, 238, 240, 256,260, 263, 264, 269, 281, 282, 283, 290, 294, 303, 306: n = A,T,C or G
  misc_feature 309, 310, 318, 343, 346, 350, 351, 361, 366, 368, 371, 380,384, 390, 404, 406, 408, 412, 414, 416, 417, 419, 423, 424,425, 426, 429, 430, 431, 435, 437, 438, 443, 444, 450, 451,454, 460, 463, 467, 480, 481, 483, 488, 491, 498, 500: n = A,T,C or G
  misc_feature 515, 519, 533, 542, 543, 550, 552, 561, 562, 565, 570, 576,586, 588, 589, 590, 592, 595, 599, 600, 610, 616, 619, 631,632, 636, 639, 640, 649, 650, 655, 656, 661, 663, 675, 681,689, 692, 694, 698, 702, 705, 711, 713, 719, 721, 727: n = A,T,C or G
  misc_feature 728, 729, 733, 742, 745, 757, 762, 764, 768, 776, 777, 780,782, 798, 802, 809, 814, 817, 820, 831, 832, 833, 834, 836,838, 842, 843, 845, 847, 851, 853, 860, 861, 863, 867, 870,871, 875, 881, 884, 886, 888, 889, 890, 891, 893, 896: n = A,T,C or G
  misc_feature 903, 913, 920, 932, 938, 944, 946, 949, 953, 954, 961, 962,966, 968, 971, 972, 977, 978, 981, 984, 985, 988, 996, 1003,1004, 1007, 1008, 1011, 1017, 1026, 1037, 1040, 1048, 1054,1056, 1057, 1060, 1062, 1065, 1071, 1072, 1073, 1082: n = A,T,C or G
tnttnnatnnnnnnnnctnnnnnntnnnatanttntttntnnnnatnnactnnatananntnatnttnnnnnanntcnctantnnnnctccncnntctcctntnnanatttgtacatcnnntcttatnccnctcntntntntgntnttngccccccccnctaacttnccccccccacttnantatnnancnnncnccnanngngntnaannccnngggggggttnttattttntcctntngccccccccccattanaatncannttctnttattatgagcnnnaccaaantttntttggggtngancannttccattntcctgggggggttttttttatttanacntttnnccttctttcnccttntnagncctattcgntgantctatnttaatcttttcctnananttgncntnntnaatnnnnttnnntttntnnatccnnatctgnnccntccaanttnagtnttatattttaacnntnttccnatnacatcantncgctagactaaactnaatntaaaaaccttcatntgatctatnnatatttnantaatactcnnttnatttnatttanttatttctcnannnanttntaannctctatttcntatctntcnatttatatttcnntacnctnnttttcttcnnttcanntacantncatttttcatangcattntctactcnatntntaanactnttntctttnantgatcntnactttnnntccntccctaatnctncttcttcctcgntttcntncagnctgttatnntantnactactatcatactancatnctactcnatatngtntancacgatatctnnnnanancttnntnanctantnaactctnntnttantannctantatatntananannnntntcntctactnttccaccttnctatatntcttatatatanttactntatatnanatnaccnnattctannattntnctnnttacnngtncanntanctcatatntcttatnntcnntcntctatntaatcactntacttatactntantaatattnttattnannctntnacngctacnnntctacactntcttatntcntacgttacntganttanttcatanctgnatatgtntntatagnnttctganctanactnantattctanntantncttntccatncactnnttgctcntacttantattatnanatcatcntctcacaatganatcactgnnactntacttttntaatgcatatnttnttgtatttatcatcnactctcacnnntctntannca

SEQ ID NO: 8199 - DNA, 729 bp, Homo sapiens
  misc_feature 2, 11, 21, 36, 38, 39, 48, 49, 82, 85, 93, 95, 108, 110,124, 136, 146, 151, 168, 363, 378, 383, 563, 570, 608, 643,664, 679, 692, 719, 728: n = A,T,C or G
angtttcgtcntctgatgatnacactcacttaatancnnccgtttaanntgatgaatgtggctttttttcccttcactttantgntcaaaaantngtggctattgagnanatttcttctgattnattctgtgacancctgttatcngatcnttatgtaatctttcagnagattttcatcctttcatatccacattcttatgtggacttgctgaagaaacagaatatcagttcaaaacaaaacctaggccaggctggtctcaaactcccgacctcaggtgatccacccacctcggcctcccaaagtggtgggattacaggcatgagccaccgtgccgagccttccttgaagttttttgtttggntttgatttgttttgntttgntttgttttgttttgttttgttttgtttttggagatagggtctcactctgttacccatgctggagtgcagtggcacaatcttggctcagagcaacctctgcctcccaggctcaacaatcctcccacttcagtctaagtggctgggactgcaggcacgtgccaccagcccagctaattttgngttttgntaagagatgaaggtttgccatgttgcccaaggctcgtnttggaacacccggggcttaaaggaatctgcccttnttccccttccaaaagtctganaatagcaggtgtgantcatcatgcccancctcttggaagtttacttaaccaattnggaaaaacng

SEQ ID NO: 8200 - DNA, 761 bp, Homo sapiens
  misc_feature 2, 4, 43, 90, 112, 120, 121, 300, 311, 315, 326, 351, 361,365, 389, 400, 401, 409, 415, 419, 425, 445, 467, 487, 512,522, 535, 544, 545, 546, 548, 557, 565, 577, 580, 590, 594,601, 617, 630, 631, 634, 646, 663, 665, 682, 691, 692: n = A,T,C or G
  misc_feature 695, 697, 701, 702, 721, 740, 741, 753, 756, 760, 761: n = A,T,C or G
antnttttcgaattcgcacgaggttgttgttaccgtgtgccantgtgtcccatgtgggttgtgccaggtagagaaacaggatttcaatcntcatgtacacagttcaaacccnggcttgtnnagccatgtgggctgggtgatggattcccgtgagcacaggccccgtactgcttccatcagctccagcccctcagaagggacgcctacagttggcagctatggctgtcccctcagtcattgcccaagttccagcatccttcccatgaactgctcaaggaaaatggcttcacacaacacgtntaccataagtntcgnaggcgctgccntaatgagcggaaactcttgggcatnggccaatctnatgngatgaacacactcttcacgctttntggacttcttnntccgagancacttnaacnaaaaanatggtatgacggagttcaangcacgctgggctcttggaggancgcccaaagaaaggctacanatttggtttggaagtgcctttttcngatactacanttattggcctggnaaaaagaannntnccggctggncatattcnagggattttcanganggaaaccggngaangactatnaagcctgggccaactntattgggctggannaanttctggaccttnttgaaatattccaaagncnaaaatttggacatttgnccccaaacnngcnanaaannctctggaaaaatccgacgnttttgaagacttccgaggnngattcccccctnggntgann

SEQ ID NO: 8201 - DNA, 1451 bp, Homo sapiens
  misc_feature 3, 4, 6, 14, 15, 24, 25, 26, 27, 28, 30, 34, 35, 37, 42,43, 47, 49, 57, 59, 60, 62, 63, 64, 69, 71, 75, 77, 78,79, 84, 87, 91, 92, 93, 99, 103, 111, 114, 128, 133, 135,137, 138, 143, 151, 156, 168, 173, 176, 181, 183, 187, 197: n = A,T,C or G
  misc_feature 203, 204, 205, 209, 212, 215, 216, 222, 224, 228, 232, 234,242, 247, 250, 253, 258, 259, 260, 262, 264, 266, 267, 273,278, 279, 284, 287, 288, 291, 295, 299, 302, 303, 311, 312,314, 315, 326, 327, 329, 331, 332, 333, 334, 338, 340: n = A,T,C or G
  misc_feature 341, 345, 350, 356, 361, 363, 366, 367, 379, 383, 391, 393,397, 402, 409, 418, 421, 425, 428, 432, 434, 446, 447, 448,449, 466, 470, 472, 475, 478, 483, 486, 491, 494, 495, 501,503, 508, 518, 520, 525, 527, 528, 534, 538, 542, 549: n = A,T,C or G
  misc_feature 553, 555, 558, 573, 578, 585, 598, 604, 615, 623, 629, 631,643, 649, 672, 675, 677, 688, 689, 693, 696, 702, 706, 710,713, 717, 721, 723, 727, 735, 745, 749, 753, 760, 779, 781,789, 791, 797, 799, 803, 806, 814, 822, 823, 826, 827: n = A,T,C or G
  misc_feature 834, 844, 862, 863, 865, 872, 876, 879, 882, 884, 894, 898,901, 915, 921, 935, 936, 939, 947, 951, 953, 957, 973, 975,979, 981, 986, 988, 991, 993, 1008, 1015, 1016, 1026, 1036,1046, 1047, 1050, 1051, 1059, 1077, 1080, 1088, 1089: n = A,T,C or G
  misc_feature 1095, 1096, 1098, 1099, 1101, 1110, 1129, 1130, 1133, 1141,1162, 1164, 1169, 1171, 1174, 1179, 1183, 1186, 1191, 1194,1195, 1198, 1199, 1213, 1214, 1221, 1224, 1228, 1235, 1236,1243, 1245, 1250, 1251, 1252, 1276, 1278, 1285, 1290: n = A,T,C or G
ccnncnaacaaacnnattaagatnnnnntntatnntnagttnntttngnacaagaantnncnnntgttnantacncnnnctaanccnctcnnnttattntatntaaatctnggntaaaatccctttgnccccntnanntttanaaaaaaantatanattttagagagngactnganatccngngggntttttaaaancgatannnacanatnaannactacntnttgntagncnaaaatatnaagcnganaanatttnnnantntnnaagcgnccagnnatttnaannttnagcnaaantanncgtgaagnntnngatgacaatanntncnnnncacnannaatnaatcnacatantattntnagnntaaacatatacngcanacatcttnantatnacctnatatacnaacacactnttntcgntangatntntatctatacacnnnnatagaactatcgtgttnacantnatntantatanatnacatngcnncacatnancgagnactataaaantntcagnannactctnatanaagnacatatnattngncgntctatacatgtcaanaaacnacttagnatacacatgatanatacanaaaaactgatntacatccngatggntntataacagatantgaatngtagacaatatcttagaatatanatnangaataaaaaannactnatntaaatnaaanatgnatncatnaaananaaangttagatntcttagttcntacnatgngatcacnctagatcatatataagaangnaaatatcncnacaganancttnatnaaatatanctctcatnnatnntgataanacacgctatntacggataaattactaanntnatcgcanatanaantcnangtgtgcaaanaaanaanacatacctacatgncactancacgatacagactnntancgatcttnacgngngtcncatctatattttgtanantacnanacgananccntncgaatacaatacaancatatcnnatattgtatnatatatattntatagaaatnnaanngacttaangtgtcgatgtcaatcacntgnctatatgnnactganngnnancaaatacanttactacataagatatatnnatntaatatanacaatatattacatacattcnantatgnanacncgaantgtnaancactntanncanntatgacacaatcgnnaatcatnctntatnaccgaannataaatntnatatnnngaatagagacgacactataagatnanatgtagnctaanaanactaannntanncngtnacnnatatntcntcgatntaactgttagttnttannacntanttannatatnantataatntatngagacactcaaatnatatntacncnntnaacnntaatagtgnctanatatntaatnntntgattatanctannnna

SEQ ID NO: 8202 - DNA, 1509 bp, Homo sapiens
  misc_feature 2, 4, 5, 6, 7, 9, 14, 17, 18, 20, 23, 27, 31, 32, 34, 35,37, 38, 46, 50, 51, 54, 55, 58, 59, 60, 61, 62, 64, 66,71, 72, 74, 75, 79, 91, 92, 99, 100, 102, 103, 119, 123,124, 126, 128, 130, 131, 132, 139, 142, 145, 149, 150, 153: n = A,T,C or G
  misc_feature 156, 159, 164, 184, 187, 188, 197, 198, 209, 212, 219, 224,225, 227, 235, 237, 240, 247, 248, 250, 258, 260, 261, 264,271, 279, 287, 289, 292, 303, 304, 311, 317, 325, 326, 331,334, 337, 339, 340, 358, 362, 366, 368, 369, 370, 373: n = A,T,C or G
  misc_feature 381, 385, 391, 393, 397, 399, 400, 404, 406, 407, 418, 420,426, 431, 432, 436, 437, 443, 445, 450, 452, 454, 456, 470,474, 477, 480, 483, 492, 495, 499, 503, 504, 507, 509, 512,515, 518, 520, 522, 529, 531, 541, 543, 547, 549, 551: n = A,T,C or G
  misc_feature 555, 567, 568, 569, 587, 589, 591, 593, 603, 620, 623, 626,627, 629, 630, 631, 634, 645, 650, 661, 665, 666, 689, 690,691, 700, 701, 713, 723, 726, 727, 736, 738, 740, 748, 749,756, 757, 762, 763, 772, 775, 785, 792, 796, 797, 801: n = A,T,C or G
  misc_feature 803, 805, 811, 817, 818, 820, 823, 824, 825, 831, 832, 838,842, 843, 847, 852, 854, 860, 861, 865, 868, 869, 878, 889,896, 901, 906, 909, 910, 922, 924, 925, 939, 940, 941, 944,945, 949, 955, 956, 964, 965, 973, 980, 987, 990, 994: n = A,T,C or G
  misc_feature 996, 997, 999, 1005, 1006, 1013, 1015, 1018, 1021, 1022,1028, 1032, 1035, 1040, 1046, 1056, 1062, 1068, 1073, 1090,1092, 1093, 1097, 1106, 1111, 1115, 1116, 1117, 1119, 1123,1132, 1133, 1140, 1141, 1142, 1144, 1145, 1152, 1156: n = A,T,C or G
tntnnnnantaccntanntnatntccnatanntnnanncataattncaanntannttnnnnngnancatcnnanntggnggacgaacctannacgcttnncnntatatatactattatngccnncntncnnntatcccnccntcnttcnnctnttnttnaaacntaaaaacccgggggaataanatnnacacttccnnccccgtctaanttnttaccanaacannantactcttncnacnttttttnntncgaggtancnnatnttctacnaggggggntttttttnantanaaatttatctnncccttcnttaatntccattanntattncanctnannaatcttcactacattccntcantccnannntanaagtccancccnaaaccnangacntnnaccncnnttaaaacacgnanagatanttctnnaacnnatactntnctccnantntnttgttcaatctatncagnatntcntancactcaacnacnccantaannacntncgnatnatntntnataccantntacctaactntncacncnancacnttactctacatnnnacttctcatcctcgtatngnancnataattacanaatttacctctatccantgnttnncnnngtnttttaaataancttancatattatatnaaannctatctatcctaatctatgcatnnnatatctatnncttcctcacccnaactatcatnatnntctcctacnantnttctaccnntacatgnnaagannactaacgtnatnactcacatcnctacacntaanncctntnanctctancccaannanacnnnacacanncttacntatnnctancacantnatctcnntacnaannttactctantttcgagctanacgatantcaangtatnttnncatactctcccncnnctttttataattannnacnngaantcacanntctcaacnnaccctaanctatatnactatcnacncgantnntncctatnnttgtatncnaantanncatctncagnacnctgcnctaacncaatatctcntcactntgtaangaacntcactatttatcacctnannatancatttatanttagnaacnnntnatanatatacttnnctatctnnncnnaccttanctcnctatctacgntancnctcnnatcgananttatntaanntanacannctacantacgnattgcancccnacnanantatactacgatccntatgtgnattccttntntcccacnantnntnanactatcantatctattncgncgnacaccacncnaatncctcacctaacattnncacacacccctncntttcccatgnttttcaaanatacatcnnntcatatagctancgcatntacngctgcctctacnatctganggnttatatgcaaatnnatcatatacancntnatgcnatatacncncatanatacatnctccatcnnntatntactatntacncgatgcgccca

SEQ ID NO: 8203 - DNA, 1314 bp, Homo sapiens
  misc_feature 2, 3, 4, 5, 7, 9, 10, 11, 13, 14, 15, 16, 17, 18, 20, 21,22, 23, 24, 26, 27, 28, 29, 30, 31, 32, 34, 35, 36, 37,39, 40, 43, 45, 46, 48, 51, 52, 54, 55, 60, 65, 77, 78,86, 87, 90, 91, 92, 93, 98, 102, 104, 105, 115, 119, 120,122: n = A,T,C or G
  misc_feature 125, 126, 128, 131, 135, 137, 144, 153, 155, 158, 168, 169,172, 174, 175, 177, 181, 183, 184, 194, 195, 198, 200, 201,203, 205, 207, 209, 221, 223, 226, 228, 230, 234, 248, 255,270, 271, 278, 281, 285, 286, 292, 301, 302, 312, 313: n = A,T,C or G
  misc_feature 325, 332, 371, 389, 390, 401, 410, 412, 416, 426, 430, 434,446, 447, 458, 461, 464, 475, 482, 484, 487, 488, 497, 500,504, 505, 510, 511, 518, 530, 533, 540, 541, 544, 547, 550,554, 562, 564, 567, 569, 570, 572, 575, 581, 585, 596: n = A,T,C or G
  misc_feature 604, 616, 635, 638, 642, 651, 652, 664, 665, 668, 671, 672,673, 685, 698, 699, 706, 710, 712, 713, 716, 723, 724, 728,738, 742, 747, 751, 752, 756, 763, 764, 769, 775, 779, 782,785, 787, 793, 803, 805, 813, 814, 817, 821, 822, 823: n = A,T,C or G
  misc_feature 827, 836, 841, 847, 853, 859, 860, 861, 862, 866, 868, 876,878, 891, 899, 900, 908, 909, 911, 917, 918, 919, 920, 928,936, 937, 939, 943, 956, 964, 969, 970, 975, 982, 987, 990,993, 997, 999, 1006, 1007, 1010, 1014, 1016, 1018: n = A,T,C or G
  misc_feature 1022, 1028, 1033, 1044, 1046, 1054, 1061, 1068, 1083, 1098,1100, 1106, 1108, 1109, 1111, 1112, 1121, 1124, 1127, 1145,1150, 1155, 1157, 1158, 1160, 1169, 1175, 1178, 1185, 1203,1210, 1214, 1216, 1217, 1219, 1229, 1237, 1239, 1244: n = A,T,C or G
tnnnnantnnntnnnnnntnnnnntnnnnnnntnnnnanntcntnntnaanncnncaatnattcnacataatactanngatgttcnnttnnnngaatnttancnntatctctcantatnnantannanatntatntnccccccnctatcttancnccnactgcatcannttntnntnaagnanntcgaatcggnncgnanntnantnantattatggccgncnagnananactnaaccaggatgtatngcagaanctacttctactcatnnatcaacntgncaanngggggnttttttaannaccccatctnnacaggttgatcnataccanggcttgggaagagcaataccaacaagatggctttcccanagactgaacttccgtacnntttacatcatnaatgcaaananctanccaaatcctngganaatncaaaattataannaagaacccttnaanctnttttatttctnactcgtntngtnnaaaagtatnctnctcnncgacnntcttcanatttctttactntgntactttnntanacnttnaatntcactgantncgngnntnacntatttngtgnattaacttatntatgtctntataaatcacantataatgttatgtctaatnggnaaantttatacgnnttacataacttnnctntannnctgtaacagttntcagcaactatcnnttatctngctnannctntactccnntacnatactaatanaaanctctntctnntaanacattcnntactnaaaganctanatnttntncatatnaattctaacntngactacannatnaatnnngatncatatatcnaatcntatacnatctcntcttcnnnnaaanancgcaaatnanacatatgtgtatnaaaatacnntatatatnncntttacnnnnttctatcntataaatnntntacntctaatcgtgggnattatatntatcnnatctnccattangcccnttnggntacnanatattcnnctnaccntncnacgntactanactanacatatctatntnccctctcntacgcanattattnctattcctcagatanttccaacgatgaggntngatacntnntnntttacgctnaanaantacaacataaatctctcntatcnatgtntnnanacaatcaanacattntcnctacttncgacacaacaactcgctntctcatnactntnncnactcactatntaatatanancagannnnncntatcatctaagcaccccanttntnccattantacttngttattacatcctctnctctctcnnca

SEQ ID NO: 8204 - DNA, 1456 bp, Homo sapiens
  misc_feature 1, 3, 5, 9, 10, 13, 16, 17, 20, 21, 22, 34, 36, 37, 42, 43,44, 45, 46, 49, 52, 53, 55, 60, 62, 64, 65, 66, 67, 73,86, 92, 93, 94, 96, 99, 105, 108, 135, 136, 137, 156, 162,163, 166, 172, 174, 179, 180, 183, 185, 193, 194, 204, 208: n = A,T,C or G
  misc_feature 211, 220, 225, 229, 230, 231, 237, 241, 253, 254, 256, 258,265, 267, 276, 280, 290, 295, 310, 314, 316, 319, 331, 334,337, 338, 340, 347, 348, 349, 353, 354, 363, 371, 377, 381,382, 383, 384, 387, 395, 396, 397, 409, 420, 423, 424: n = A,T,C or G
  misc_feature 426, 431, 433, 446, 447, 450, 452, 461, 466, 469, 473, 474,477, 479, 493, 494, 497, 503, 512, 519, 520, 522, 534, 536,537, 538, 550, 553, 563, 565, 570, 571, 574, 575, 576, 582,587, 597, 598, 599, 601, 603, 604, 607, 608, 616, 630: n = A,T,C or G
  misc_feature 632, 633, 635, 642, 645, 650, 654, 655, 662, 663, 666, 672,685, 696, 700, 711, 712, 717, 724, 728, 731, 741, 742, 743,747, 750, 753, 763, 764, 765, 766, 767, 772, 773, 776, 779,783, 791, 796, 805, 808, 819, 830, 834, 846, 848, 852: n = A,T,C or G
  misc_feature 857, 858, 859, 865, 866, 868, 874, 880, 884, 888, 889, 899,901, 907, 909, 912, 915, 922, 924, 931, 948, 949, 950, 953,960, 961, 965, 967, 971, 977, 979, 985, 988, 991, 994, 995,998, 1009, 1024, 1028, 1029, 1030, 1031, 1032, 1033: n = A,T,C or G
  misc_feature 1039, 1041, 1055, 1060, 1064, 1072, 1076, 1081, 1084, 1088,1094, 1103, 1105, 1110, 1121, 1125, 1132, 1135, 1140, 1141,1144, 1145, 1149, 1154, 1156, 1159, 1160, 1168, 1170, 1173,1175, 1181, 1184, 1187, 1191, 1193, 1196, 1200, 1208: n = A,T,C or G
ncncncacnnttnacnncannnaacgacatctcnanntatannnnngantanntncacantncnnnnaactcnccccccccactcncccccnnntncantttaancancgcactttctgccttaaaaaagcaccnnntatactacagtgtaaacantatttnnttnacctcnantttgnngcngnccccctcnncacctcatgngggngtnttttttaanttcancatnnncccatntaantatcaatatcgnnantncacctcnanatagttgtnattntctaacttancaacnatacactacatacanactnanacntcctagtgcacntanacnnangcatacnnncatnntatcgcaancaacctantctctngtannnnacngtcatttnnnactcatatcctnatctatacaanaanncnctaantntatatctacgtannctntnacaaatcantaacnaanatcnnacntntacatatcggactnntancttacnctctcattntctttcnntnaacataccgtantnnntcgcaactatanatngacatatatncngtacnncannnttactntctcncaacgcatannnananncanncgcaaaanatacgcaacgcatntnntnacgcaangcnatccnatannattcatnnctnaactcntatcgctaaactnattcataactngatnacttaccctannatctnaccaatntatntgntcaccccaannncttnagnatnatcaattctnnnnnctctnnccnccnctanagaaatgnctttntaatctttnctnacgacttaccnaatctatgatntaanctctacatcacnanacantacannnacctanncnattcanaagtanatcntacnnacgcgttagnanacctancnacnacncatcaanantcgtcanacctatctatcgactcnnncgnacgtatnncacncncacnatcgcntnacacanacnacnacnntangttactaaccntctagatctcttcanaacnnnnnnaactcnancatcgtaatccacntattncctntaccaccnatcnatctntanttcnaatcgnatctacacntntactntacatctacgnatcncatcaantanacaanntanntccncatantnctnnccaatgancnaananacgtantangcnattncntcnttcncaacgttntatagntancnnangtccntnacatagcagnttcnntctanntnngatattacnatnntancacntattatccctntcacnttctattccnttnnaaatcnnatncctatnatnannccacttatcnnnccnatgcactanaaacacnatnnncctctacnncnatncctannannancatctatnacacnctnnacntacctntnnttaantncancnctnactnnnnccncnnacnaacacannca

SEQ ID NO: 8205 - DNA, 1107 bp, Homo sapiens
  misc_feature 3, 11, 39, 78, 80, 83, 94, 109, 132, 145, 164, 171, 181,184, 185, 187, 188, 189, 191, 192, 194, 202, 209, 212, 222,223, 225, 232, 236, 240, 255, 258, 264, 266, 276, 284, 316,317, 331, 340, 344, 347, 354, 359, 364, 373, 378, 380: n = A,T,C or G
  misc_feature 383, 384, 386, 387, 391, 398, 401, 403, 404, 408, 409, 410,422, 423, 426, 428, 435, 443, 459, 464, 468, 473, 475, 477,483, 485, 487, 491, 493, 495, 500, 501, 505, 508, 511, 512,513, 517, 521, 531, 532, 542, 543, 546, 558, 561, 563: n = A,T,C or G
  misc_feature 568, 572, 573, 584, 587, 601, 603, 604, 608, 609, 612, 614,624, 628, 632, 633, 634, 650, 651, 656, 658, 661, 669, 670,671, 673, 677, 687, 689, 693, 699, 705, 708, 713, 717, 720,723, 735, 737, 738, 741, 742, 747, 751, 755, 758, 761: n = A,T,C or G
  misc_feature 763, 764, 765, 767, 772, 773, 774, 775, 776, 781, 785, 796,799, 801, 802, 815, 818, 819, 821, 826, 827, 828, 829, 830,855, 858, 859, 861, 863, 870, 871, 873, 875, 877, 880, 883,885, 895, 897, 900, 901, 904, 905, 907, 913, 915, 924: n = A,T,C or G
  misc_feature 926, 930, 932, 939, 944, 947, 951, 954, 956, 958, 961, 966,980, 981, 990, 992, 994, 1002, 1011, 1012, 1018, 1019, 1023,1025, 1029, 1032, 1045, 1048, 1049, 1050, 1051, 1053, 1055,1057, 1058, 1064, 1072, 1080, 1083, 1085, 1090, 1093: n = A,T,C or G
  misc_feature 1095, 1101: n = A,T,C or G
acnttcgtttngaacaatatgcaatgtgaagcggtcgcncgtgagtttagtaaggctgtgtacactgactacacactncnggnatgcatgagcnacgtgtgtgatgagngggaaatttgttttatatcagtnatatatacatatntataactgatataaaacanatgatantttgacattnganncnnntnnanaccatgcngtccaanagngctccctagnntntctctgncatngtangaagaccgtaacctnttntcactncnatgcaccttnaatgcaantcagacctatttccctccttggggcccccctnnatctgcttcaccanccttatttngaanggnagaacanttcancaaanggtggaggnggganancanngnnaccntcctttnaancnngaannnattcccctcccnngantngaaaaancctattgnccctctctaattaagnagagntcancacgntnanaccttntncnctangntnaaacnnactntanttnnncgcngggnttttcatatnntacccctcannctncaccccttcttnacntnctccntacnnctatccccacnatntcccaatcctaatntnnatannaantnagccacgtcngctnatcnnncacttcacacaacatnnatctncnacncacccacnnntntttntctctctcancntacntacatntcatcnaancacantctnacnaangaaatcaattcnannatnnctcancctncttnttntcntnnnanagttnnnnntcacncgtntaatctcattngtntnngactatcagctcncannangtgtnnnnncgacatctcatcgtaacacttatcngcnncncnctctaanncnananaantancngtttatatcncnctnnatnntntctacntntaactcctncntttncntgatttnagccntantctnttnangnctnaatgnttcatatatacatnncttttcgcncntncacctacncttcaatanncgtatnntctngntcanccnacatatactaatntannnncntntnntatatnctatattntctgctanctntnattcnacntnctctgntacgcc

SEQ ID NO: 8206 - DNA, 1475 bp, Homo sapiens
  misc_feature 4, 9, 14, 15, 19, 20, 23, 26, 27, 28, 29, 32, 33, 36, 38,39, 40, 41, 42, 43, 44, 45, 46, 47, 49, 52, 55, 58, 61,66, 70, 71, 73, 74, 82, 83, 84, 86, 91, 94, 95, 97, 101,104, 105, 110, 112, 115, 118, 119, 123, 124, 125, 128, 129: n = A,T,C or G
  misc_feature 131, 135, 137, 139, 147, 150, 152, 155, 156, 157, 163, 165,166, 170, 175, 183, 184, 186, 196, 202, 210, 216, 220, 222,223, 225, 226, 227, 228, 231, 233, 235, 238, 242, 246, 255,261, 271, 275, 281, 291, 295, 297, 301, 302, 305, 307: n = A,T,C or G
  misc_feature 316, 317, 324, 326, 328, 332, 345, 347, 354, 355, 356, 361,364, 382, 383, 387, 388, 389, 390, 391, 392, 399, 401, 404,406, 412, 415, 416, 419, 421, 423, 426, 427, 434, 435, 436,438, 439, 441, 442, 443, 444, 446, 452, 453, 455, 458: n = A,T,C or G
  misc_feature 461, 463, 465, 471, 476, 477, 478, 479, 480, 484, 487, 492,497, 500, 505, 506, 508, 510, 513, 514, 522, 523, 531, 535,537, 546, 547, 550, 551, 553, 556, 560, 566, 570, 578, 582,586, 589, 592, 598, 599, 603, 607, 612, 614, 624, 627: n = A,T,C or G
  misc_feature 631, 635, 636, 643, 656, 659, 660, 668, 670, 674, 677, 683,690, 693, 695, 717, 721, 722, 727, 735, 738, 744, 746, 754,761, 767, 771, 773, 778, 784, 793, 798, 801, 803, 812, 823,829, 830, 835, 838, 844, 851, 857, 860, 876, 882, 883: n = A,T,C or G
  misc_feature 885, 890, 891, 892, 894, 898, 902, 922, 928, 933, 939, 943,946, 948, 960, 962, 965, 966, 967, 969, 970, 972, 974, 989,991, 993, 995, 996, 1009, 1011, 1016, 1021, 1025, 1027,1028, 1029, 1035, 1052, 1056, 1071, 1073, 1080, 1081, 1085: n = A,T,C or G
cccnaaccngtttnntttnntantannnnttnnccnannnnnnnnnntnganaantanacnacccntaanntnntaagcaannncnataancgnnanatcntanncttancntangcnnttannntanntnaatngnangggcaaanatnantannntttatnanncttnttaancttatttnntncccccccgantctacntacccccnacttcntaancnnannnnacnananaanaaanaccnggggggtcnatcacnttaatgagcncccngcatgnaatgtaaaantccnanaatnnttncnattttgcannaggagcnanangacnatatgcggggggntnttataannnttttnatncccccttactttaactanntccnnnnnnaacaatntnctncntccccnatnntantncncannttctacnnnanntnnnncntccttnntntcncgnancntattgnctttnnnnntaanatnaactntattnatnattanncncncgnnattaacannccgcatanacantnttaaatttnnttnntnttncttncctttntacnacataacntatntatnctnacntacaanntatnaatntaccnantaacgtctantantcantatnnttcatantcacactgactcngcnntattatanantcantantatcgntaacatntangnatacaacgatcgtatcatatcntacnntctcntatcactntgnttctangntactttanatatgcntaatantctnantactncttatntcacgtacnatatnacncntacgataantataacttacngatttnntcacntancgtatnttatacnatcatnttnctctcaccactactanccaacnnanatatnnntnaaantctntttctaacttaagctacccncgacgnatagncgatantatntananatattcaaactntnacnnntnncntnacatatctcacacantngnannctcctttttatgnanctaanatatncatntnnnatctantatcttatataatacantatnctcacactcatctantnatttcanncctntnatataccttntaanactctcnanatgntatcatcctcanccactctctnttacggtatttcctnnatncatcnntatgctacanatacaangtagtactatannacnctanctnacgatatanttatgtancncanatngctatntacncncnanncncgatagntacattatatttnncgtaactnaaacttatacnaatncgctgntntnatanactatcnatatctanagcataactnnntattatntaatacnaagctntnatctcgtnatgnatcacnaaacctntctatantcacntnatgtacnatatctatctatatctaannatacnccaaccacntntacgtattctaaccatntcttntataagtttcanataccca

SEQ ID NO: 8207 - DNA, 950 bp, Homo sapiens
  misc_feature 1, 2, 3, 4, 5, 6, 7, 8, 9, 10, 11, 14, 15, 16, 17, 18, 19,20, 21, 22, 23, 24, 25, 26, 27, 28, 30, 31, 32, 33, 34,35, 36, 37, 38, 40, 41, 45, 46, 47, 48, 49, 50, 51, 52,54, 55, 56, 57, 58, 60, 62, 64, 66, 67, 68, 69, 70, 71,73: n = A,T,C or G
  misc_feature 76, 77, 78, 79, 80, 81, 83, 85, 86, 88, 90, 91, 92, 93, 94,95, 96, 97, 99, 100, 101, 102, 103, 104, 109, 113, 117,119, 121, 122, 123, 124, 129, 133, 134, 135, 136, 137, 138,139, 141, 142, 144, 145, 146, 147, 148, 149, 153, 156: n = A,T,C or G
  misc_feature 162, 198, 206, 209, 215, 216, 217, 219, 220, 221, 227, 249,270, 277, 304, 380, 413, 430, 446, 462, 482, 486, 496, 504,515, 518, 538, 549, 564, 590, 595, 614, 637, 651, 666, 686,706, 719, 726, 734, 748, 765, 788, 802, 803, 820, 825: n = A,T,C or G
  misc_feature 834, 836, 841, 844, 849, 852, 856, 875, 898, 901, 904, 911,915, 921, 941: n = A,T,C or G
nnnnnnnnnnntcnnnnnnnnnnnnnnntnnnnnnnnngnnatcnnnnnnnntnnnnngngnantnnnnnnanttnnnnnncncnntntnnnnnnnntnnnnnncgccncccncctnanannnnccccnctcnnnnnnntnntnnnnnntttnaantacaanttcggcacggaggataaacatctttttattcaggancgctgcgnacnctaacnnncnnncagggntcatgggattgggtaccgaggngtgaggagggaatctgcaatnggcttgntacaagagaacacgcccttttctctgnagatttccgccccaagtcgtaccatactctttaacagggcacaaacgtcagcaacttcaagtttcctgtgaggatnaacatccagagtttctaatgactaatctccatngtgcaaaagaaaaggcntaacctcagccccttnagacagcttatgccangagaagttcatgaggtattntaanaaaggctgtngttactgnctctatttctnggngagcaaggaggaagactgtnactaatatttnttggaatacctaatntgtaccacacagtgttcccagagctntaganatattaactcacataattntctaaataacttgaagaaggtanataggaatttttanctccattttacaaantgaaaaaacataatgacagngattgggtgacttgcctaangggcacacaggcntcatgangtaaatancaaatttagctttnagcctcagaatcttaantcaaaagcccttatgcccaagcnccgcaaaggaagannaagaaaaatccacgganggttnagtttggtngnaaacngantgaanggntccntggggtgtaaaatggagtngtggaacccctggagttatttcnaanttnttctttntttnctgaanaccccctagggccaaaattnggaatggcg

SEQ ID NO: 8208 - DNA, 710 bp, Homo sapiens
  misc_feature 2, 7, 480, 484, 486, 490, 494, 497, 511, 522, 540, 574, 597,599, 611, 625, 636, 642, 651, 669, 676: n = A,T,C or G
antttcnttggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttggaaaatgcnaaantntttntccntcntgatggggggttantttttttgtgnaaaaaaaaaaatgggttngtttttagttttaaggggaaatgccccttccccncaaaggtttggcaattatggggngnagccttgggganaaaaaggccttttnaaggaaccttncctttnaaaagcctntttgggcttccaataaangtttgancccaaaaaaaaaaaaaaaaaaaaaaaaaacccct

SEQ ID NO: 8209 - DNA, 815 bp, Homo sapiens
  misc_feature 3, 45, 47, 51, 71, 77, 80, 86, 111, 343, 365, 428, 435, 458,468, 482, 484, 487, 518, 528, 529, 532, 537, 552, 561, 566,576, 585, 596, 597, 616, 617, 619, 620, 622, 625, 630, 631,634, 643, 653, 674, 702, 707, 710, 715, 718, 723: n = A,T,C or G
  misc_feature 737, 738, 755, 756, 757, 763, 767, 781, 782, 784, 790, 808,813, 814, 815: n = A,T,C or G
atntttttcgaattcgcacgaggttgttgttaccgtgtgccccgngngaangacggacactgtatgccacnatgccnatntttagngcattttcctgatccaaacaagctngattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcngtttggggattaaactctttgntttactgatcttttgaattttgatgatccactgaatattgaagctgcagaacatcattttgcnggacaanggaggacttccggaataaaagtnggattgactncatcaaacgttatncncanatgataaaaaggggacctattgcagggcccnatgggccttnngcnacaancttgtcttcttaccntttaaaacnaagtnatggagggtnggccccccntttttccgganntttaaagcctgcccttttnnanntnccntgggnnttngccccccanttccttgganaaccctgtttgccccttcaanaaaagaaaaccattttttcatagaactngcctnctntttgngtnttttngaggaaattttttnnattaaaataacattccnnnaaaaangctntttagggggctttnntnaaaaangccttttcggattacccntttannn

SEQ ID NO: 8210 - DNA, 898 bp, Homo sapiens
  misc_feature 3, 7, 10, 12, 15, 16, 17, 18, 20, 21, 28, 29, 30, 32, 33,34, 35, 37, 38, 39, 40, 41, 43, 44, 45, 46, 51, 52, 54,56, 58, 60, 62, 64, 67, 70, 71, 72, 73, 75, 76, 77, 78,79, 80, 82, 84, 86, 89, 90, 91, 98, 99, 100, 101, 103, 108,110: n = A,T,C or G
  misc_feature 111, 112, 114, 115, 116, 118, 119, 120, 121, 122, 123, 124,125, 130, 133, 136, 137, 138, 139, 142, 147, 148, 149, 153,155, 156, 159, 160, 162, 163, 165, 169, 171, 175, 177, 180,182, 184, 185, 187, 192, 204, 205, 207, 208, 210, 212: n = A,T,C or G
  misc_feature 226, 229, 231, 234, 235, 236, 237, 238, 239, 240, 241, 243,244, 245, 246, 247, 248, 249, 250, 254, 255, 258, 262, 270,271, 272, 276, 289, 291, 297, 304, 306, 307, 309, 310, 311,312, 313, 318, 320, 321, 328, 329, 331, 332, 335, 336: n = A,T,C or G
  misc_feature 338, 342, 344, 345, 346, 347, 348, 349, 350, 351, 352, 354,355, 356, 357, 367, 371, 372, 374, 375, 377, 379, 384, 386,389, 390, 392, 395, 401, 405, 406, 408, 410, 412, 415, 423,431, 439, 440, 444, 447, 451, 456, 458, 461, 463, 465: n = A,T,C or G
  misc_feature 468, 470, 476, 480, 483, 486, 489, 490, 497, 499, 504, 509,510, 511, 512, 519, 522, 527, 528, 532, 539, 540, 542, 543,544, 545, 547, 555, 557, 560, 562, 565, 568, 569, 577, 580,581, 584, 585, 586, 588, 590, 592, 594, 597, 598, 599: n = A,T,C or G
  misc_feature 600, 605, 610, 613, 616, 617, 625, 626, 627, 632, 633, 640,642, 643, 644, 649, 650, 651, 655, 657, 658, 661, 665, 667,672, 673, 677, 679, 682, 686, 688, 689, 690, 697, 702, 704,705, 707, 708, 711, 712, 713, 715, 716, 722, 723, 728: n = A,T,C or G
ccncctnccntngtnnnncnnggcgctnnntnnnngnnnnncnnnncccgnngngngncngngncgngtnnnntnnnnnntntngnctnnnccgcctnnnngnggggncnnngnnnannnnnnnngggtnggngannnnctntcgtnnncctncnngcnngnngnctcntnttcncnttngngnntncgcgnccccccgcgccnncnntntnccccccaccgcctntcntnttnnnnnnnntnnnnnnnntatnngcncgtntaaccgtnnnctcntggggggggggtntnttcatntttctcncnncnnnnngggcncnnccccccnnanntgnngncgantnnnnnnnnntnnnnacgcgagagncganncnntncntcgcntnctnntntgncggggnggcnntntncnttncgccatcngggggggntttttttnntggngcncagngcccncngtnancntcncnctcgtngggntgntgntcnnccggtcntntcccntctcnnnntctctanttncgttnnaccnttttcanntnnnngntcctctcncntcncnccnccnnccctttgnacnnctnnntnantnanctnnnntctcncgctngcncgnnttccagtnnngttanncctgtcncnnncgcgnnnactncnnagngtgncntgccnncttngngtnccgncnnnttgccgnatatntnncnntcnnncnnttggcnntgtcnnnantntagncctnngcgntncgtannnngcactcctccgnnnngtngncnncngtacncgncatccntnanntgcgtcnnnctcngannncanccncnntntctntngcnntnnnnnncctgntnannatntctctnnganttntnntcnatancggggtncgnttncg

SEQ ID NO: 8211 - DNA, 1351 bp, Homo sapiens
  misc_feature 4, 7, 20, 22, 23, 25, 29, 37, 41, 62, 63, 72, 82, 84, 87,93, 100, 104, 106, 107, 114, 119, 122, 123, 134, 139, 142,143, 145, 146, 148, 150, 151, 156, 161, 164, 172, 176, 180,198, 201, 207, 221, 223, 228, 236, 237, 241, 246, 247: n = A,T,C or G
  misc_feature 249, 250, 252, 257, 262, 267, 268, 269, 273, 276, 277, 279,286, 296, 299, 303, 305, 307, 308, 312, 315, 320, 322, 323,326, 327, 333, 339, 342, 346, 347, 352, 355, 361, 370, 371,372, 378, 385, 391, 403, 405, 410, 415, 418, 419, 420: n = A,T,C or G
  misc_feature 422, 425, 428, 429, 430, 431, 433, 443, 444, 451, 453, 457,467, 472, 478, 479, 480, 481, 483, 485, 496, 500, 502, 504,505, 508, 514, 524, 525, 530, 543, 545, 556, 557, 558, 560,562, 563, 565, 568, 570, 574, 581, 588, 594, 596, 600: n = A,T,C or G
  misc_feature 602, 609, 611, 617, 620, 626, 630, 632, 635, 637, 644, 659,663, 670, 675, 676, 680, 685, 688, 692, 696, 697, 702, 704,709, 714, 717, 727, 731, 742, 745, 776, 788, 789, 801, 814,816, 829, 843, 854, 864, 873, 877, 883, 887, 895, 897: n = A,T,C or G
  misc_feature 901, 908, 916, 917, 920, 930, 932, 939, 941, 953, 954, 957,961, 969, 973, 978, 979, 984, 989, 996, 997, 999, 1000,1002, 1003, 1004, 1011, 1019, 1020, 1022, 1025, 1036, 1050,1054, 1057, 1063, 1071, 1074, 1086, 1102, 1106, 1109, 1119: n = A,T,C or G
  misc_feature 1124, 1128, 1149, 1160, 1166, 1168, 1170, 1176, 1181, 1185,1189, 1190, 1192, 1200, 1202, 1204, 1207, 1220, 1221, 1236,1237, 1242, 1248, 1251, 1253, 1254, 1256, 1259, 1261, 1269,1271, 1278, 1281, 1282, 1286, 1300, 1301, 1321, 1325: n = A,T,C or G
tccntangcaacgatgttantnncnatcntgcatcanatcnttactacacatctatctttcnngcgtacctnctacagaatntntantcaccncatacanctantnntctatgnccccnccnnctttacccccnccccntannanncntnnaaacntgaanccnggggggtnttanttancccttggccccccggtanctnttatanaaaaaatacgtaanantattnaagttttnngtgnctacnntnnanccatntgtgnggggnnntttnttnnanttcacgntccacctttnctnaacncnanncttnatnacatnannagnngacacntcaccntcnacannacttnttngttatntttactaannnattganaatatcnctactnattctaactggngnctacncttgngannnantgncgnnnnancacttccaannagaacangntttnacaacagtantgtcnactacnnnnantnatcgatcactntatnantnnacnttttcnttatctctanntactngacttttcctacnanttccaattacnnntnannanctncncttntacttantccttancactananatcncncacaacnantacacnaantaactntacnancgncntattaantaagctaaggaccgnaacnatcgacntatanncacnctacnttntatntacnntcttnantaacnaaatntancataggcganaggnatctacactanacncatatccttgtccaaaagataccctaatggnttacgctacgtnncgatctccaacntaatcttatatangntatacatctcttntcacgatactactntacgtatacanattgctcgcnacttcacgntatntcactnaagntatgcccntntctncatctgnttatatanngcnattcaaattncngctctcntnaatgtaactaannttncgtntcgattgncacncttanntagcntatgncaatctnntnntnnntcatatnttgacacnnanctntgggatatctntaattttgatcacntatnttnaattangtacgcancgnaatgtcttctantgtacgtgctataatntatnggnctgtaccgtnactantgtnctcaatttatctcacatatanacactatatcnaagtangntncaaatnatatntacngtanntncctttacnananatnactatcctactannattatactatttaanngacantatcanctntnngnacncnacgacgcncnctatacntanntacnttctattacctatnntctcaccctcctactcatcnaaantanccatgtntacacangnaaangca

SEQ ID NO: 8212 - DNA, 705 bp, Homo sapiens
  misc_feature 2, 6, 433, 562, 569, 621, 649, 674, 679: n = A,T,C or G
anttcnatcgccgaggcccgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgnttatatttttaaaagcaatatttaatgtctttgcaactttatgctgggattgtttttaaaaaaactttaatgaggaaagctattggattattattatttcttggttattttgccatggctttagaatgnattctgnatgcctctcttttgctctgatctggtgctctgctattctgatgggcaactgnttaatagtgggaaacaatcctgggctgntgggctttggcaactcagaccctgnttggncctctcaggagtcatcttgaaagagt

SEQ ID NO: 8213 - DNA, 737 bp, Homo sapiens
  misc_feature 506, 613, 730, 736: n = A,T,C or G
aagttcaatcggacgagacccttcttgtcgtatctccggtgtgtatcagctctccaactctatgtcataattcagttcatggggatcttgattacctttcccttccacaaaatattacactgattggttatatcgatgacattatgctgatttgacctagtgagcaagaagtaggaactacattagacttagtggaaagacatttgcatcagagggtaggaaataaatatgactacaattcaagggccttctaccttagtgaaattggtagggacccagtgacatggggcatgttaggatatttcttctacggtgaaggataagtacttgcatcttgctgctcttaaaaccaagaaagaggcacaatacttagtgggcctctttgggttttggaggcaacattttccaatttcattatgttacaccagcctgtttaccaattgactcaaaaagctgctagttttgagtagggcccagaacaagaaaagagtctgcaacaggtccangctgctgtgcaagctgctctgccacttgggtcatatgatccagtggtgtttcaatggcagtggcaaataagggatgctgtttggaagcttctggcaggtccctatangtgaatcttggtttaagattttagagccaaaacccggccctttacccaacaaaataactagtcttttttttgagaaaacaagcttcttgggcctgctactggggccttaataaaaantggatnc

SEQ ID NO: 8214 - DNA, 738 bp, Homo sapiens
  misc_feature 6, 603, 609, 614, 629, 654, 671, 699, 728: n = A,T,C or G
agttcntttggaacaatatgcaatgtgaagcggtcgtgttgtgagtttagtaaggctgtgtacactgacacctttgcaggcatgcatgtgcttgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaacccgattcatctctcagaagggaggctggggttcattttcgagtagtattttatactttagtgaacgtggactccagactctctgtgaaccctatgagaaccgccgtctgggccccgncatgtncttancacaaggggggcccnccgttttgagtgaaggtttcttganctgctcttgaaataaanccttgcttggctgcttgggccttgggcnttaattcaaatctattgaatgcttgttgncccacgtttt

SEQ ID NO: 8215 - DNA, 685 bp, Homo sapiens
  misc_feature 442, 448, 479, 562, 589, 644, 647, 649, 662, 664: n = A,T,C or G
ttcataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaactaagtgtccaaaacctaaattgaatgtactaagttttcacatgtcccattatctagnccttgnatactaatgttttgaacttagatcatttcangtgttgtttggtggataaaggaaccttttatttataaagaatctgtagaaagcatgtgaacaagctctctgcttgattaagangccataatagtgctgtatttgcagtgngggctaagacaaagtatattaataaagctttcacccccccactcccgttccctantgnanaacccccaggtgnanaactcagtcttaaacttcagt

SEQ ID NO: 8216 - DNA, 763 bp, Homo sapiens
  misc_feature 5, 16, 17, 24, 25, 28, 31, 38, 45, 59, 61, 509, 614, 625,644, 652, 659, 678, 706, 746: n = A,T,C or G
agtcnaacgcgagttnnctagcannttnctnagcaatnggcatgncatgtagagctccnangatttgttaccatcctgcaacaggagccagaggagaatatgcctcaatcaaaatcaggctaaaaatttgtttcaattctgcgtgtgagctgggaccttaagtctttctggtcgctatttggtaggggaccaaatgtggccagtcacactggaaaagtttattttagattgtcccactttgtgacatgcactaggatcttttcatgtggagagttcattttttccctatgaagaaagagattcaattagtttattcattttgtaggtaattttgagggcattggggaaaacagaagtaggtggtccctcgaacaacttgtacaataaaatattttggcctcaatttgacacaaaatgatgttgacattgctgcacataagtcccatggaaacttattatgttataaacaacaagagacactcttagaagggaataccttggctcctttncagtagaagttccgaattctggagaaacattcgactgcatgttttctagcaatgagatattcgattcaagtccttggagtgtatgggggggtttcaagtttttgnttggagttggnggctttttttttgaaaatnccattagngggtagnaaattttcaaagaatgggnccccagtaaaaccacttgggcccagtcntttttggacttcaagtggaaaaaaaaattggggtttcccnggggggaattttccctt

SEQ ID NO: 8217 - DNA, 816 bp, Homo sapiens
  misc_feature 4, 5, 6, 433, 512, 558, 568, 583, 608, 637, 673, 764, 781,782, 791, 803, 812: n = A,T,C or G
agannnagtagaagggctcctttcctaaatccttgacgattgacaacacccatttttccttttgccgaccccaagagttttgggagttgtagttaatcatcaagagaatttggggcttccaagttgttcaggtcctctgacaccttttggtatcgttaattttactgatttgtgtagaatgtcagttgtattttaccagctaatatctagaaatgctggcaagaggggtttactccagctttagattgtaggtatgttagcttttttcatacagtgtattaaatttactgagtcagcttgctgaataagacagaagcccaagaattttaacagtgtgtagctttagttgtctaaaagttaggccttcgggcttcaaaagttagtggtcatcgaaaagcattaatctttgcagtttcaggtacaacacattggntttgattaaggatggggatggggccctctttttgcagaatggggaaaagtattgacaggaatttgagagctattggtangcccagtggtataaaggtattgtgaaaaacaagaaattaaagttanttggtcttgnaagtggactggaaanccattttaaggctcttatcaaaggncctaaaaaaatttgggtaaaataatggangttttgggtaaatgcccaaaattggtgggccaagtngggaaccaattatttttaaattttaaaaaatttattgttaaaattgggcattaaagttaccttaagcccccaagttatttttttttaaatnaaaaaaggtttattttnntttaaaccnaaaatgttcaangtttgccantttt

SEQ ID NO: 8218 - DNA, 712 bp, Homo sapiens
  misc_feature 8, 22, 39, 49, 70, 454, 525, 540, 563, 577, 603, 631, 650,690, 703, 711: n = A,T,C or G
aaatgcantgtttgaacctgangaaaagttaaagtgtanaaaatattgncttgccgaaggattttgcagncctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgtttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtaaagacgggggtttgccatgttgcccaggctggttttgaactcctggcctcangtgatctgcccaccttggcctcccaaagtgctgggattacaggtgtgagccaccgcacctggccaaaccgnttcactttgtaaaanaaattaaggctaataaaaaaggngtaagttttttganaaaatgaaaattttaactttaacccnttttcactaagtaaaatagccacaatcntcaatttcttccctttggnaaaaaggggggttacctactggggccctaccctcatattntattgaaaaaagnaattttgnt

SEQ ID NO: 8219 - DNA, 802 bp, Homo sapiens
  misc_feature 13, 21, 36, 40, 41, 48, 51, 54, 57, 70, 76, 83, 559, 609,667, 745, 780, 785, 798, 801, 802: n = A,T,C or G
actttacaatccnacgaaatnaactcactattatanacanngagcacngcnacnatnagcagcatctagntgcagnctacgtncattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgcttgggtgaggacgtcatagttaatgatgagctctaccttcaacggaacccagcgtgcttgcccacaagtctattnggcgaagtcaatggccaaaaacctcgtattcatcaattgttgaaaggggnatgccaatggggggcttgggcccgaaaccccccgggtttttcccatttcaaaccaaangggggaaatggcttgggcccttgacaccaattcagaaaagaaccccttgggaccttgggcaatttaattttgggcctnggggggggggccacttggggttggaaaaacctttnaaaancttttttttgggnacnn

SEQ ID NO: 8220 - DNA, 1508 bp, Homo sapiens
  misc_feature 2, 5, 8, 9, 10, 13, 14, 16, 17, 18, 21, 22, 27, 28, 29, 30,32, 36, 37, 38, 39, 40, 43, 45, 49, 50, 53, 54, 55, 58,59, 60, 63, 64, 66, 68, 69, 70, 71, 72, 73, 74, 75, 76,78, 79, 80, 81, 82, 87, 90, 92, 94, 95, 98, 100, 105, 108: n = A,T,C or G
  misc_feature 113, 115, 119, 120, 122, 124, 125, 128, 130, 133, 135, 136,137, 139, 141, 150, 153, 154, 157, 168, 170, 171, 172, 173,174, 175, 176, 177, 178, 179, 181, 185, 194, 196, 200, 201,205, 206, 213, 214, 215, 219, 222, 225, 266, 279, 287: n = A,T,C or G
  misc_feature 292, 301, 306, 311, 318, 335, 349, 353, 373, 376, 379, 380,385, 388, 392, 396, 397, 400, 401, 402, 403, 417, 421, 431,433, 434, 437, 441, 451, 452, 454, 458, 462, 463, 464, 469,471, 475, 480, 491, 492, 493, 500, 502, 503, 510, 512: n = A,T,C or G
  misc_feature 514, 515, 521, 525, 526, 527, 532, 534, 536, 541, 552, 553,557, 559, 560, 562, 563, 566, 567, 572, 573, 582, 584, 586,587, 588, 591, 592, 593, 608, 610, 615, 618, 619, 629, 632,637, 638, 647, 655, 675, 676, 679, 682, 688, 689, 700: n = A,T,C or G
  misc_feature 702, 707, 710, 712, 716, 718, 724, 732, 733, 734, 737, 747,751, 760, 763, 777, 779, 784, 786, 793, 794, 799, 808, 813,814, 820, 825, 827, 828, 831, 834, 835, 836, 846, 865, 873,877, 881, 885, 886, 892, 897, 908, 910, 922, 927, 930: n = A,T,C or G
  misc_feature 931, 932, 935, 937, 938, 943, 950, 952, 959, 969, 974, 981,984, 987, 991, 998, 1000, 1001, 1005, 1010, 1015, 1018,1019, 1029, 1032, 1049, 1050, 1052, 1060, 1063, 1064, 1078,1082, 1086, 1088, 1089, 1090, 1092, 1093, 1095, 1096, 1097: n = A,T,C or G
cnaancannnaanncnnnctnntcctnnnncncatnnnnntcncnatannctnnncannncanncnannnnnnnnnannnnngtgtntcncnanncananagggncancgacncnaccnnancnncantnatntnnnantnccccccccntanncancccccccctcntnnnnnnnnnnanatgncgcttatcnantccnngggnnttatatnnnaccnganaanccgaagtcgatagaaatgaaaggcctgaaatttgcacgaangcattccatgttntttatagnaggcnaaggggcgnaaatntttgnggatggnagtacaaatgtgccttngtaaaatatgttgnaaanggatcatttcagaacccctngcnacnncgtgncanactntcannccnnnnattaatggaatttnccanctggtctccncnngcncaancactggcctnngnatgntggnnncaccngncggnggccntatttggcacnnngaaggcnannaaaactntntnncacacncgcnnnactcntncntagtnggacccctttnngccncnnannagnngcacnncgtaactantngnnntcnnngactcacccacactnanccatnacnnccacaatatntangtgtnnattagatgngataagtnctctcactcgatctaatctnncantcnctatannttcgaaaaganantgctngananctcnanatgcanactaaatnnncanacggtcatanaaanctcactgtntanctcgcctcgtctananaccgnanccattcnnatcanttacacatnggaannaacccncccananngtnaannncatacggggngacggggtaacacccctcntcttcacntatnaatngggnnaaaccnaaatnttatccaaaanantttttcttaatngtctntcnnncgntnnacatngaaatgntnagcctcngataagtttnatatncactganaanaanacgngactatncnnttcnacacntctcntannatcgcgaaanggncgaaaaaatactcgtannanacgaatancanncgctatgataccgnacgncacnannnanncnnntgtaanntttntctcactctnctgnccacataaannagatntaactancatntncacttnagggaaatgttaagnnacngnngtcaancgnaaacnttgacgggnggcatgcgtatattaaagaatnnananngtannnctnntagntacancnccactctcnggcganacgaagaantnattanaaaancnacagatngnnactataatgtaaattanatcgaacncngcacgcggcctcnacgttagtntcctcctcntnntcnatggntacncacgtnatcttactgacacnntantaattccnnntntctccagccnaaataaccaacctatntttatcntccatangctcancagcnatgcttatcgtctnncatctcaaaccgancatanctgnagccntcnccg

SEQ ID NO: 8221 - DNA, 805 bp, Homo sapiens
  misc_feature 3, 8, 31, 32, 33, 34, 35, 36, 37, 47, 76, 108, 109, 110,111, 115, 122, 172, 195, 391, 562, 572, 574, 610, 655, 706,709, 715, 718, 726, 755, 765, 766, 791, 805: n = A,T,C or G
tanccttnaactcttgtctttttgcagatcnnnnnnntcaattcggnacgaggtcagctcgggcaagccctccganaagaacctctacgccgacatcgacgccgtttnnnnggcnctgcgcncccggtatggcgtgagtcccgagaacattatcctctatggtcagagcatngggactgtccccacggtagactnggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggcattcatggtacagaggatgaggtcatcgatttctcccatggcctancgatgtacgagcgctgtccccgagccgtggagccccttttgggttgaaaggggcttgggcataatgacatagagctttatgcacaatacctagaaagactaaaacaagttcatatctcacgaacttcctaattcctgaagacaacaacttggatcttacctcatttactgngaacaagaanantcctctgttttgcacatgctttaactgggtagctgnaaaaggctttgataccatgaaaaaatgcccaaccctttagggggntctaaatcaaaagaccttgatgaaatctcaagtctttttgtattctaaganggngggtcntgnttaattcncacaaacacgttaaaactggaacagtcgnggaattcccnncctttcattacccttgccaggaatngggaatgaaaaccn

SEQ ID NO: 8222 - DNA, 882 bp, Homo sapiens
  misc_feature 3, 18, 27, 31, 32, 33, 36, 37, 38, 41, 42, 45, 46, 47, 48,51, 52, 53, 106, 108, 466, 529, 581, 608, 632, 633, 640,650, 662, 663, 672, 678, 682, 695, 705, 707, 717, 743, 783,791, 794, 801, 818, 824, 830, 831, 833, 860, 870, 879: n = A,T,C or G
  misc_feature 880, 882: n = A,T,C or G
tancctttcaactcttgncttttgcangatnnnatnnnccnnttnnnnttnnngtcggatggtaaatttcagatttttgcctatagagggaaagttcctgtggttntnagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccagggaaatctgctgtgatagagaactgcgtaacaggccttttctgtgagcgctcactcatacattatgcacgacgtggctaagatctttgaagcgcatggagacaggcacatctctgagaggggagttgctgagtcagcccanaccggaaggagtggcagagatcatttgccccaagaacggcagcgagcgagtaaatgttgcctnggtttacccacccacgcccgactgtgaatcaagccccctggttccaaagaangaaattgttgggtgcaaaaagccacangaaaacccagtggaccgttttcgnnggcctgntgggaaattntcccattgggannaaaaaaganaaagcnattnttgaaccaccctnggaaccaatntntttttgccancccttgggcaaaaacccctttttggnaacttcaacccccaaacgggggtttctgggggaaaccttngagttggnacnaaacgcnttgccttggcaaggggngggccntttctnngnacaaaacttggggggaaaaaaaggctngggggaaagnggggttttnntn

SEQ ID NO: 8223 - DNA, 1222 bp, Homo sapiens
  misc_feature 5, 11, 23, 31, 32, 33, 34, 35, 39, 52, 57, 58, 61, 78, 80,81, 83, 85, 94, 97, 102, 112, 116, 119, 120, 121, 122, 123,124, 125, 126, 127, 128, 138, 139, 140, 141, 143, 144, 145,147, 151, 152, 155, 157, 159, 160, 161, 163, 166, 167: n = A,T,C or G
  misc_feature 170, 171, 173, 175, 176, 179, 192, 196, 201, 202, 205, 208,223, 238, 239, 244, 251, 253, 255, 256, 260, 262, 269, 270,273, 275, 277, 278, 282, 283, 286, 296, 299, 301, 302, 309,310, 315, 319, 332, 338, 341, 345, 353, 359, 361, 362: n = A,T,C or G
  misc_feature 367, 381, 407, 422, 423, 425, 427, 442, 448, 454, 457, 462,464, 470, 472, 475, 478, 484, 486, 504, 506, 509, 512, 513,516, 518, 526, 527, 529, 538, 542, 552, 553, 558, 560, 561,562, 564, 567, 571, 573, 575, 587, 591, 592, 595, 598: n = A,T,C or G
  misc_feature 605, 625, 632, 634, 635, 637, 640, 649, 650, 652, 655, 656,673, 679, 683, 686, 689, 693, 698, 711, 713, 714, 715, 717,734, 741, 754, 757, 760, 762, 764, 771, 783, 786, 787, 795,802, 809, 811, 816, 818, 819, 821, 826, 832, 835, 847: n = A,T,C or G
  misc_feature 854, 856, 863, 866, 873, 878, 886, 898, 903, 904, 912, 913,917, 929, 931, 932, 937, 940, 943, 944, 953, 957, 973, 974,980, 982, 984, 985, 1005, 1008, 1009, 1017, 1018, 1032,1054, 1057, 1061, 1067, 1069, 1070, 1072, 1083, 1091, 1096: n = A,T,C or G
  misc_feature 1102, 1109, 1116, 1126, 1129, 1131, 1142, 1152, 1163, 1176,1182, 1190, 1205, 1209, 1211, 1222: n = A,T,C or G
caagngggggngagggggggggnaaaaattnnnnnattntttccaaaaaccnaattnnctncccgaaagggaaatttntnntncnccccaacanaanaaaanggtttttttntttntcnnnnnnnnnncaccaacccnnnncnnncnacannccntngnnngncgnnccnngncnnggnggggggggttttnttcncaaanntcnccnacaccgggggcccancgttaatattgtcgnnaaaantcttttnananncaangngggggcnnatntnanncagnncgngaggagaaanaancnnttaactnncacanaaangaggtctctccancgtgcnccnatcncccccacngctgtnanntgggncccccccccaaaangacccccccgccataatcctggcccnagaaaatacttcccnncngnagccattccccatcnctttcncctccngantcccnangccccnanggnganttttanantcccccaggtaaggtctnanatngannccncnagaatggnngnacccccctncccnggttgggagnnacttntnnngnaangggnangnacccggggaaancccnnccnccnccagccntggccataaaaaccggcccnaatccangnntntcnacccttccnncncannaagaaaaacttctaaancccccnaaanaancancaantcctnatggccccaaaanannnangccattaaccccccccnaaatttntccgctcaccccnggngcngnanatttaancccaccaataanacnnccccacgncccttcnggggggncncaaananngnggggngaatcntgnaaaaaaaaaccntcccccncncgcgccnaancgggggnacccnaacaatantcctccgcccantacanncccctccnnatantcccccccgcgntnnaaacnccncanncgcgaccanaccnccactcctctctcgannacaccngntnnggtgcaccgcgcaaaacccnccnnacataaanncacacccccccccnactctaccccccaccactcatnatncccnctccancnncnctccccccccnttctcatngcacncccgcnatacgcnacatccncgaactatgncgngnccccccccgtncacggacccngccccatggancccccctagatcnaggacncccccccnccggaatctcccccnggtncnaacaccccccn

SEQ ID NO: 8224 - DNA, 789 bp, Homo sapiens
  misc_feature 1, 16, 19, 21, 22, 32, 36, 37, 38, 39, 40, 42, 43, 44, 45,53, 54, 55, 56, 57, 58, 87, 88, 541, 750, 751, 775, 789: n = A,T,C or G
ntaatcctttcaactnctngnnctttttgcangatnnnnntnnnnacgaattnnnnnncgagagtagaaatagtcttttatgaaatnntatacttatggaaaatatatgactggtatatgattcctttagaggaagaaaatttcaattttcagattcaaaggaagcacccttcctagtctatatatatagtaagcggagaactagttttacagtgctcatttcaggtcttcagtaagtgtgtatgatgatgtcagaagtattcattggctcactttcaaatcactgaaaattcagccatgctaaggttggctattacgtgtattagcgtttccaagcgagtggtcttggctggggtgagattgtcagctgtctgttaggattagtcacaacaaacatggtgcaaatggtttccaacaacagcgcacttcaagggtaccttcataattctttctgccagaacccaaaaaacaatactcttgagctactcagtgttccaattgttaaaaatttcctgaaattttccttcatgtattcaaaggngaaacataaagatctagaaggatggttgtgaaaaagtatggactttatagtatctagtgggcattttcattgagcccaaatgataaattctgtttccaagtcttttaagtgaaaaaaaaaaacctctagaactatagtgagtcgtattacgtagatccagaaatgataagatccattgtgagtttggacaaaccccactagaatgccannaaaaaatgcttattgggaatttgngatgctatgcttan

SEQ ID NO: 8225 - DNA, 1481 bp, Homo sapiens
  misc_feature 3, 5, 8, 9, 12, 15, 18, 21, 23, 24, 27, 28, 40, 41, 46, 51,53, 54, 55, 56, 59, 61, 63, 66, 69, 70, 79, 80, 87, 89,94, 97, 101, 103, 106, 107, 113, 115, 117, 122, 124, 128,131, 132, 139, 142, 143, 145, 153, 156, 161, 169, 171, 172: n = A,T,C or G
  misc_feature 175, 190, 194, 195, 196, 199, 203, 206, 218, 225, 233, 242,243, 244, 247, 250, 251, 252, 253, 256, 257, 258, 259, 261,266, 269, 284, 294, 302, 310, 311, 312, 314, 318, 325, 327,328, 331, 333, 335, 336, 340, 344, 345, 351, 357, 359: n = A,T,C or G
  misc_feature 362, 364, 365, 367, 384, 386, 396, 413, 414, 418, 420, 422,429, 430, 432, 435, 439, 441, 447, 451, 456, 457, 459, 460,467, 472, 474, 475, 477, 480, 486, 490, 493, 497, 498, 499,500, 505, 507, 510, 515, 518, 526, 527, 531, 532, 534: n = A,T,C or G
  misc_feature 537, 545, 546, 549, 550, 551, 552, 553, 555, 556, 558, 561,572, 574, 575, 577, 585, 586, 588, 589, 591, 592, 594, 597,604, 612, 618, 623, 626, 637, 639, 644, 647, 650, 651, 652,664, 666, 669, 670, 681, 683, 703, 705, 708, 711, 717: n = A,T,C or G
  misc_feature 721, 724, 728, 733, 735, 737, 739, 750, 762, 764, 772, 775,778, 781, 783, 792, 793, 794, 797, 804, 808, 810, 811, 814,816, 824, 831, 841, 849, 851, 852, 855, 856, 861, 863, 865,866, 868, 869, 871, 872, 886, 888, 889, 890, 898, 903: n = A,T,C or G
  misc_feature 910, 913, 918, 919, 925, 928, 929, 934, 935, 936, 938, 939,942, 946, 947, 948, 950, 954, 959, 961, 963, 966, 973, 980,984, 985, 990, 992, 994, 998, 1001, 1031, 1050, 1055, 1059,1063, 1068, 1074, 1078, 1081, 1083, 1087, 1089, 1097: n = A,T,C or G
aancnccnnacnganaanganannacnncaccgacgcgannccggngcgangnnnnacnangnganacnnacacacacnnacgcgcnangaggnacncgcncnggnnagaaanangnagagngngcanganncacgagnggnnangacagggnaancacangcgagcangnncgngcacacacgagaacncacnnnccncccngcngcacccctaagnggaaaancccctttnccaaaaaannnccnggnnnnagnnnnanacacngangaacacgaagcacgnccccccacancgacacangagcagcnnnancagncaaaacnannaancngnncagncganncacgcnaaggcncnagnanncnaaaccgacaacaacacnanacaaactaanaaaaaaaacaacaaccnncgcnangnacagaannanagnaaananaacaanaaanaagannanngaacacngaacnanngncancaagcnaaanaanagannnnccagnanccncagcncgnaacaaganngganngnagnaaagccannggnnnnnannanaangcgaaacgggnannanaagaaacnngnngnncnaangaaaaancacagcanaacccnaaaanaanaagaaacgggnanggaangcncannncaaaaccgggangncanngcggaacaaancnaccaaccactacggggacangncancgnatacangccnganacanacgcngnananaggcgaaggcncgcacgaggaancnaaaacacnagnaanatngnaaaagaaannnggnacacacngaancnnagnanaaaaaaangcggganatccaacaanagccacgnanntgnnggaangnannanncnnagcgaccgaaaacnannngcacgggncagtnatggaangcnagcannccaccntgnncccannncnntcnaccnnngnaagntgaancngntcnaacgaancacgtgnaggnnctggncnangacncanggcacatcacacacagctctccacgaatantctgagagacagaagcggnaaaanaccncgcncaacncacganaaanacncncganangacgaccnncaaaacaanaccgcggaagncnagangacgannangggngacgcanntgncnccnacgacagacgnanncgcnaggngacganggaccgaagcacgacaancncgacaangacatgggcgggagccacacnacngngngcgggggaaaaaaaaaaaaaagaccangcacacgggnggcgcacgaaacagcnaggnngggananaannncnaagaacagngacgcaagaaaaanncgnggnggaaaantacaactcacgatattgaaaccggnggagggcaaaacacacaacgcacccnaaaggaaacgnacacgangggggggaggaaccacaaaacatcacacaaaancgnngggnagcncgacaacaaaaaaaangggngn

SEQ ID NO: 8226 - DNA, 1153 bp, Homo sapiens
  misc_feature 2, 5, 7, 22, 23, 27, 30, 31, 35, 37, 40, 41, 45, 47, 48,55, 56, 60, 61, 62, 63, 69, 70, 73, 74, 75, 77, 78, 79,81, 82, 84, 85, 88, 107, 108, 116, 127, 146, 154, 157, 165,166, 167, 176, 177, 179, 190, 196, 198, 205, 206, 208, 209: n = A,T,C or G
  misc_feature 211, 217, 218, 219, 234, 236, 238, 248, 254, 255, 257, 263,268, 276, 285, 286, 288, 307, 311, 325, 326, 328, 333, 334,335, 339, 341, 343, 347, 354, 365, 368, 371, 378, 394, 395,397, 398, 400, 402, 403, 407, 414, 423, 424, 425, 430: n = A,T,C or G
  misc_feature 439, 452, 458, 460, 462, 468, 472, 473, 476, 478, 481, 490,502, 506, 508, 514, 516, 520, 530, 532, 536, 539, 544, 550,552, 561, 564, 566, 569, 570, 571, 572, 573, 598, 599, 600,601, 604, 605, 606, 607, 610, 620, 623, 624, 633, 644: n = A,T,C or G
  misc_feature 647, 648, 659, 662, 670, 672, 673, 675, 676, 677, 687, 700,708, 709, 712, 715, 720, 726, 730, 731, 752, 754, 759, 760,779, 791, 792, 811, 812, 820, 823, 826, 827, 831, 840, 843,845, 853, 855, 862, 870, 872, 878, 881, 892, 899, 906: n = A,T,C or G
  misc_feature 908, 925, 936, 937, 940, 941, 955, 956, 961, 964, 975, 984,992, 1002, 1003, 1006, 1007, 1014, 1015, 1017, 1023, 1024,1025, 1027, 1048, 1059, 1064, 1071, 1072, 1075, 1077, 1092,1096, 1102, 1112, 1125, 1127, 1128, 1133, 1137, 1139: n = A,T,C or G
  misc_feature 1140, 1152, 1153: n = A,T,C or G
gncangngaggcacgcgcacgnnggcncannaagngncgnngggnanncacgganngaannnnggggannccnnncnnncnncnngcnaaccttgcactccggctcnngaggaggncccacgccccnagcggcacgaggagaagcncaaaagcncangggccttnnnaaggccccnnanggaacccaggnaggggngnggagganncnnanagaaannnaaaaccgggaggcgncncncaaacggcancccggnngnacccgncccgncgaaaacngaaccaaanngnaggcgggggaaaccccganaagnggaaacgggggaannanaaacnnncggnancngganaggcgcnggggcacaaanaantcnaaacccntgagggaagggggccnncnngntnnaaancaaacanagggggggnnnaaaanggggggaanccggaaacccccncacgcngnanggcagngggnngangnacnggggaaaancccaccccccanaacncnaggacncncgtnggggcccacnanaacncancccgngggcgnangggaaaaanaananaannnnnagagggggggggcgcgacgcgaaannnncannnngcncgcgggccanccnnggggggaantccccgacacnccnnggggaaagaancancctcctgnanngnnnggacccatgnggcaaaccccacntgggtaanncgngcnaaccnctgatngggnngggcccaaataaaaaaccaancnagggnnggggcccaggaacccaganggtaaaacagcnncttaaaaaaaaattggaanncagggganttnggnntaanaaccaaaanagncnctaggaancncgggcgnacgggctnancccacncgnagaaaaggaanctcacgngggaacnanaagcgaatccccagaanaaaaaaacccnnccnngggcacccaaaacnnggccnggnctataaaaaangggggcccngggctaanaggaacaaanncanntcggggnnangggggnnnanaaccgaaaggaagaaagggcnggccccaaccnggganggggggnnaanancaggtagatcaaccnactngggggnaaaagggggncagggacctctangnnagggncccnanncggggggaagann

SEQ ID NO: 8227 - DNA, 779 bp, Homo sapiens
  misc_feature 2, 4, 7, 8, 9, 10, 38, 186, 463, 493, 494, 523, 571, 580,586, 588, 614, 627, 647, 664, 695, 697, 723, 728, 736, 741,743, 744, 745, 749, 751, 757, 758, 761, 763, 772, 777, 778,779: n = A,T,C or G
gnantcnnnncaggatgcacgggcactttggaggaccnagcggccactctgagtaagatcatccaggtggcggtggaactgaaggattccatgggggacctctattccttctcagctctcatgaaagccctggaaatgccacagatcacaaggttagaaaagacgtggactgctctgcggcaccantacacccaaactgccattctctatgagaaacagctgaagcccttcagcaaactcctgcatgaaggcagagagtccacatgtgttcccccaaacaatgtatcagtcccctgctgatgccgcttgtgacgttaatggagcgccaggctgtgacttttgaaggaaccgacatgtgggaaaaaaacgaccagagcttgtgaaatcatgctgaaccatttggcaacagcgccgattcatggccgaggctgcaagacagctcccggatgaatgctgagaggancctggcaaggttttcaacccagatgaaganntgaattgaaatctgcaagactgaattttnaaatgcgattgctatggggcaagcaaaaggtgcacaagtcatcagacnggagagatnttgagnanattcaacccaggattttaactgcccnctcgcgtaaattnggaaccttcttcttgtaaancaggcagaacttttgantaacttctcccgagaaccctttaaaatattntnttcaaagtttcccccaaccttcaatntttgnggaaagcntactngnnntcgntnaaaatnncantnggccaaaanttccnnn

SEQ ID NO: 8228 - DNA, 826 bp, Homo sapiens
  misc_feature 1, 12, 19, 21, 23, 32, 33, 34, 35, 36, 37, 39, 40, 42, 46,48, 49, 50, 51, 52, 59, 71, 72, 78, 82, 106, 108, 113, 122,138, 148, 151, 153, 168, 173, 180, 186, 191, 204, 295, 297,304, 309, 325, 340, 419, 422, 431, 463, 476, 481, 484: n = A,T,C or G
  misc_feature 486, 493, 494, 497, 507, 529, 535, 546, 547, 551, 562, 572,587, 596, 597, 614, 616, 621, 622, 636, 642, 652, 654, 666,688, 698, 706, 707, 709, 712, 727, 728, 731, 744, 749, 753,755, 797, 799, 804, 808, 826: n = A,T,C or G
nctaaacctttnaactccngncntttgcggannnnnngnnangaantnnnnncagattncactggaatatnnaaaaantttncttttaaactccctataggtcaangnttttngtttccatntatacggccataatcntccatagctnagntnatatgccattgttgnattanaagggancaaaancctanggaacaaagtagncttggcaagttggcagtttgtgccctctcagctgtttaacttatgtaatggatgtccgcacctgaaaacactataaaaatccagcggttgntnaaaaagnccatncgtcactaattccatncaggttctccaaccncttcttgaatatcattgccaccatttttactgttagaataaagaggcgacaccataaagccctgctgacaatgagagtnggntcaggacanctgtgattgaaatatggccgctatttacagtntttcaggggaaangtaanacncntccatgnnaantaaagagctnaagtgggtctacagttaaatgngacatngcagggacgannatantttttaaaacnacaatttcgntgctaaaaaagcctnctaggcccnngccaaattaatgcagtnanaaccnnggggttgccaaaangggaantatcaccccntnctttaaaaaaangcttaacccccccatattccantcttcatcanacccttgnntnccntctggtttaaaacgnnaanccaaaccctgggntggtnttgncnaacccaaacccccacccaaaaagaccgaccctgggtcctatngncaaanaaanccccctttttcatttggn

SEQ ID NO: 8229 - DNA, 868 bp, Homo sapiens
  misc_feature 2, 5, 13, 24, 26, 27, 28, 42, 49, 52, 53, 54, 55, 60, 62,63, 67, 68, 70, 79, 82, 85, 96, 97, 102, 105, 109, 110,112, 113, 115, 117, 124, 125, 126, 131, 133, 138, 146, 147,151, 154, 159, 162, 163, 170, 175, 182, 185, 187, 192, 193: n = A,T,C or G
  misc_feature 196, 198, 213, 228, 229, 233, 235, 244, 247, 254, 257, 258,267, 269, 271, 272, 347, 348, 349, 350, 351, 357, 359, 369,392, 414, 445, 454, 493, 510, 543, 589, 605, 612, 635, 657,671, 703, 716, 749, 798, 834, 850, 861: n = A,T,C or G
antcngactcttnggaaaacttcncnnnttttaggaaaaaanccccccnaannnngggangnngggnncnaagaataangangtnggccggttttnnaacantancccnntnngnangggcttnnnttttntnggggnatattggnnaccnaangggcnggnngggaccnaaaantgggggnaananaaacnnaancnccggttttggccttncctggttcccttaannattncnggaatgggntancaaaatnggnnggaggcttntngnngttaacaaatggtaactttcaagagacttttagagggaaaaaaataatttaaaataactggcaaactggttcaannnnncccccnantttttcacgngcataaaccccttttaaaaaggnaaatttttacactattttggtngttaaaaagggaggcatttctactttccttngaggttttnggtggtggccaaacccttaaaaaacattttccccttttngggaaccatggaggttnataaggtttattaacttttttccttttaccatnggtttaccaccttttttaataaaaaaatccaggatttttttcaagnggggccttcttccccnggaatanttaaacaaggaaattgggttggnggtaaacctcaaaaggaaattnggcttttttaatangaacttgggattttcaaaatttctttaaaggnttcagcccttttncccttatcaaaatccacaaaattcatggtattngggaaaattaattaaaatggggcaaccccaaaaaaactgggggtttttnaaaaaaaaaaatttttttggggataatcaattgganggggctggggccacanttatattattnggggggg

SEQ ID NO: 8230 - DNA, 808 bp, Homo sapiens
  misc_feature 1, 18, 19, 20, 21, 23, 24, 25, 26, 28, 29, 30, 31, 33, 34,35, 36, 37, 38, 42, 46, 63, 64, 71, 74, 78, 86, 88, 95,119, 124, 288, 352, 411, 538, 540, 547, 549, 563, 569, 583,600, 625, 632, 651, 655, 660, 665, 667, 668, 672, 678, 682: n = A,T,C or G
  misc_feature 685, 686, 690, 692, 708, 713, 715, 721, 741, 745, 749, 754,756, 761, 781, 783, 793, 803, 806, 808: n = A,T,C or G
ngtctttttgcagggatnnnntnnnnannnngnnnnnnaggnattngaacaaccacctgtggnntttatanctnaccnccgatgangncatggtntttgattccttttagaggaagaanatttnaattttcagattcaaaggaagcacccttcctagtctatatatatagtaagcggagaactagttttacagtgctcatttcaggtcttcagtaagtgtgtatgatgatgtcagaagtattcattggctcactttcaaatcactgaaaattcagccatgctaaggtnggctattacgtgtattagcgtttccaagcgagtggtcttggctggggtgagattgtcagcctgnctgttaggattagtcacaacaaacatggtgcaaatggtttcaacaacagcgcacttcanggttaccttcataattcttttctgccagaacccaaaaaacaatactcttgagctactcagtgttccaattgttaaaaatttcctgaaattttcttcatgtattcaaagtgaaacataaagatctagnangatgggngngaaaagtatggacnttatantatcttagtgggcnttctcattgagcccaantgataaatttctgttttcccaagtnttttcangttgaaaaaaaaaaaaccnctcncaacnttagngnnggtntacttncgcnagnncccngncattgataaagacacnttggntnagtttngggcaaaacccccacctggnaatngccnctgananaaaangcttttttttgggaaaatcngnggatggctcntgctttaatnttncn

SEQ ID NO: 8231 - DNA, 1013 bp, Homo sapiens
  misc_feature 1, 3, 4, 7, 8, 35, 80, 83, 85, 90, 103, 104, 113, 114, 119,127, 148, 152, 153, 166, 202, 206, 223, 233, 234, 268, 335,351, 398, 418, 422, 464, 465, 466, 467, 498, 500, 586, 613,624, 673, 677, 693, 716, 718, 721, 730, 740, 764, 766: n = A,T,C or G
  misc_feature 768, 777, 825, 830, 867, 906, 911, 912, 913, 920, 931, 949,952, 955, 964, 967, 983, 989, 992, 996, 998, 1011, 1013: n = A,T,C or G
ngnntcnnatcctttgcaagcccctgtgctctttntggcgagggatcccatcgattcgaattcgggcacgagggaacatnttncnaattnggctccttttttnnatttttccnngaatntggggggnaattttcctgggggcaaaatngggnntttttttttgganccccaaccctttgggcttatggagattggaatcctntcanggggggaaccaggggangccatttggnngataacggttcaatttggaccgcccacaagggantggaacttaccattgggaggggcttttaaacaaaggaactttcaacaatttacttggttttcttaanaggcccttaccaaaanggttaaacccccagcaacattggaaattttttggaggggttttttanttccacaaaaaggatggatngggncttggtcctggaatggaatcaccaaaaaataagaaaacaccnnnnaccgccaatttccattcaaaaaggggccaantnggatgaacctttgcaagatgccttggggccttaggaaaaaaccttccattccttaagcctttttaatctgggaccttaggtaatcntattggacccatttcaaatattttggnaaggccctttnaagtaaagggggggttggcaagaaaaccttcaatttccacaaacttggnccgnacccctttggggaaanaacctatttaaaaataatctttnantantcaaaaatntcaagggtanttggaaaaaaagctattttcttcntntnggatggttnggtcaagcaaaaaattcttacaattggcgaaccagaacaggtttcccnctggnggggatatggccaatcctttatggaacttttgcttgnggaacaatgaatcggatgttggaaaattggaatgtggcnttggnnntataatnggggttaaaangggaaagaatgggaagtnggnaantggctttantgnacaaaaaaatctaatngggcgnttnatgnangctggaataaatncn

SEQ ID NO: 8232 - DNA, 777 bp, Homo sapiens
  misc_feature 1, 7, 8, 9, 10, 38, 352, 427, 465, 508, 531, 608, 624, 638,640, 653, 663, 674, 676, 678, 680, 682, 731, 747, 762, 777: n = A,T,C or G
ngagtcnnnncgagacttggcaaatgttgctaacaacntcaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgttctgcagccgagaggcccctgacgctcttccacaccgttcagtcaacagagaaacaggaacaaaggaacagcatcatcaactncagtttggaatctgtctcatcaaatccaaacagcatccttaattccagcagcagcttacagcccaacatgaactncagtgacccagacctggctgtggtcaaacccacccggnccaactcacttccccccgaatccaagcccaactttcacccctntcgccatcttggcccatgttctnggcgccatccagccctatgcccacctcattcacgttcagcggactcatcccccgtcaggaacacccgtttcgggaanggcaaaaagccttgtntgcctgcaaagctngnacattgactccanaaactttccnttcacaggcangncncngnccttcgataatggttcacccaatcttaaggaaccttggctgggttggangggggactcttgaacnggaaagactggcctnaattccttgaaaatn

SEQ ID NO: 8233 - DNA, 928 bp, Homo sapiens
  misc_feature 2, 8, 9, 10, 12, 18, 22, 26, 41, 45, 47, 49, 67, 81, 98,107, 117, 118, 119, 120, 169, 173, 184, 191, 195, 198, 207,208, 227, 228, 230, 231, 232, 263, 269, 274, 308, 311, 312,318, 332, 338, 339, 346, 374, 382, 404, 410, 412, 414: n = A,T,C or G
  misc_feature 437, 439, 442, 445, 446, 452, 462, 463, 466, 468, 470, 473,475, 476, 481, 488, 490, 492, 495, 500, 503, 504, 511, 515,528, 532, 535, 541, 543, 563, 573, 578, 581, 582, 590, 595,598, 609, 612, 617, 621, 641, 648, 654, 661, 663, 665: n = A,T,C or G
  misc_feature 669, 673, 676, 691, 693, 697, 708, 710, 719, 725, 732, 739,740, 745, 747, 748, 752, 762, 772, 795, 800, 803, 806, 807,821, 822, 827, 834, 835, 839, 847, 861, 868, 870, 875, 878,893, 909, 915, 919, 926: n = A,T,C or G
gnagtcgnnnangcctangatnagtnacccaataattcttntacngnanaaactcctacatccagcnttttttttttaagnacccaacatccgaatancaaataaanggcgttccgnnnnttgcacaaagcaggctgggatttacaggcgtgaaccacctgcacccggnccanaactgcatctnaacagcnaagncanctttattcnnccccataactgacagactnngnnnccatccatctcctcaggttacagaggataanccgaanagaancgttacccgtagaacatatagcccacgtacttcnttnncccaanagatagggtccacnatcgcnnaagctgntctcaaactgctgggctcacgagatccncctgcccngcacttcccaaaatgctggganctacangngngagcccgcagtacccagccagtntntgnacnnccgaanatcgggagtnnctnancngcnannctttnctttccnancnggncaaanctnnaactaanaatnaatcccccttggnctanganaagccntntttactcccccccactcctntaaaaaatgnccccnccnntttcacgnaacanggncaacccaaacntgnttacncggnacaaaattgggctcccaccnttaaaantttcgnaggcatnancntgcnccantgnggaacctctccttancnaatngggaaaaacancnaggcccctngaaggnggcctcncttccannggggnannaagnttctggatcntggaaaaaanaaactcccaacaaatcgagattntaacngcnacnnaacccaaaaccaannggggnctatcannaaangaaggaantgcccccgcgatcncccccantnaaaanaanatggaacacccctgnttctctccaaacactntacaangaanagtccancg

SEQ ID NO: 8234 - DNA, 778 bp, Homo sapiens
  misc_feature 3, 6, 7, 8, 9, 65, 69, 71, 144, 189, 223, 274, 286, 315,325, 326, 403, 406, 438, 452, 465, 466, 505, 507, 511, 515,527, 553, 559, 560, 565, 580, 581, 583, 591, 598, 621, 622,623, 628, 637, 653, 655, 678, 687, 689, 695, 696, 716: n = A,T,C or G
  misc_feature 734, 743, 746, 749, 758, 765, 768, 769, 771, 776, 777, 778: n = A,T,C or G
aantcnnnncagcccacacctgcctggccaacccctggcactgatgatgcctgggtgcgggttantttngnaggagctcctgcctgcctggatgaagaggaggtcaagactttgtcccccactccgcaagataccctctctgtnccggagcggtgggtccctcccctgttaggaccttgtctccctcangactggacctggatcctgggcctgcagtcagatngccagtttcacttagaggtggaaatgtcaacccactggttggaatgggaanctgctgtgttgngagccaccttatggaaaacccatgtggcncagaaccgannggtggtggctggccaacagcaagccaggagctgaggcccacaagtccaacaactggtgaggaaccacatgctgccancangccatgttagggaacttagaagcaaatccttnccccagttgagccntcagatgacaccnnaacccctcggctgacccctttacttttacccctttgtancnagancttntgagccaacaanacctcggcttaaaaccccccctgggnttcctnnacccncagaaaccttgaaannantaaacggngttgccntcaagtcaaaacaaaaaaaaaannnactcnaccctctanaaccatagcggagtcnanttacccacaccccgactttgatnagaaccatntnatgaannttggccaaacccccactttnatggcgtgcaaaaaaaangttcttttnggnaanctcggcaancctttgnctnntnttccnnn

SEQ ID NO: 8235 - DNA, 850 bp, Homo sapiens
  misc_feature 1, 7, 21, 22, 24, 42, 43, 44, 45, 46, 47, 48, 49, 52, 59,60, 62, 89, 120, 130, 306, 430, 444, 466, 472, 490, 517,532, 558, 563, 565, 579, 593, 652, 673, 675, 691, 693, 694,744, 759, 788, 813, 815, 818, 831, 841, 844: n = A,T,C or G
ntttaancccttgcaactccnngntctttttgcaggatcccnnnnnnnntanttcggcnncnggaaagattgtggccagatgtgctttngcttgctgtctagttgttgttttcagttttntagtgtggcntgcccaaagcttcgttcagcagatttaatataactggtattttaaggatgtttatctggtggtgttacagaagagagaggaaggtaggaagaccaattaggagagcccattgccatggtctacgctggaggggaaggtatgacctgtgagtctcaaagggcactcctggctggaanggaatgaggaataatgagagtagattgaccggggcttgctttcttcctactctttcagaatttcgagatgaattgctgaaggacttctcttactgaattctcctcaggggagtcttaattccangggtgagagtaccngaagacaaaaagagaaaacccnaaaccngaaatcttgcccttagcntggaagacgagggagaagaaagagaangaaaggctgtgtcangaagtccagagcacacctgaatgcanatcantntgctatgagaccangcccaaaagttcangcccagacaaatcccacaagaaccccaaggagattcccaccttggggcaccgggtggcntgggcgcctgttaatcccaancncttttggggaaggccnannaccgggtgggattcacccctgaggtccgggaagtttcgggacccagcctngcccaacattggccnagaccccttgttcttcttccttaaaaatncccaaaaatttcccttgggcattgntnccnaggtgccttttantccccacttnttngggaag

SEQ ID NO: 8236 - DNA, 986 bp, Homo sapiens
  misc_feature 2, 9, 10, 11, 12, 13, 14, 15, 16, 17, 18, 21, 30, 31, 34,35, 36, 75, 92, 99, 101, 131, 144, 159, 173, 180, 185, 215,229, 232, 239, 243, 245, 246, 249, 253, 254, 258, 262, 263,275, 290, 295, 297, 310, 314, 318, 322, 323, 324, 336: n = A,T,C or G
  misc_feature 337, 349, 359, 364, 365, 366, 371, 372, 377, 380, 381, 382,383, 386, 388, 389, 392, 402, 409, 413, 415, 424, 425, 428,434, 440, 441, 447, 449, 456, 472, 487, 494, 500, 502, 513,516, 518, 533, 536, 555, 557, 558, 560, 564, 576, 583: n = A,T,C or G
  misc_feature 584, 594, 595, 602, 618, 620, 633, 638, 641, 653, 670, 674,676, 677, 682, 695, 702, 703, 705, 707, 711, 716, 729, 730,735, 737, 738, 740, 761, 763, 776, 781, 787, 802, 803, 806,810, 817, 827, 828, 835, 837, 842, 857, 858, 874, 892: n = A,T,C or G
  misc_feature 894, 896, 898, 921, 923, 930, 946, 950, 960, 962, 964, 976,986: n = A,T,C or G
gnatccccnnnnnnnnnncgnaattcgggnnacnnnggggggcctggcttaacaaaaaaaaaaaataaggaaaanattcccaagcctggggngggccgntnggggtccgccggcctccaatgggtgatgangtacccaagtccnggcctgggggaaggnaaggaacctcgcanccctggngtggnagggggattggggcctctggaggcccccanccgaagggggcccnatnggtcttncccncnngtnaccnntctntggnncgtacccacaanggcaaatccctaganccctntncccccttccccanatcncacntttnnntaccccataacnntcccccccttanacccccacanccctnnntcccnnccacnggnnnngcntnntcnccccctcctntccttcnttcnancatcccttnncgncccccnccttcnngcgacncnacatccntttcccccactccccnccctcccttccactnccccccncttccncncctcgtatccnacntnccccccccccttctnccnccctctgccctcgcccctntnntntccncccccccttccnccccccnnctctcctatnncttcccncccccccactctctcncncccgtcccctctntcccncanatctcccccatnctcgctttcctcccccntacntnncaatnccctttcctcttntgtcaannancncacncgctncctccaacctctnngcgcntnncnccccccacctagctctcatcntnctataccctctgnttttntacaantttccgcgggccccnnccnccgnaaaaggngcctctaaanncactaantnaaacncctcccattctcttnngcgggccacctcctcncactcatcccctcttctntntncnctatctactctcttctcttctcncncctatcnatcctcatctaccgcncctncactttcccntntntcaccactctcnacctcgcacn

SEQ ID NO: 8237 - DNA, 828 bp, Homo sapiens
  misc_feature 1, 5, 7, 10, 13, 16, 17, 18, 19, 25, 28, 37, 39, 47, 54,73, 89, 97, 100, 108, 121, 216, 219, 319, 328, 337, 358,365, 434, 443, 477, 481, 487, 497, 516, 522, 523, 524, 539,550, 578, 595, 599, 612, 617, 625, 627, 634, 636, 643, 653: n = A,T,C or G
  misc_feature 655, 665, 670, 685, 692, 697, 701, 705, 716, 717, 738, 739,755, 756, 759, 768, 773, 778, 779, 782, 784, 796, 800, 803,809, 810, 817, 818, 820, 821, 822, 825, 828: n = A,T,C or G
ncttngnccnagntcnnnncgagcnccnatgaggacnangatgagtntgaagcnaaggatgatgaacaggaanaagatgaaggcagaanggattcanatnctgagtcntcagatttgtttnctaatttgaatttaggaaggacctatgctagtggctatgctcactatgaggaacaagagaactaggggagctgctctggtggccgtgtgtgagangancaggagtgagttgtgtgtgcttgatgaattgtgtgtggttgttcaaaagtaccttaccacttagccttgtgcagaagactagttacacttaatgggccangcaataggntgtagcgtntttattagaactgataatcangcttatngcataagaaaaatgagtttcaaatttaagatgtttattgatccgaagcaatttgaagcctcatggattnggattgttncctgatttcagtaaagtattgttttgccaatttncatncatatnttccaagatnaaggggaaatagggatggnaaatannnttgttttgaaaattnaaattccctgnttttttattaaaaaaaatactggctttnatttgggcctgaatttntgtnaaaatgtaaatgnagctnaaaatggnantcacccngnttctttncccctttttncngtcccccccnaatgnggaatccctaactcntggttcntcccncctnaaantttccctttcnnattttccatgccccacccttnnagtttggccatgcatnnagncccggtctnaaacnccccnnccnantccctccccttncctncanaaatgnnccgttcnncnnncgntcn

SEQ ID NO: 8238 - DNA, 846 bp, Homo sapiens
  misc_feature 6, 36, 37, 38, 39, 40, 41, 42, 48, 49, 51, 52, 54, 631, 646,664, 709, 713, 720, 727, 733, 738, 747, 753, 761, 764, 770,779, 802, 813, 819, 824, 828, 844, 846: n = A,T,C or G
tgatcntttcaactcttgttctttttgcaggatccnnnnnnntcgacnncnncnccaggaggaactccccaggcattctgtgagatggtagtgttcacagcgctgacagatgtccctttgacacagtcctggggtcttctctgcacaacagaaaggagttttgtgacaaagttgatggaggaggttaggtatttaattaggactagccagggagggcagggactctgttaagcagtgaatttgtcaaaattttacttgtaccaggtgggaagataactagctgtggaagcctgttctgagatgccctgccatggccaatgactggttaaccacaagggtcactaaaagagagggtttctcatgatctgtagaaatgtacaactgacactattgtgtgctcctcacaataaggccggttcaggtacctagtttgtttattttattaatggggtgggtggtggtttatgaatcctttttttgtttttggaagcagttgctgcaagtcaagacttttttttttcttgaagttattcctaacatttgaccccaaacatgcatccccccatttggggcataccttttagcttacacccttgcttaccaccctggggtgtatttttaaaagaccaanaatttttattgattntattaaaaaaaaaaattntgcccaaccgaaaacccttttgtagcttgctttccttgttttganccanccttggnttttctnaaaatnccatnttttggganggggcntggtccantangggcanacatttttnttggttgcaaaaaccccttgaancccccttggtncctaanggggnccanaaaatttcccccaagntn

SEQ ID NO: 8239 - DNA, 853 bp, Homo sapiens
  misc_feature 16, 20, 21, 22, 23, 24, 31, 32, 35, 36, 37, 38, 39, 40, 41,42, 43, 44, 45, 53, 54, 55, 56, 57, 113, 117, 157, 381,475, 487, 506, 549, 587, 646, 668, 674, 686, 699, 711, 728,729, 734, 746, 752, 753, 788, 796, 800, 827, 843, 851: n = A,T,C or G
ttgaaccctttgaaancccnnnnnttttgcnngannnnnnnnnnncgaattcnnnnncaggtcatgccttatttactccatttttaatcctgcatcccagatttatggcagcntttnatatctacaggatacttttatgttgtccaaatattgctgncagtcatatgtacttataaaatgtctccactcatgtatatttatagaaatgaaatgtcaaatttctcagactgttaaagtgcagtataaagttgcttaatgcacacttaaaaatgatatataatttctgaatcctatgaaatatgtgttcttttttaattctttgggagtttccttaagttttacatgttttttggcttattgttaatgattttgtttactctntgccaaattttgtcatgtaggttattttacaatagcacctttaaaaaaaatgtatatgctaatttactaagcatattcatgtccatttttattngatcatctgatntgtgaaataacttgaaatntgtactgtttggtttgtgaaaataatattaccaaaatccctgncattagaatgtgtactttatgttcagaaagtgacctgnggggtttatttcagaagccaagccattcctctcccttggatgcactttggtaacccagnctaccacatggccttttaaggngggctnttccctggatanggggtccaaggtnttattgacctantaaaaacaattttttcnntgggngaaagcctattnaaggtnncattaagtctaccccttattttccccccttggttnggaaactnaaanggggcgccagggtattaagccctaatncccccagcatttcccngggggggngg

SEQ ID NO: 8240 - DNA, 1146 bp, Homo sapiens
  misc_feature 8, 26, 28, 44, 61, 70, 80, 98, 105, 133, 142, 151, 166, 180,191, 202, 206, 208, 211, 213, 218, 222, 226, 233, 242, 246,247, 256, 266, 269, 276, 289, 290, 293, 302, 304, 305, 309,311, 317, 318, 321, 324, 326, 331, 336, 338, 345: n = A,T,C or G
  misc_feature 346, 348, 355, 360, 371, 376, 377, 386, 393, 407, 416, 420,425, 428, 434, 435, 436, 438, 445, 449, 450, 458, 459, 461,466, 470, 475, 476, 477, 481, 484, 493, 495, 511, 522, 528,531, 538, 539, 542, 543, 546, 553, 567, 569, 572, 573: n = A,T,C or G
  misc_feature 574, 577, 581, 587, 592, 593, 595, 597, 599, 600, 601, 603,608, 609, 610, 613, 614, 616, 621, 623, 625, 630, 638, 640,643, 644, 646, 656, 660, 664, 669, 675, 679, 683, 685, 687,691, 692, 696, 697, 698, 701, 702, 712, 714, 717, 718: n = A,T,C or G
  misc_feature 719, 729, 732, 741, 743, 747, 750, 760, 762, 768, 770, 771,772, 773, 774, 775, 780, 789, 793, 794, 795, 799, 800, 805,817, 821, 823, 824, 826, 830, 832, 833, 835, 841, 842, 845,851, 858, 861, 862, 865, 869, 870, 874, 879, 884, 890: n = A,T,C or G
  misc_feature 892, 895, 897, 901, 906, 911, 912, 914, 916, 918, 927, 933,937, 938, 947, 949, 951, 956, 958, 961, 972, 976, 979, 985,986, 991, 1002, 1007, 1023, 1025, 1027, 1030, 1059, 1063,1067, 1068, 1070, 1074, 1081, 1088, 1089, 1096, 1097: n = A,T,C or G
  misc_feature 1099, 1102, 1103, 1110, 1113, 1118, 1121, 1137, 1138, 1142: n = A,T,C or G
ttggttcncccaaaaggccaacccangnccaaggggccaaggtncaagggggggttggggnccccaaaanaaaccaaagnaacccggtctcggatcanccaattntttatattaaggttgggccgattttttntacccttgnaatcccccntaaaacaaaaaggcnggggggggattttnttttttttttnaaaaggacatnaaancnagngnccctncccnctcnatttatnggaaagggngaanntcaccttanccccactggngcntgggganaaaccatattttnnganaactctccnanngatntntccatnncanatntnatatnccaangnttccaannangtccttnaaagnaaaaaatggcntcatnntcgaccagnaattcanagaagtagtctcanaaatactanttanttctnagnaataannncnctcaacnatcnntacctacnncnttctntacnatatnnntccntancactttaantnctataccaaatcctcnactctaaacangacctnacnataactnntannacnaccacancctatttatattcncnctnnnagntaanacctanaatgnntnantnnntnctctnnnttnntnaaacncnanaaganaatctacncnccnncnctttcactangtcnactntatcnccactntacnaacnananatanncatnnnctnntccactcacncncannncatctcttgnaantacaacatntncatnatnattattaacnantactancnnnnnnaacancaatataangaannnccannctatnttctatcacccnctcntnntnctcncnntncttgtnnganactaantacgatnaannctnacanntatnaactnattcntattantnacnanactntccantcctnntnantnacctttacnactctntaanntcttcgctncnanctcananccnatatcattatntacnacncaaacnntactnatctatcaaanaaccnactaccctacttactncncnatnctaaccacctcttctcatccattctaccncaanctcnnanacancttcaanttattcnntcacatnntntcnnctctacnatntattnatnttatcctattttaatnnactntccg

SEQ ID NO: 8241 - DNA, 1294 bp, Homo sapiens
  misc_feature 1, 3, 5, 6, 9, 13, 17, 21, 22, 28, 29, 30, 31, 33, 34, 35,41, 62, 64, 65, 66, 67, 68, 72, 89, 92, 95, 96, 97, 102,103, 104, 106, 109, 117, 119, 125, 137, 138, 147, 158, 162,170, 175, 177, 178, 182, 183, 186, 187, 188, 190, 205: n = A,T,C or G
  misc_feature 208, 216, 217, 227, 229, 234, 236, 248, 249, 255, 268, 269,273, 275, 276, 282, 284, 288, 304, 305, 310, 314, 316, 318,319, 331, 336, 343, 345, 350, 354, 359, 362, 363, 365, 368,369, 371, 375, 376, 377, 382, 385, 390, 393, 399, 401: n = A,T,C or G
  misc_feature 404, 406, 407, 409, 416, 417, 418, 425, 426, 437, 444, 448,449, 453, 464, 466, 477, 486, 497, 512, 513, 516, 517, 523,534, 542, 543, 544, 550, 552, 555, 563, 572, 575, 583, 587,588, 590, 594, 595, 606, 610, 621, 636, 640, 642, 652: n = A,T,C or G
  misc_feature 657, 666, 667, 669, 670, 672, 678, 679, 680, 683, 690, 693,702, 711, 713, 714, 715, 717, 719, 734, 735, 744, 749, 752,753, 757, 767, 769, 771, 772, 775, 776, 782, 787, 789, 791,793, 795, 796, 802, 806, 817, 821, 822, 826, 838, 841: n = A,T,C or G
  misc_feature 843, 848, 851, 862, 863, 867, 869, 870, 876, 878, 881, 882,884, 886, 888, 899, 901, 904, 906, 912, 916, 930, 931, 937,938, 942, 943, 945, 950, 953, 954, 955, 957, 959, 962, 964,967, 969, 971, 985, 987, 990, 994, 998, 1006, 1007: n = A,T,C or G
  misc_feature 1016, 1017, 1019, 1028, 1030, 1035, 1050, 1054, 1057, 1060,1065, 1071, 1081, 1085, 1093, 1096, 1107, 1110, 1113, 1117,1120, 1123, 1127, 1128, 1132, 1135, 1136, 1141, 1144, 1149,1154, 1157, 1165, 1168, 1175, 1179, 1186, 1195, 1196: n = A,T,C or G
ncntnngtncatnaccnagtnngccgcnnnncnnncccccncccccccaacgggggcggggncnnnnncacntttgtacttcaatacgnctntgnnngaacnnnancancgggggtntntacaancatcccatcccnnccctcaccntcaccctaccnacangcactacnacgtncnncctnnatnnnanctctcactccttttnatntacgtcanncactcctacncncattncngcacacccacanncgcgancacactgacgttnncaantnnatgctnancganaacgtatacctcttcnnacaancatntncnntaacgtcacctntacgnctcttcncnatatncctntctcntanntnttnngntgcnnnccgcnatncacancanacgtcncnggntnntnatatctnnncataacnnatgttacactnatcacancgcnntacncgtctaccctnancctacttatcnctctatttnaccctctcaanctctacactcacacnntannctcacnactgctcctcnctcattcnnncccatncnccnctctactntagccattntcntctttccncgtnngnaagnncactactcgcntcanaccacatcccntcattactcaccccncatncnacccctcctncgctnactttacannanncnatgtannnagnactcacncanctccgctancatcatccntnnncncncatatcatctaccannatcatcctnatacnacnnaccnacattactcntnannctnntcgttntacancntnancnncctatnccgntctctcactcnacgnncganacagtctccganctnanacctncanactgccgctcnncatnannattctncnacnngncncnatctcgcaccncnatngntccccnattntaacgctcacacanncccacnnactnnancattntcnnncntnacnanttntncngctatctcacctancnacnacancacntattctcnnatgtcacanncncctcaactnanctacntcacgtctccacatnctcnacnctntccantcatanctcgcttccntctnttcttcangtnagacaccctcncancgntccnttncancacnnattntcnntctcnacnattcnctcgnctntttcccgnctntacccantttncttctcntttcatctnnnnaaccnnnnncncnntntnctntctacgnctatgnttnncntcnncaatctatttaaaantcnnnctcncccngntntantttntatntatnnngcg

SEQ ID NO: 8242 - DNA, 1371 bp, Homo sapiens
  misc_feature 2, 4, 7, 8, 9, 10, 11, 14, 16, 17, 18, 21, 22, 28, 29, 30,36, 37, 38, 39, 40, 42, 44, 50, 52, 54, 55, 57, 63, 70,71, 73, 77, 79, 80, 81, 83, 85, 87, 88, 92, 93, 99, 109,111, 112, 115, 126, 129, 134, 135, 139, 146, 149, 154, 155: n = A,T,C or G
  misc_feature 156, 157, 162, 167, 173, 192, 200, 209, 210, 213, 223, 227,233, 258, 275, 279, 281, 297, 319, 321, 327, 328, 335, 337,342, 343, 352, 356, 362, 364, 378, 379, 380, 383, 389, 394,397, 398, 408, 410, 426, 428, 430, 431, 432, 441, 447: n = A,T,C or G
  misc_feature 448, 452, 459, 460, 465, 471, 472, 473, 474, 476, 477, 478,481, 490, 491, 495, 496, 497, 498, 503, 504, 508, 509, 514,516, 517, 519, 522, 525, 528, 531, 534, 538, 541, 542, 545,553, 554, 557, 558, 565, 567, 571, 574, 575, 578, 581: n = A,T,C or G
  misc_feature 584, 586, 587, 591, 595, 603, 604, 607, 616, 621, 622, 624,625, 628, 631, 632, 636, 647, 648, 649, 650, 653, 654, 658,662, 664, 668, 674, 676, 678, 679, 680, 681, 684, 689, 694,695, 699, 700, 701, 711, 712, 713, 721, 731, 735, 738: n = A,T,C or G
  misc_feature 743, 744, 751, 755, 758, 763, 766, 768, 782, 783, 786, 788,798, 799, 800, 804, 814, 818, 821, 827, 835, 837, 839, 843,844, 845, 846, 850, 855, 857, 871, 872, 877, 889, 892, 905,913, 915, 916, 928, 944, 948, 955, 961, 963, 966, 984: n = A,T,C or G
  misc_feature 988, 991, 993, 997, 998, 999, 1000, 1005, 1011, 1013, 1018,1024, 1027, 1032, 1033, 1038, 1045, 1059, 1062, 1071, 1072,1077, 1078, 1080, 1092, 1096, 1099, 1100, 1102, 1107, 1108,1117, 1120, 1123, 1134, 1136, 1144, 1145, 1147, 1152: n = A,T,C or G
cncncannnnntcntnnncanngtttannngtatannnnntntntgatcncntnncnacctanctacacnngnctcncnnntncngnnctanntatatnatgtctcttntnnacntactcaatttnccnccccnncctntcccccnctnacttnnnnttttnaaggnttcgantccgcacggaaggaaatangcctcagnggaccccgnngcntatttatctnccanattgantggcagaatatttacaattgacagngatgatggggaacaggntgantncatgactgatggactntctgagcccatgcatggcagantnccccanntcaattntngttgnntccccacgntctncatcangnggtttggatccgtnnnggnggtctntgctngcnnttggaaactntnatcttcacaagtcgtntncnnncccgtcttntaactnncacnctcttannggatnctctannnncnnntgnctgatgatnnttannnnacctnnttannctacntnntnatnttnatntancantacnatnncantcgacacnncanncatgacntncccngcnntangtnctntnncttnagantagccgcnnagntcgtacacngaccnncnntgntcnnacgntacgagtcacnnnnacnnacantgtncntttncactcnantnnnngantctcncaatnnaaannnctctccttannntgactctntctatcgtcntaanctntttgnnacccccnctanagnctacnacncnctgtatctgtctgnnccntntgctttaggnnntctntcatctctgnctantcnaccgcnctcctcantngngtgnnnntccnactgntnagtgcgcatcgctnncttcncggaacgccacntanccgctgtgatatngtctaaantnntctcactacatntaaatctcttcacgcngccnctatgtnttcatntnctnacactgcccactcactcnctcnttncncacnnnncgtgntcggancnccatntctctnttnatttnnctcantcctacnctaaatgtctaacntangttctgcgnnccacnngngaatcccgctcnccgntanntnaattnntctagaggnagnatnactctatcttngntttatggnncngtaanctatggcnaacgcgtcacttnaactcncttacgtttttcntatctnacaacnatctcttcngcgtaaanctaaacnnatactntcnacnnatgntgcctccntcttctnnanattnaattgtnactcanctctttcatcatacgcttgtcnctangtcanatnnanacatttanntaggtaanngntacncnttatngacatctccacgccacaccncc

SEQ ID NO: 8243 - DNA, 1346 bp, Homo sapiens
  misc_feature 1, 4, 5, 7, 8, 9, 10, 11, 12, 13, 15, 16, 17, 19, 21, 26,29, 30, 32, 33, 34, 38, 40, 41, 42, 43, 44, 45, 49, 50,51, 54, 55, 56, 57, 59, 61, 62, 63, 64, 68, 69, 70, 72,73, 75, 76, 77, 79, 80, 82, 83, 86, 87, 89, 90, 91, 93,95, 101: n = A,T,C or G
  misc_feature 102, 103, 107, 110, 111, 112, 114, 119, 127, 129, 131, 133,134, 140, 141, 143, 146, 147, 148, 149, 150, 151, 153, 155,156, 159, 160, 161, 162, 163, 164, 165, 168, 171, 172, 174,175, 181, 192, 193, 194, 197, 201, 202, 203, 206, 207: n = A,T,C or G
  misc_feature 209, 220, 221, 222, 225, 226, 228, 230, 232, 233, 235, 236,237, 238, 239, 240, 241, 242, 243, 244, 250, 251, 253, 255,270, 295, 301, 302, 304, 305, 308, 315, 318, 327, 331, 343,353, 355, 360, 366, 368, 386, 388, 392, 403, 407, 413: n = A,T,C or G
  misc_feature 417, 419, 422, 437, 449, 469, 470, 471, 478, 482, 486, 487,489, 490, 494, 504, 507, 511, 515, 523, 528, 529, 531, 535,537, 539, 547, 553, 564, 568, 570, 571, 572, 573, 578, 584,588, 589, 594, 604, 613, 617, 620, 625, 626, 627, 630: n = A,T,C or G
  misc_feature 632, 633, 635, 642, 643, 644, 646, 647, 649, 654, 655, 665,671, 674, 675, 681, 685, 688, 693, 696, 704, 705, 707, 709,722, 727, 730, 737, 747, 750, 752, 754, 759, 767, 768, 770,775, 777, 780, 785, 786, 792, 806, 815, 817, 827, 834: n = A,T,C or G
  misc_feature 836, 848, 849, 851, 853, 865, 867, 870, 887, 891, 904, 914,925, 932, 937, 939, 942, 947, 948, 950, 957, 966, 972, 974,979, 982, 988, 991, 1004, 1005, 1007, 1008, 1009, 1014,1017, 1020, 1024, 1025, 1026, 1027, 1029, 1030, 1032, 1037: n = A,T,C or G
ngtnnannnnnnntnnncntngttanganntnnnaatntnnnnnntatnnnttnnnntnannnntaannntnntnnngnnannctnntnnntnanatgtannntatnttnnntntaggngtctactntncnanncgtaanntnaannnnnntntnntannnnnnnatntanntnncgcgcnccccccacccnnntantatnnntcnncncaccctctccnnnccnntntncnnannnnnnnnnntcatanntntntttcgaaaatattcncgggggggggggggggttttattanttctanncnnaanaataaanagnccccccccncggnaaagtctaaagnatacttaagntngggtngaccgngnacccaagccttcggcacngntctntctatggaagnggtntcgctntttncntancctcgcgcggggggngcatttttcganagtcgaaactccatcatctnnnttctctnatgntttnncnnaatntaacctttcnatntatntacntacttttntgctnngnattntncntacactanagaatntctcactcctntgancnnnntaagntgtggnaaanntgaanaacattttanttccaattntctnatngctcnnnatncnngngttttcnnntnntnctatnnaccttctatnctttanctnntttttnatantcnttaanttntctactcnnantnagttgatgatctnacatnttncatattntataatctcnacncntnatttnctaatacnntnctctntntanacttnnatcatntctatatgacgttnccttctacngntcattactantatttcntnatcttgtcaatnnantntacaattaattntntcncttatattgacatctcncttnctcactgtatacnatctcacacntgattaaatcntatcttntatcntntanttatnncnatatctngtcctaaanctctantntatcnaantttccnatntatctaactagtnntnnnatcanttnatntatnnnnanntntcacnttntctcttcanncatactnagtntannatgtacanngtntcctnttctcaactttatatnctttnntntnnatgcncttntatanngntgatnctttcctttnaanaaatntanctttcttatattctgagtntcacatantacatntatatnatgtntnnntncntatctattcttatnancctnctaanantcatctatcatctttnntttntntccatnatactctatntattcttcntttaatcttcntatntntatatntntcatctannntangntctctatattnanntnttttnatnncc

SEQ ID NO: 8244 - DNA, 751 bp, Homo sapiens
  misc_feature 3, 19, 20, 22, 24, 37, 106, 568, 574, 575, 591, 616, 617,650, 652, 661, 682, 697, 705, 708, 726, 731: n = A,T,C or G
agnttcaattccgcacggnntncngccccttttgggncgcatttaattttggtagtgttaatgtctattaatgtgattttttttttaacctttctcccaataggtngatgacaacaagaaactaggagaatgggtaggcctttgtaaaattgacagagaggggaaaccccgtaaagtggttggttgcagttgtgtagtagttaaggtaagtcaccgtttattctagggatgaaggttatgctgggtaatcatataaaaccttgtattgaaataagttgaggatcttataaaaggaaaaaactgattcaacaggtttaaagcattttctgcatttcaggaaaaaaataaaagctgtaatttacaagccagccaatgaatctgcttacctgattgtgtttgtgcagacatactttaaaaactggcaatagtaaagccatgttaccagccttaaggacattgaagtccgtaaggtccctgagaatggctataacaaatcttagtgatgggaaacatttttataaaaacatagctaattgttgaagctcccctataattggatactaataancttggnngaaaattcctaaatanttaaccaagaaaattgcctgccgtnnttttgttttttttaaaggactatggcaagggantncttcaaggnccaaggatgtcattgaaagantattttcaaatgccnggaaatgnaanaaaataaaatctttggcntcccnaaaaaaaaaaaaaaaaaaat

SEQ ID NO: 8245 - DNA, 740 bp, Homo sapiens
  misc_feature 3, 519, 547, 554, 577, 619, 620, 621, 622, 623, 624, 625,626, 627, 628, 629, 630, 631, 632, 633, 634, 635, 636, 637,638, 639, 640, 641, 642, 644, 652, 653, 654, 655, 656, 657,666, 674, 693, 694, 695, 703, 704, 705, 712, 716, 735: n = A,T,C or G
agnttcaatcgccgaggaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaagggctactaaaaggaaaaattgnggtactttttttaaattccctgttaagntcccctncattaatttttattgttcttggngagggaaaaaagtaaaacattgtttaatttttaaaaaaaaannnnnnnnnnnnnnnnnnnnnnnnanaaaaaaannnnnnaaaaaaccngggggtcnttaaaaatattgggggggnnntttttccnnnctccccncttnttaaaaaaccttttggggngggtc

SEQ ID NO: 8246 - DNA, 745 bp, Homo sapiens
  misc_feature 13, 40, 106, 461, 511, 517, 520, 529, 587, 603, 624, 643,666, 688: n = A,T,C or G
acgtttcaatcgnacgagatttttatgtgtttattcttantttatagaattcttagttgctggaagccctcaaaacttagtcatattaccattgggtatttattgngtccctttcaagtgagggacgagcataatcaaatctgcattgtacatgaccaggatttttttttaaaaaaacagtactgccctggtggatctagtttattattgagtgtatagcagaaaggtaaattgtttgccatgttggtgcagtttcattgggagggaagtgttaactcccctgagcactgcccttttctctctccttaattttacagtaggttgcaccaaaaccattcctctcagagaaagcaacactccagtatcttgtttccattaagagataattagctttcagcaaatcttcctcagcaaacaaattacattttaacttctttgagttcttttggagcaaaatttanctgttttcctgtattgcaaaaaaaaaaattgtttatgttctggatctaanaattgntgntattttagnttgcttggtaaagctatttggtttatgacaagattcataaaagtgctgtccccacagngaaattttaggggatntcttaaatgaagttcaccagnggaattaaagggtattagnggttgaagtgaaaaagtactttntgggccataccaggtcccctgncttcaagttggacttcttctaaataagttttggggccatttggccattctttcaata

SEQ ID NO: 8247 - DNA, 1336 bp, Homo sapiens
  misc_feature 6, 7, 9, 12, 19, 23, 26, 29, 30, 32, 36, 42, 44, 45, 46,50, 54, 55, 65, 66, 72, 74, 75, 78, 79, 81, 83, 86, 88,91, 94, 95, 96, 98, 100, 102, 103, 105, 106, 107, 111, 115,116, 119, 120, 126, 127, 132, 136, 139, 140, 144, 147, 148: n = A,T,C or G
  misc_feature 157, 159, 161, 162, 163, 164, 169, 171, 173, 175, 181, 191,192, 200, 209, 273, 274, 275, 287, 291, 292, 296, 297, 300,302, 303, 305, 313, 319, 322, 323, 328, 329, 335, 336, 337,343, 351, 352, 355, 361, 372, 376, 379, 380, 382, 385: n = A,T,C or G
  misc_feature 392, 413, 425, 426, 429, 432, 434, 443, 445, 447, 448, 449,456, 464, 465, 466, 469, 474, 476, 477, 478, 484, 494, 496,497, 499, 505, 507, 516, 521, 524, 526, 529, 530, 531, 547,549, 556, 558, 563, 567, 568, 571, 575, 576, 577, 579: n = A,T,C or G
  misc_feature 581, 587, 591, 592, 600, 605, 607, 611, 612, 616, 624, 626,627, 631, 632, 636, 638, 643, 645, 651, 662, 663, 664, 667,679, 682, 684, 685, 686, 689, 692, 695, 702, 707, 712, 714,720, 721, 738, 746, 755, 760, 776, 778, 784, 802, 807: n = A,T,C or G
  misc_feature 811, 818, 821, 823, 827, 828, 829, 832, 849, 850, 851, 857,866, 872, 874, 876, 882, 894, 897, 900, 903, 913, 914, 915,916, 918, 927, 936, 944, 950, 952, 958, 964, 971, 980, 982,984, 995, 1004, 1009, 1013, 1020, 1027, 1042, 1044: n = A,T,C or G
  misc_feature 1065, 1067, 1070, 1073, 1080, 1081, 1084, 1087, 1092, 1095,1097, 1098, 1102, 1103, 1106, 1111, 1114, 1116, 1117, 1122,1124, 1125, 1127, 1135, 1139, 1146, 1148, 1149, 1167, 1169,1174, 1181, 1182, 1196, 1199, 1209, 1213, 1224, 1228: n = A,T,C or G
ccatanncntcnaaaaatnatanacnacnntnctanctaaanannnctanatannccatatctcnnactcanannccnncntnatnanatntcnnntncncnnannncctntacnntannaatatnnccccncacnctnnatcnccnnctccatttncntnnnnttaancntngnaacacnatggtggccnntacaaaangcattcccnctatactacagtgtaaacctcatttttttcactccaaattgtagcagcccctcttcttcccacnnnggggctttttcntacnncctnnacncnnancacacagnacctanaanngattnnatacannnctatanatcacttnncanactcangttccgaacanaaanctnncncgnactatcncaccaccaatactcactatangaaaaaaaattnntcnccntntccccctangnannnactccantatcattnnnacnataanannnaaatcntactcgtccnannanatgatnancaacctccncatanatntnatnnntcttaatccacctctnantacggcnantcacnattnncancaannnangnatatancatnnaactactntctcncnactnntatntcctcccncnnaacnnctancntctantnaacacnctcaagcactnnntancaacttcaatanctnannnacnatncanttcgcgncttanactcntntaaatnntacacaccagctatgcnaccacaanccagtttanctctnagtatcgaaacatacntngatatnaatcatattaacataatntacgnacanaacaccncantnattnnnctncctaccaacatacgacnnntatatnctacgcacngcatangncntcctcncagcacctatcnacnctnctncaacaatacnnnnancctgactanacatactancgtacatncctcantntacttntctganataccantcgaagtgnantnatccacaagcntgcatatcnacgcnctanatactgnactcaanctatacatccgcacncnatacacatactctgacccaangntancancacatanncanctnaaccnacnannacgnnatntatcnatntnncctcntnntnacgtaatnaacngacgcananntaacaaccctatcatacnanaatcnaaggctnncatatccatacgcnacnatacctctcntacnctcatgtagangtcnacncnacnnaacnnntcacgaantctaaaacnatccncaagnaatacgtaacacgangnactcnntngactanntataacngcncncacangnaattntaaatncncn

SEQ ID NO: 8248 - DNA, 875 bp, Homo sapiens
  misc_feature 5, 6, 7, 10, 11, 12, 13, 14, 16, 17, 18, 20, 23, 24, 27,28, 30, 31, 32, 33, 34, 35, 39, 40, 41, 42, 44, 45, 47,49, 50, 51, 55, 56, 57, 58, 60, 63, 65, 68, 70, 71, 74,79, 82, 83, 85, 86, 88, 89, 90, 92, 102, 104, 107, 112,120, 121: n = A,T,C or G
  misc_feature 122, 123, 124, 125, 126, 127, 128, 131, 143, 147, 152, 166,170, 173, 177, 231, 232, 242, 719, 730, 747, 835, 843, 864,866, 874, 875: n = A,T,C or G
ccccnnncannnnngnnntncgnntcnncnnnnnnttcnnnncnncncnnngtcnnnntnacncntcntnntcnctcanctnntnntnnnanatcccccccncncantcccnctcccccnnnnnnnnncanattttcgaatcngcgngaacnttctcgactgcccngaanatngcanaccattatagggactagtttgcctttggaggaaaaggaaaattgcaaacccttnnggggagaccnatttgcctttggaggagaaagccaatttatcatccaaaatcctcagaattctcaaatacaaaaagttctgaaaactgaaagtttcttcttaagtttggtggcaaaagttatttatagtcttgacttatcccatttgatgtgaatctgcttacatttcattgcacaaaatgtttctgtgattgtgaaatactgttccagaagccactgggaggtttaacttaataaatagtatatgcaacgttttactcttctaaaatctgaaaattgtgaattctgaaacatatctcagagggtttcattaagaatttttgggcttatacaaatttatgctacataaatgtttatagtcttgtctttctctggtatatacgttcttactttgccattttacttttaggccctcaaatcatgccaagttatattttaagattttgtttttggcatttcaaaataactatggttactactatgatagtnttagggatggngaatagggtaaatcctngctttcaattttttattttggtattcaagaatatggttactgccccaatttattttggaagtttttcctcaaagcgtaaaaagttttngctttcangcccaggctgggtgggctcancncctcttann

SEQ ID NO: 8249 - DNA, 842 bp, Homo sapiens
  misc_feature 4, 6, 40, 41, 42, 43, 44, 57, 82, 104, 109, 117, 136, 137,158, 197, 224, 239, 260, 267, 279, 291, 309, 329, 334, 339,345, 352, 355, 357, 364, 366, 370, 378, 389, 397, 410, 412,419, 420, 428, 431, 437, 441, 446, 459, 463, 483, 487: n = A,T,C or G
  misc_feature 506, 507, 513, 517, 521, 526, 532, 537, 545, 592, 597, 607,616, 621, 622, 623, 625, 632, 636, 637, 639, 641, 649, 650,651, 656, 672, 679, 685, 690, 696, 700, 702, 703, 717, 721,724, 725, 739, 742, 746, 751, 752, 753, 755, 756, 763: n = A,T,C or G
  misc_feature 765, 766, 769, 770, 774, 776, 781, 790, 795, 796, 800, 836: n = A,T,C or G
aagntnaatccgcacgagactaactgggggattttattcnnnnngcccaccagcacnatcgccagcttgctcccaggattgncgtcgtgatcatttggacctgngatgnggcctttntcaatacgtggtcccctannttgttgcacaagttcaacgangtggtgtggcatgtgagctggtccatcacagccaacatnctggctgtctctggtggagacaataangtgaccctgtggaangagtcagttgatgggcagtgngtgagcnatcagagatgtnaacaaaggccanggctcccgtatcagcatnagtgaccagacggcccaccngaacnaagcnattganaatacangtngngcctgantncccncccgtcantccaagactgnccctttcntgggccaacttancncaaacanntggggaanaanccccancctncaacngggatttattttnccangtaagagtttacttttgctngccnccaatttgattcattctgnnctttancgcngatncgganaatggnttctncaaatctnacctgtcccaggctgtaaaagcacttccatgcttacccatggaaaanaaacntaacaaagtnaatggtttnaaaannntnatatttngagnncnanttatttannnaaccntttgggcttctcacgnccattanatttcnggggngggctntttngnntccccaaagggaancttntannaaaacggtccttanttntttntcttnnnannaatttantnnatnnctcntntactnttaactacnaaacnntctnttccgactacctataataaacttcttgtgggaggcngcttcg

SEQ ID NO: 8250 - DNA, 1236 bp, Homo sapiens
  misc_feature 2, 3, 6, 7, 8, 9, 10, 11, 12, 13, 14, 15, 16, 17, 18, 19,24, 26, 27, 29, 32, 33, 34, 37, 39, 40, 41, 42, 43, 44,47, 48, 50, 51, 54, 55, 59, 61, 62, 63, 65, 66, 67, 69,73, 78, 80, 81, 83, 84, 85, 86, 88, 94, 95, 97, 98, 105,107: n = A,T,C or G
  misc_feature 108, 111, 112, 113, 114, 116, 117, 118, 120, 125, 126, 130,132, 133, 134, 135, 137, 138, 139, 144, 148, 150, 153, 154,157, 159, 160, 163, 164, 168, 171, 172, 173, 174, 175, 177,184, 193, 195, 197, 198, 199, 200, 211, 215, 217, 218: n = A,T,C or G
  misc_feature 220, 222, 224, 227, 232, 242, 243, 247, 256, 257, 266, 272,281, 284, 288, 290, 329, 331, 334, 338, 339, 343, 344, 347,352, 353, 369, 373, 381, 394, 401, 403, 407, 413, 416, 417,420, 458, 461, 462, 466, 469, 470, 476, 480, 486, 493: n = A,T,C or G
  misc_feature 494, 513, 525, 531, 547, 549, 554, 558, 560, 562, 567, 568,569, 570, 575, 582, 593, 601, 615, 625, 630, 633, 635, 666,669, 671, 692, 693, 697, 699, 702, 707, 713, 718, 722, 729,730, 737, 742, 749, 753, 755, 756, 757, 758, 762, 764: n = A,T,C or G
  misc_feature 774, 778, 785, 791, 792, 798, 811, 813, 814, 823, 833, 835,839, 841, 847, 851, 857, 858, 860, 862, 863, 866, 869, 874,879, 886, 890, 893, 900, 901, 908, 918, 919, 930, 936, 938,945, 948, 955, 963, 964, 971, 983, 987, 993, 994, 999: n = A,T,C or G
  misc_feature 1004, 1006, 1032, 1034, 1045, 1052, 1055, 1058, 1065, 1076,1077, 1081, 1082, 1086, 1087, 1088, 1091, 1100, 1112, 1114,1116, 1128, 1130, 1135, 1138, 1143, 1146, 1157, 1162, 1168,1179, 1190, 1191, 1193, 1194, 1195, 1199, 1204, 1209: n = A,T,C or G
tnnttnnnnnnnnnnnnnnctttncnntnttnnnttncnnnnnnttnntnntcnnttcntnnncnnncnttcntttcntnntnnnntnttcttnntnntgctttncnnttnnnncnnntnttgtnnttcntnnnntnnntttcntttncnttnnctntnnccnntctnctnnnnntncgccccnccctctccntncnnnncccccccctcntctntnntntntnttnttttnacgcctgacnngttngaaatgggnnttttttttnttcttncgccccccntgnactncntcccatttttcctttttgccgacccctcttttttttggntngtntctnncctnntcnggggnntttttttcttttcctnttcncctctttntctctcctttttnttccttntntttntttccnccnntcntttttccttcctctctttctcttttctctttctttttnctnncttnttnntctttnctcntccctnttttccnnttctttttcccttcttctnccttcttctttnctttcntctccctctctccctntntctcntttntntncttcnnnnttttnttctttntcctctttctntcttcctnttttcttctttttnttcttcctcnctttntcntntcttcttctctctttctctttcctctttccntcntnctttcctctttcttttttgtnntctncntcnctttnttttcnccttntctntttctannttttctntctcntcttctncttncnnnntttntntcttttcctntctnttctccnctttcnntctctntctcctccttttntnntctctctcntctctctctncncctntnctctcntctntctctnncntnnttnttnctctnctctnttttccntctnttntcttctnntctctcntcttttttcnnttctcctcttntttctncnttctctnctntccttcnctctctcnngtctctntcttcttcctcnttcnttcctnnttttntctcntnttctcttctccttctcactttccctntncttttcccctncctctcnccnttntctctcnctctccctctnntttnncctnnntcntctctctcntcttcttctttntntnttctcttcttcntnctctnctntctcnttntccttctcttncctcntcctcnctctctttctntccctctcttnntnnnttcnccccnctttntctccntcttctnccctctgcntnncg

SEQ ID NO: 8251 - DNA, 1378 bp, Homo sapiens
  misc_feature 13, 14, 15, 23, 24, 28, 32, 36, 39, 40, 41, 50, 51, 52, 55,56, 59, 60, 61, 63, 65, 67, 72, 73, 76, 84, 88, 89, 94,95, 100, 104, 106, 107, 116, 130, 131, 132, 138, 142, 143,149, 151, 153, 158, 161, 175, 176, 180, 181, 183, 186, 190: n = A,T,C or G
  misc_feature 198, 216, 217, 221, 225, 233, 241, 246, 247, 256, 262, 264,273, 277, 279, 283, 285, 289, 293, 297, 305, 315, 318, 321,326, 327, 329, 332, 340, 346, 348, 371, 375, 392, 395, 396,399, 400, 413, 418, 419, 420, 422, 423, 426, 431, 432: n = A,T,C or G
  misc_feature 433, 437, 454, 461, 462, 464, 465, 466, 469, 472, 475, 477,483, 484, 488, 492, 493, 494, 496, 506, 514, 517, 522, 528,529, 535, 538, 542, 547, 548, 552, 555, 559, 565, 566, 570,573, 583, 586, 587, 593, 595, 599, 612, 616, 621, 627: n = A,T,C or G
  misc_feature 641, 650, 651, 653, 654, 655, 657, 663, 665, 670, 674, 675,681, 686, 687, 689, 692, 694, 699, 708, 710, 711, 717, 720,722, 724, 725, 731, 734, 735, 756, 757, 777, 791, 806, 816,820, 825, 829, 835, 838, 844, 852, 856, 863, 872, 880: n = A,T,C or G
  misc_feature 883, 884, 889, 890, 892, 908, 910, 926, 927, 932, 935, 936,940, 966, 989, 991, 992, 993, 994, 1000, 1001, 1005, 1009,1013, 1022, 1034, 1041, 1044, 1064, 1083, 1110, 1114, 1115,1122, 1131, 1134, 1135, 1136, 1145, 1147, 1149, 1157: n = A,T,C or G
  misc_feature 1169, 1193, 1202, 1205, 1208, 1211, 1218, 1220, 1233, 1234,1238, 1250, 1253, 1258, 1265, 1274, 1283, 1300, 1301, 1318,1332, 1337, 1344, 1346, 1363, 1365, 1370, 1371, 1376: n = A,T,C or G
tcctgtttactannntcatcatnncttnattnttcnccnnntttgtctcnnnctnntcnnntnangngtctnntcntctgggantcanntcacnncttcntctntnnctattgttncccccccctcctannncccccntctnnatattntntntaaantgnacgagtagggccgnntatnntnctntgantgaccccngctgtgtttgtaacctgnntatnctgntactctcnattttgcntgggnntctctttantcactnancgggggggntttncntatnantacntctngtcntcttcacnctttcttctnctnctntatcnnanatncttgcttnattacntnccccttcttatcctgggataatngacncttctcactttgcctcnttnnttnncctcatctcaagnaaaannntnngcntcccnnnatcntgcctcttgtcgagctncactacnngnnnctnctntancnatattnnagtntacnnnantcttatacantccactantantcccnccttannacgctntcnttancttcnnctgnacnattnatttanntctnacnattaacctantanngtagtncncttntatttactactgngccntagcncctgantgtctatcttacantttccgacnntnnnantctctncnttccnatgnncttctnttccnncncananttttncctcattcncnncatctnctnantnnctcttncgnngctattgtatatccgctttcnngatattgcactgtactctantctcactatccttntctcttacgtctcantactcctacntatntatcncgantctttntcnctacantcctctcntatncgtaatntactagtcncttagttnctnnacaanngngctctctcctcttccntnctcgctcctctattcnnctcantanntatncgtctcactctcttcttctccacacntcctccatattccgacgcgtctntnnnncttacnntagnctantctngtcccctanttgtactcactntctctcncantctaaactctttatcgcgtntttctctcactatctctcnacattatactctcatggatctctcccntccnnactatcngtttgccgnacnnngtcgagtantntntacttatnacgctcatacangatatatgtatattgtcgctcctntcttcttantcntanagnatccatntnaccatcttgctcnnattntcacttactctnctntcatnatctatntcatctgtntctactcgnctcatataccttcttcnnatgctctcatttacccnatctctctatgcgnctctncttcacngnatctatttcccctgttntntttcnntttcncc

SEQ ID NO: 8252 - DNA, 1333 bp, Homo sapiens
  misc_feature 40, 55, 84, 85, 103, 105, 107, 114, 115, 118, 137, 139, 140,141, 143, 171, 172, 181, 186, 188, 206, 211, 227, 233, 235,246, 251, 252, 254, 256, 259, 262, 271, 276, 278, 281, 286,300, 301, 303, 305, 313, 314, 315, 317, 318, 321: n = A,T,C or G
  misc_feature 326, 327, 329, 334, 335, 347, 348, 350, 360, 361, 362, 363,367, 372, 379, 380, 392, 398, 402, 403, 404, 405, 407, 412,434, 440, 442, 444, 447, 451, 457, 462, 463, 467, 475, 485,488, 496, 497, 500, 501, 508, 510, 511, 519, 520, 529: n = A,T,C or G
  misc_feature 532, 533, 534, 541, 546, 548, 561, 565, 568, 579, 580, 585,587, 593, 597, 606, 611, 623, 635, 636, 638, 642, 648, 650,658, 667, 669, 672, 673, 683, 684, 687, 692, 698, 703, 705,710, 713, 718, 720, 722, 737, 740, 744, 745, 749, 750: n = A,T,C or G
  misc_feature 753, 757, 770, 773, 786, 798, 805, 807, 811, 815, 822, 823,824, 827, 839, 843, 847, 855, 862, 865, 883, 885, 889, 898,902, 906, 912, 913, 914, 916, 919, 927, 931, 937, 946, 953,955, 958, 969, 988, 990, 998, 1002, 1003, 1006, 1022: n = A,T,C or G
  misc_feature 1026, 1032, 1034, 1035, 1037, 1045, 1049, 1068, 1073, 1085,1088, 1089, 1090, 1094, 1099, 1114, 1115, 1126, 1127, 1132,1134, 1137, 1147, 1151, 1153, 1161, 1165, 1168, 1169, 1173,1175, 1184, 1200, 1209, 1223, 1226, 1227, 1229, 1230: n = A,T,C or G
  misc_feature 1236, 1242, 1246, 1262, 1272, 1278, 1284, 1286, 1289, 1295,1311, 1319, 1321, 1329, 1331: n = A,T,C or G
ggcccaatttgggtttaacccaactcccccctcggggaangtccccccctttggncccaaggtttgggccctttggccgggggnncaggacccaaattccccnangncctttgnnccnaggagcgctttaaccgttntnnncnattctcgggtatttatttctctctcggnnccctttctnggcgntnggggggggggggggtttnttttngtatatacacctctcngagggngngaaaatacatncaccnncntntgnggnaaatttacngtcananacngccanaccatatactcccnnananatactttnnntnntcncaaanncngtacnnctttctctctannanttcgaatagnnnnacantcctntattttnntattttaacttntacaantgcnnnnantttanccctttttactgtaccaaaaanaaaaancntnttngccntttatngaggnntttntacaaaanattctttctntcnccaatttnnctnnccaaaantnnccctatcnntctaaaatnacnnnaaaaaantttcncnatcctcaaataanacanacnctatatttttnnaatgngnattcanaaanttgggcccnccatnaaaaaaaaaaancccccctttctnntncaanattganantttggcgngagaatttntnaanncctccccccnntanaaaantttgtnccctnanataanatntcatnananaatataaaaatattntcnaccnnatannttntctnacctcctcctcanctnactacatatcaancatccacttctntatatgngnactncctnactaatnnntantatttcactacnctcncctntacaatanttttagnatngtcatatcaatccctatncnctanttcttttcnattntacntctatnnncntancatcaacnaatnttcttnctagtatanatctacncnctntactcatcatncactatcatgctcttaatntntctctgcntacnnatnattacttacatattgncctntatttntnntntacttctnattntctcactcctccttctacntttanatatcatctctntcnnntacncgatntcctatatcacacgnntaaaatcaacnnaaatncncantcgctcttcntcancnccctcaancctnacnnttcntntcactgttntaactccaattctttnttaactctncatcattctctacntcnncnntattancacatntatncactctatctatttcntctacttacnactctntatcantnttnaatccnatttcttacctttatnaaatttcncnaatcttcncncc

SEQ ID NO: 8253 - DNA, 700 bp, Homo sapiens
  misc_feature 39, 40, 43, 45, 47, 48, 49, 50, 51, 52, 54, 55, 57, 58, 59,60, 61, 67, 68, 71, 72, 75, 367, 436, 474, 480, 507, 523,525, 527, 546, 607, 623, 662, 668, 672, 675, 690, 696: n = A,T,C or G
gccttttcgattccgcacgaggtgtggagtgtcccaagnnccncngnnnnnnanntnnnnnctaatnnacnnctngcagtgaaagtgggggcagactgagcctgtgtagtgaagtgtcttgaggaacgtcagctgtatcttttaggaaaccaaaactgcatagacattgaacccaggcagaaggtcatgaagtcagagctaagaaatgctagtggggatagggggtgagatagagttgggaaatgtttcagagctcaggtgacagttgttggtgtccagttggatatgtaccatgaagggaagaagcagtcagagtggcaccaagctttctagcctggaggactgaatggttctgtgcacatttcanatggaaagaatagaggcccacagaaagttaatgagatgcattttatacataccagttttgaattttaangacctgtggggtagatatccaagatggctattcccagnaattgnatttatatcttgctacatcgcaaaaangatttgaactcttacncncntaagatataagattaaatngctggacgtggtactcaccctgtatcccacattttggaggccagccggtggatacttgagncaggagttcagacaanctggccacatggtaaaacccatcctctaaacttcaaaantaccangggnggngggccggcctgtaanccactnttca

SEQ ID NO: 8254 - DNA, 970 bp, Homo sapiens
  misc_feature 2, 4, 5, 8, 9, 10, 11, 12, 13, 14, 15, 16, 17, 18, 19, 20,21, 22, 25, 28, 29, 30, 32, 33, 34, 35, 36, 37, 38, 39,40, 42, 43, 44, 45, 46, 48, 49, 50, 51, 52, 53, 54, 55,56, 57, 58, 59, 60, 61, 63, 64, 65, 66, 68, 69, 70, 71,72: n = A,T,C or G
  misc_feature 73, 74, 75, 77, 78, 79, 80, 82, 83, 84, 85, 86, 87, 88, 89,90, 91, 92, 93, 94, 95, 96, 97, 98, 103, 105, 106, 109,110, 111, 113, 114, 115, 116, 118, 119, 120, 121, 122, 123,125, 126, 127, 128, 129, 130, 131, 132, 134, 135, 136: n = A,T,C or G
  misc_feature 137, 138, 139, 140, 141, 142, 147, 148, 152, 153, 154, 155,156, 157, 158, 159, 160, 171, 172, 176, 177, 178, 179, 180,181, 182, 183, 191, 192, 193, 194, 196, 197, 200, 201, 203,206, 208, 211, 212, 214, 215, 216, 220, 221, 223, 224: n = A,T,C or G
  misc_feature 225, 226, 227, 236, 237, 238, 270, 300, 317, 326, 332, 466,623, 755, 757, 780, 805, 806, 816, 819, 843, 856, 878, 888,889, 890, 902, 911, 928, 931, 932, 943, 966, 968: n = A,T,C or G
cncnntannnnnnnnnnnnnnnacntcnnntnnnnnnnnnannnnntnnnnnnnnnnnnnncnnnncnnnnnnnnannnntnnnnnnnnnnnnnnnnntagtncnnatnnntnnnntnnnnnncnnnnnnnntnnnnnnnnnacccnncccnnnnnnnnntccccactccnntctnnnnnnnnaaataggnnnntnntanntnttntnttnntnnntatnnannnnnccccctttnnngttgacctgcaggcatgcaagcttgagttttntatagtgtcacctaaatagcttggcggggngtcatggtcatagctgnttcctgtgngaaatnggtatccgctcacaattccacacaacatacgagccggaagcataaagtgtaaagcctggggtgcctaatgagtgagctaactcacattaattgcgttgcgctcactgcccgctttccagtcgggaaacctgtcngtgccagctgcattaatgaatcggccaacgccgccggggagaggcggttttgcgtattgggcgctcttccgcttcctcgctcactgactcgcttgcgctcggtcgttcggctgcggcgagcggtatcagcttactcaaaggcggtaatacggttatncacagaatcagggggattaaccgcaggaaaagaacatgtgagcaaaaaggccagcaaaaggccaggaaccgtaaaaaggccgcgttgctggccgttttttccataggctcccgcccccttggcgaggcattnanaaaaaattcgacgcttcaaagtnatgaaggtgggcgaaaaccccgccnngacttttaanagnatacccaagcgttttccccttggnaagcttcctttgnggccccttttcttggtttccgnacccctggcnnntttacccgggantaccctggncccgcctttttttcccnttnnggggaaagcgngggggctttttcataagcttcancnct

SEQ ID NO: 8255 - DNA, 786 bp, Homo sapiens
  misc_feature 2, 3, 9, 214, 233, 234, 428, 553, 572, 576, 624, 630, 637,640, 643, 644, 660, 663, 666, 667, 674, 676, 697, 709, 721,723, 725, 729, 737, 743, 746, 760, 766, 768, 782, 784: n = A,T,C or G
cnncccctngaattcggcacgaggaaccctgactctgcctcttagcccctgggttgaagccgactagagaatctcagacgtgcttaaccggtctgttgggcttccctgcccttttccagtcccaggtttcctttccctgctcccttcctgcttctaatttcagccaaagagaaagcaaagatttagaaaagaagggtaggaagaagctggaatntgaattggcaagagaagtnngaggttgtcttttctagatcaaaacaatttttaataggctgatgttcacatgttgcactttctaaagcccgtgcttgacctcctaaggaattttaagtcctattctgataatcgatttatgaagtaaattgccattaacgcctctgttttatagattaagaagaaaatgaggtcacagataaatatccgtgccnaaacgacgtggtctttgaactgacctccaggcacgatgtcattatttaactcgagaaatcacagcttctgcgtcctaccattctgccaatattcacaggccaagaagctcaacttaacacccctnggtagaaaaaaagaagaancccnttaaatatttgcttggaataccgggaaaggagaaaggggaaataattnggaacntaacctntgnctnngggaggggggaaaaancanatnntgggaananatcccacatcgcaccccctgntatggaaagccnttttgaacacanantngaantgggaggngctttnttngggaaaaacccctntcccanantttttttggaaaancnat

SEQ ID NO: 8256 - DNA, 754 bp, Homo sapiens
  misc_feature 2, 3, 5, 401, 413, 434, 471, 493, 510, 515, 524, 533, 553,572, 576, 578, 615, 619, 623, 625, 627, 628, 629, 630, 637,639, 645, 652, 656, 661, 669, 673, 680, 688, 689, 693, 698,700, 709, 710, 717, 719, 720, 721, 723, 724, 725, 729: n = A,T,C or G
  misc_feature 731, 732, 733, 735, 740, 747, 752, 753: n = A,T,C or G
cnntnccttcgtgcccaaggcgcccggactcggctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaanaagctgggatcnctgcagccatgttttcccggncatgccggcgttgtaacctcaggacctttccttgtangaacagcctttctcgaatctgntttcagctcttgcattncatanatgaaaccncagcatgtnaaagaactatttttttaaanaagtgatttttcttattanaccnantccaaatttttaaaaaaaaaaaaaaaaaaaaaaaccncganctcntncnnnnttttccngngccccntttactntccntcccnaaaacctnatanaaaaacntttttgtnnatgntggcnanaaccccccnntcttaantnnncnnntccncnnncnccccncctcctnccccnna

SEQ ID NO: 8257 - DNA, 1109 bp, Homo sapiens
  misc_feature 3, 5, 6, 7, 8, 10, 11, 12, 15, 19, 29, 32, 36, 41, 42, 45,46, 49, 51, 53, 56, 59, 63, 65, 69, 75, 78, 91, 100, 101,104, 108, 110, 122, 129, 133, 134, 135, 141, 148, 161, 162,163, 173, 174, 175, 182, 197, 206, 209, 223, 224, 225: n = A,T,C or G
  misc_feature 228, 230, 233, 240, 243, 244, 258, 262, 263, 264, 269, 270,272, 276, 288, 291, 296, 297, 304, 306, 312, 313, 317, 320,323, 327, 333, 336, 340, 347, 353, 354, 355, 356, 358, 359,360, 364, 367, 371, 373, 376, 377, 378, 381, 385, 386: n = A,T,C or G
  misc_feature 388, 389, 396, 398, 402, 403, 406, 408, 410, 411, 414, 418,421, 427, 429, 430, 432, 433, 434, 436, 439, 440, 441, 442,449, 453, 457, 458, 459, 463, 465, 466, 468, 469, 471, 476,477, 479, 489, 491, 492, 493, 494, 496, 502, 503, 505: n = A,T,C or G
  misc_feature 506, 508, 510, 512, 513, 515, 522, 523, 524, 525, 526, 530,531, 532, 535, 537, 539, 541, 543, 544, 545, 546, 549, 550,551, 552, 553, 554, 555, 557, 559, 560, 563, 564, 566, 567,569, 575, 581, 586, 589, 593, 602, 605, 610, 612, 613: n = A,T,C or G
  misc_feature 614, 615, 616, 619, 623, 624, 625, 626, 630, 633, 635, 638,644, 645, 647, 650, 652, 654, 655, 657, 660, 662, 669, 671,672, 675, 682, 683, 687, 690, 691, 692, 693, 694, 699, 704,710, 723, 724, 725, 729, 730, 732, 734, 737, 743, 747: n = A,T,C or G
  misc_feature 749, 757, 759, 760, 763, 769, 771, 774, 778, 780, 784, 785,786, 789, 791, 793, 794, 795, 796, 802, 803, 804, 808, 809,810, 813, 814, 818, 820, 821, 825, 826, 827, 829, 834, 835,836, 841, 850, 852, 855, 859, 864, 869, 873, 876, 883: n = A,T,C or G
tgngnnnngnnnggnccgntgggaaggtntcnacgncacanngannaancncngantcngtananattntgtatnagncctttgaagtatnttggggttnnacngggnancgtttagttcgngatgacnatgnnnaatttntatagangattatgggagcnnngccgatgtannntatatgnttgtcacatttatcntattcctcnatngtcatattaatatnnnttnancgngcgatanganngtgggggggtgcgncatnnntagannanttgntcatggaatagnatncgtannttttaancnaatccnngttnatnatntgancacggnccntatnaggacgnattgannnntnnngagntantaanantgnnnacncggnntnnagaggtngnctcnnaancntnnttntcantgngaagtncnncnnncntannnnataatgngtcntagnnncaantnnanntngtgannantgtgtgatgnannnngntatatnnanngntngnntnttaagtnnnnnggannnggncngngncnnnngtnnnnnnntngnntannanncngcgttntatgcnattgngtntcanctcagtctntcngtcangnnnnngcncgannnngtantancntgnttaganntnganangnntncgntngggagtncnntgngggactnncacnacnnnnngattntcgcngatgancgcctctgatatnnncggnncntnatncatgcncgtntntgacctanannagntcaacncntgnatcntnactnnnttnancnnnntgttannncgannnggnntgtncnnactnnntntgacnnntcacncggtgttancntgnagancacanacgantgcnctntgtctannngnntganaaccgatgtgttgcacgnaatntatctgtanatttcncntgnngngcatagnnnagngnaaatngangcacgnannntggcataantnatcanannantcgtnattaattgagtntatacggantnatannnnntgtcnggattatacgatatangnacntgtncannatganantatgaatcnanatgnacattaaggatngggatntanacgaag

SEQ ID NO: 8258 - DNA, 978 bp, Homo sapiens
  misc_feature 10, 17, 21, 25, 27, 30, 34, 43, 53, 55, 57, 58, 59, 60, 66,72, 83, 96, 140, 154, 163, 168, 169, 171, 172, 183, 196,203, 206, 207, 209, 212, 218, 223, 227, 232, 234, 236, 237,242, 243, 250, 251, 253, 254, 255, 263, 267, 270, 273: n = A,T,C or G
  misc_feature 279, 281, 282, 284, 297, 299, 307, 308, 314, 316, 320, 323,324, 325, 333, 338, 341, 342, 343, 345, 347, 350, 353, 358,360, 366, 371, 372, 373, 377, 384, 388, 393, 395, 397, 399,400, 402, 403, 405, 407, 408, 411, 412, 415, 416, 418: n = A,T,C or G
  misc_feature 426, 428, 429, 431, 433, 434, 435, 436, 441, 443, 444, 450,451, 453, 455, 456, 458, 465, 469, 471, 472, 473, 476, 479,480, 485, 489, 490, 492, 493, 495, 497, 503, 505, 508, 512,515, 517, 519, 521, 522, 523, 524, 525, 527, 531, 532: n = A,T,C or G
  misc_feature 533, 540, 542, 555, 557, 559, 560, 565, 568, 571, 578, 579,580, 581, 587, 591, 593, 595, 599, 604, 606, 608, 609, 613,624, 630, 640, 643, 644, 654, 655, 656, 657, 659, 665, 667,668, 670, 673, 674, 675, 676, 677, 680, 683, 685, 690: n = A,T,C or G
  misc_feature 693, 697, 701, 703, 710, 712, 714, 719, 721, 723, 724, 728,731, 742, 750, 751, 752, 753, 760, 764, 766, 767, 769, 772,777, 778, 779, 786, 789, 791, 792, 799, 800, 807, 810, 811,812, 814, 817, 818, 819, 820, 823, 825, 827, 829, 833: n = A,T,C or G
  misc_feature 834, 835, 838, 842, 848, 851, 852, 857, 861, 864, 865, 870,871, 873, 874, 875, 877, 886, 889, 895, 898, 901, 903, 908,913, 918, 919, 924, 936, 938, 941, 943, 945, 946, 952, 960,973, 974, 975, 978: n = A,T,C or G
ggggggggancgtaatntcgnctcntntgnattntaagaattngtactattgngngnnnngtattntgcacntgagattaatncagacgatcgctntagtagcctatgacagctctgcccggtacattttatgtctatcncccttagtgggcgnggctcatgnattanntnncacgggattcnacttgatgtgagntgttgcncanntnttnattttntgagntcangcagnangnntagcnnagtttannannntgtaagantgcngcnttnaagtantnnangggcgtccagtgntngtgaaagnnggtagnanatanccnnnggaacggnttttngannnanangcnganccgcngnttgaanaggannnatgngcgaggnttanggtgnantngnnanntnanncannatnntntgtgggcnanntntnnnnattcngnntgcccnngntnnancggatanccgngnnnggnccnnggatnattnngnntnanattgangngantgangcnangntnnnnntngtcnnncgccctntnatcgtgtgtacgngncnnctgtngtntancatgtgnnnncatagnaacnanantcgntatgngnanntgtntatggaaattnagatgnatatggtttntannggaggttgtnnnnancagcgntnnanctnnnnnggntantntcaancgntagnaacntngtgtgcntnangaggngntnnaagnatngtgcaggaagntggggctnnnnttacctnaatntnngnagntctgnnncatagtnacncnntgaaccnncctaggnaannngnctnnnnccngnancngttnnngtnttangcaccnttnnagaangctnaannccggnngnnngntgaattagncgnttgagnggnggngntcgantaaantgggnntgatnataatattatcnangcncnannatgtgncgtatggngcaaattcaggcnnntan

SEQ ID NO: 8259 - DNA, 778 bp, Homo sapiens
  misc_feature 5, 15, 26, 56, 92, 142, 156, 157, 185, 214, 218, 232, 234,247, 275, 319, 327, 330, 335, 336, 337, 339, 347, 353, 356,374, 409, 413, 414, 431, 433, 448, 465, 466, 471, 488, 493,500, 501, 513, 514, 516, 518, 522, 523, 527, 529, 545: n = A,T,C or G
  misc_feature 549, 555, 563, 565, 568, 570, 571, 573, 579, 597, 603, 621,628, 630, 635, 637, 646, 647, 657, 658, 659, 663, 666, 669,670, 674, 675, 679, 682, 699, 712, 722, 723, 724, 733, 735,749, 750, 756, 757, 760, 762, 768, 771, 772, 777: n = A,T,C or G
gcccnctcgaatttncacgacggacngccagcccaccatgtgtttagatgggatantatggtatttttcatgtgtcattgcctggcatggtntatattcgactacattcactcaggggtgtcccagggtggcacactgtgtntttcaaaacttgannatgcagtccgcctggttcatccgcgaanccatgacaatatacatttttttgtctgcnttangggacccaactatnanctggagaactggncgctacagattacgctgcgggggtacancagacgaaatcctacatgtataactacagctctgtgactgtatntaaagganaanagagnnntnttataaantatgtntanataaatgctttcaaaaantctaccttctgcagtttttatcacatgtatgtctnggtnnctgccctttaatcattntngcatggcccttgccnctgtgaaaaaaaaaaanncatcngtagtctttggccaaantgatncaatttnntttttgtggaanntngnaganntcancntagaattgctttttanggancctggncccggttnantcntnngntggctntattttttttaaaacaanatgaantcaatcttttctctcagnccgcttntntcaananaacttttgnncccggcattnnntcantanaannaaanntccnttnctttgctcacgcaaccnttttttaaaaccntttaaccggnnnggcagcacncntctggttttctaanntttcannaanantcctcncanncggana

SEQ ID NO: 8260 - DNA, 1165 bp, Homo sapiens
  misc_feature 6, 10, 14, 15, 16, 19, 21, 29, 35, 40, 44, 45, 47, 53, 54,60, 61, 62, 66, 71, 75, 80, 81, 87, 90, 92, 93, 94, 98,101, 105, 106, 107, 113, 120, 133, 134, 139, 140, 142, 148,159, 161, 169, 170, 171, 176, 177, 179, 180, 185, 186, 187: n = A,T,C or G
  misc_feature 188, 190, 194, 196, 198, 202, 206, 208, 213, 215, 216, 217,220, 222, 228, 229, 232, 233, 238, 243, 245, 249, 250, 252,255, 256, 260, 261, 263, 266, 272, 273, 277, 279, 281, 282,284, 287, 290, 291, 294, 296, 300, 301, 306, 311, 315: n = A,T,C or G
  misc_feature 320, 326, 334, 335, 342, 343, 346, 347, 352, 353, 355, 358,364, 365, 368, 371, 377, 380, 386, 389, 397, 398, 399, 411,414, 416, 419, 422, 424, 425, 436, 440, 454, 463, 470, 471,472, 478, 482, 487, 490, 491, 500, 502, 504, 507, 509: n = A,T,C or G
  misc_feature 510, 521, 524, 527, 528, 547, 556, 563, 566, 574, 582, 586,597, 601, 602, 604, 608, 612, 614, 615, 616, 618, 620, 622,624, 628, 637, 645, 648, 655, 661, 663, 664, 673, 675, 680,681, 683, 691, 692, 694, 697, 702, 708, 709, 710, 713: n = A,T,C or G
  misc_feature 719, 726, 729, 733, 736, 740, 742, 744, 749, 751, 753, 769,772, 775, 776, 779, 785, 796, 799, 801, 809, 810, 817, 824,829, 834, 835, 845, 853, 863, 864, 867, 870, 875, 877, 878,880, 884, 885, 886, 892, 895, 897, 899, 916, 924, 935: n = A,T,C or G
  misc_feature 939, 945, 951, 957, 958, 963, 978, 984, 987, 993, 994, 1001,1003, 1007, 1008, 1009, 1012, 1022, 1028, 1034, 1035, 1042,1043, 1044, 1049, 1051, 1056, 1057, 1060, 1065, 1079, 1083,1085, 1087, 1090, 1093, 1094, 1098, 1103, 1106, 1107: n = A,T,C or G
ggggcntggntaannngancncgcaggtngggcgngactntganntncattannttacannncggntaatnagtntgcanntaaaanttncnnnttgnttntggnnnttttcntaaatanataacatttgcgnntgagnncngttccntcaattgcccngntggcgggnnngacgnnannccttnnnnanggcnangngacntgcngnttgtncnnnagntnacttgnnatnnaatcncttgncngccnnangtnngtanntnggngaaaanntcgntntnntnccnccnnttncnacgnnagtgnagtangatnggctnaatttntcttaagnntattgannganncagtnntncgnctaatnntcngcnaatcgngtncagtgnatnagtcgagnnngtatctcgcttngtnantangtncnnagtgtgtgtangtcnacgcggctgtgganttgtattangagtaannnacgcgncgantgatnagnnattgctatngngntantnnttcagcggacnttnatnntgcgaggcgtgttatacantgatgaggntagatanctntctccgtntgataatntgancgagagtaagngccnngngtanagangnnncntnananagangtgagtatntcagaagncgngtatttncgatananngtagcgacntnccgcnngnatgtctanngnctnggacnagctgnnnatnatatgncagatgnaancctnatntgtncntnaacangnanacacgagatatatctngantanncgntgtatntatatatgtgnttncnagattgtnnagacganatgatcntatantatgnngaatgtggcngtatagangcgttaaacnnagncgnagttntnngntaannnaactantcntngncaacgcaatatgtggcnaaatgatnctccatcttanagcngcgcgnggattnatattnnttaanaacgatcgttgtgtntccacngangaagtnnaatgatntnctannncangtatatgaancggagnaagttnnatgatcnnnaatantngtgtnntanatcgnatgtatatagtgcnacgnantnctngcnngaantaganctnntnttntgntacncacaatntcntnancctgcnnnngantattacgtcnntntngtgan

SEQ ID NO: 8261 - DNA, 1271 bp, Homo sapiens
  misc_feature 1, 2, 3, 4, 6, 7, 8, 9, 23, 27, 39, 41, 42, 47, 48, 49, 50,56, 58, 59, 61, 64, 75, 90, 95, 112, 114, 117, 122, 144,145, 147, 155, 156, 162, 164, 166, 168, 173, 174, 177, 179,180, 191, 197, 206, 207, 212, 217, 220, 225, 232, 245: n = A,T,C or G
  misc_feature 252, 256, 257, 270, 275, 277, 283, 290, 293, 295, 305, 318,321, 324, 330, 346, 357, 362, 367, 385, 388, 391, 394, 400,404, 405, 406, 408, 413, 414, 424, 429, 432, 438, 439, 441,442, 443, 444, 445, 451, 453, 457, 462, 463, 468, 474: n = A,T,C or G
  misc_feature 475, 476, 479, 481, 484, 487, 491, 492, 494, 498, 499, 501,505, 511, 512, 513, 517, 519, 521, 525, 533, 537, 541, 542,545, 547, 550, 554, 556, 559, 561, 563, 564, 567, 568, 570,572, 577, 578, 581, 583, 585, 586, 587, 593, 594, 595: n = A,T,C or G
  misc_feature 600, 603, 605, 607, 608, 609, 612, 621, 622, 623, 626, 628,629, 637, 650, 652, 655, 656, 657, 662, 663, 664, 665, 666,669, 672, 673, 680, 681, 691, 693, 694, 696, 699, 704, 705,706, 709, 711, 715, 716, 717, 724, 725, 729, 732, 733: n = A,T,C or G
  misc_feature 737, 742, 744, 745, 746, 747, 748, 751, 752, 756, 757, 758,760, 761, 764, 766, 767, 771, 773, 777, 778, 780, 781, 782,787, 788, 789, 798, 799, 800, 801, 804, 813, 815, 818, 828,829, 832, 834, 835, 841, 850, 854, 857, 859, 864, 867: n = A,T,C or G
  misc_feature 875, 877, 879, 883, 886, 890, 897, 899, 902, 903, 906, 909,912, 914, 915, 917, 918, 927, 931, 937, 944, 945, 948, 951,953, 954, 962, 963, 966, 970, 972, 973, 986, 989, 992, 996,999, 1008, 1013, 1015, 1022, 1025, 1027, 1033, 1039: n = A,T,C or G
nnnncnnnncaccccaccactgnccgnaaaactatgganannaaaannnntgggcnanngntcntgaaaaagggngatgtatggatttanatccncattggcgtctcaaaanangangggangactaggaggggggtgaattanntntgtcatanncgaggngntntnaatannatnannatgcccgattntatctnaaactgtannctccnatccnatntattngcatgcnacagtaacgtacnccatctntacnnactatctaatctnctcgngngggggnggtgctnttntntatgcaattntaaacaccgcganttntcntataancgcatcgatatactgnctcgtcacacncgtancgccnctgatagttatttgatcngcnatnccncccttnttgnnncnaatcnnaccgatacgntaccnctnataacnntnnnnntgctgnantatntcccnntatcncttcannnaangnacnccntgtnntncatnncnttcngcttcnnncaantnanctgntctagctnagtnaacnnaananccnttcncnatntngnntcnntntntgtcnntantnannntaaatnnnccaancancngnnnaanttcatattnnnccncnngcacacgnagtaatgcgtcantntannnctcgnnnnnatntannatctacnntctttatcgncnntntgnactgnnnatncnaatnnncgccaanncatncanntggntgtancnnnnnatnnacannngnnttnanntccncnatcnntnnncgacnnngaatcatannnngcnactgtaagnantantacgctgtgnnatnannttgcgncatctgacncgantantncgacntanatatcatntntnattnatntacncgcatancntgnnatnatntantnncnnattcaaaangtanatgcgnctatatnnccnccntnngatacatnntcngacntnngtaagatatcggngantanatgntgntccctactngggtnanactagcnctntncaagtngatcgntntntgtngtgtaagacntgncgtcttntgtatacgaanngatacgccgtnccccnanatatangntncnntnngacgatantacatcctcaanagtatgactctnncgcantgaatagttatanatanatatntcanatggatnggagttattannatgtactctacttatnctccgactattatgtacaccgtnatgtacnancgatactaccntataatntacgcgntg

SEQ ID NO: 8262 - DNA, 740 bp, Homo sapiens
  misc_feature 6, 16, 30, 34, 450, 472, 528, 560, 614, 633, 639, 646, 649,661, 663, 666, 694, 698, 704, 710, 711, 714, 725, 727, 728,730, 736: n = A,T,C or G
cctttnttaaaaaacnagccacaaaatccncccntggatctagtctggatctggacttgaagggaaacatttttcttatcttttgctataagggacattagtgggacacttggcaaaatttaaattaactgtagattagataatactattgtattgttaattttctggcttttattctactttgattatattataaaagtccttgttgttaggaaatagacactaattattttgggttaaaggaatatcatgtgaaattcactttcaaacagttccaaaaaacacagtgatatatatgtatatatatgggtgtatacacacacacacacacacacacacacacagagaaagcagtgtaataaaagttaagatcatttgggaaatctgggaattcttttacaatcttaggaactattctctaatgaaattatttaaatatgaaatgttacngtatttaatatgaaaaaagagngagctcgctgtatgtattctctcatgcaaaagtatcggccatattattgccaaggncaaaagcaagtttttgaaagtaggatgtatanctctgtccccattttttgtgaaaaaatgggatgtatgaaatgcatgtgcataanaaaccaatctgttggcccnggggcngaaggcnccncccctgtaattncnacncttaagggaaggctgaacccagccgganccancaaggntcaggnnaantgaaaaccttncnngnttaaanaagg

SEQ ID NO: 8263 - DNA, 718 bp, Homo sapiens
  misc_feature 4, 6, 551, 581, 608, 611, 620, 621, 653, 666, 691, 694, 696,698, 700: n = A,T,C or G
cctntnatcgccaagtgactgtgctccctgaccgcaacaaaccgacctcacactgatgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttcttctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacaggggatcgggccaggctcccagattcttgaggacagggacttcngcatttactaattggggggactactgtggnggtaagggggcgcctgcttgcctgatncangatggggtnnagggacaagtgggccggtcctcactcacggantgggggggtgtangctggcccaccccccaaggcttgtncancnantnttcttccccgcagggcca

SEQ ID NO: 8264 - DNA, 739 bp, Homo sapiens
  misc_feature 3, 6, 42, 565, 598, 632, 649, 696, 709, 720, 731: n = A,T,C or G
ccntcnttcgaattcgcacgaaggcaccccctcccggggtgntggttcctccttgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacagtgggtccaggaccagacctctctacaaaaaattgccccaactacagtttgcaaccccaaaccacattagaagtctgtgcagacatccctccgtggtgtgtgtcttggngcattggaaaaggagtcaggagcccactgtgangtgagaatgaaaagtggatctcaacttgggcacngggggctcacgcctgtnaatcctaacaccttggggggtcaaaggtgggtgggatcacttgaggncaaggagtttgangccagcctggncaacattggcnaaacccct

SEQ ID NO: 8265 - DNA, 732 bp, Homo sapiens
  misc_feature 1, 15, 67, 214, 450, 505, 531, 548, 607, 635, 659, 681, 687,689, 708, 731: n = A,T,C or G
nctcacccatttttnacaggattttatttcggtgcatgcattctgctccaagtgtcacaattctggntacaataattataatatttggagttactactaagactttcctgaaagaggtgtattgtcccaaattttgtaacataaaaaaatactaaatgatcttaaagcttcctaaattgtgaaaagggtatgtgctaacatctcagaactttanacctgcttgttgtcatctttaccgatctctgatgataaatgcagaagggatctgagagtttttaaagcaagtagagtcaatcagagttttgaacatcatagtaatacttccgtgattcagagttagatcatataaatcaaagtaacaatttggattttttttaaacaacaatatcataactgtcataaaacagatggtccaaccccaggagcagataataacttgggcagctctgnggggaacaagacggggaaaacaactgttctaactgcccactagaacagtggtttnaactactacaattctcagtgtttganaggtcaagggaagaaangactatgtggatcccttgtggctatgcagatactacctcaccagagttgtcggtagaanactggtggtttggttcaaaccttgtgantaaaagagttggccaaccttttantcttttggaataaaagccaccntttctnanccaaaaaaaaaaaaaaaanctcccccccttaaaaattattcna

SEQ ID NO: 8266 - DNA, 803 bp, Homo sapiens
  misc_feature 6, 14, 57, 88, 264, 308, 427, 478, 510, 514, 517, 518, 521,530, 571, 606, 620, 651, 655, 658, 659, 687, 693, 719, 738,739, 743, 745, 761, 771, 774, 783, 784, 788: n = A,T,C or G
cccccntcgattcngccgagtggccaagggtggggccaagactccacatagatccangggctcattccatgatgctctcatttcctanagtcctccaggtgtacagggaattgtttcactgacagacaggccaggatatctcataagcttcttgggcacaagttggagtggtatgggtggaattccagcacaattaggcatatccgtggttgggtgaacacaaccatacaagggggagaggtctctaccagtggcctgtgcagncctgccatgttctttcctggtcaatgttttaaatgataacttgnaatactactaaatacagccgggccgcagtggctcacgcctgtaatcccagcactttgggaggctgaggtgggtggatcacttgaggtcaggagttcaagaccagcctggccaacatagngaaaccccatctctactaaaaatacaaaaaattagccaggcatactggcangcaccctgtagtcccagctactccgggaggcntgangcnnganaaatccccntgtacccccgggaggtgggaggttgcaccagaagcccaaanattcgctacccacccactggtactttccagccgtngggccaaacaagangtggaagaactcttgtcttccaaaaaaccanaacnatnnaaaaccctgggcggggggccaacaagcnggcttnattgccctggtaaattcccaacaacnttttggggaaggcccccanngcananccggattcattgaagntcacggaaantgngaaaacccnnttcntgggcccaacattgg

SEQ ID NO: 8267 - DNA, 763 bp, Homo sapiens
  misc_feature 2, 9, 13, 26, 49, 59, 81, 90, 467, 488, 563, 566, 619, 640,643, 648, 686, 701, 715, 724, 728, 730, 733, 744, 747, 748,759, 763: n = A,T,C or G
cnccccccngttntggttgggaggtnttctgaacttaaaaaggaaaatngcaaccattntagggactagttgcctttggangaaaagganaattgcaaacccttataaagaccaatttgcctttggaggagaaagccaatttatcatccaaaatcctcagaattctcaaatacaaaaagttctgaaaactgaaagtttcttcttaagtttggtggcaaaagttatttatagtcttgacttatcccatttgatgtgaatctgcttacatttcattgcacaaaatgtttctgtgattgtgaaatactgttccagaagccactgggaggtttaacttaataaatagtatatgcaacgttttactcttctaaaatctgaaaattgtgaattctgaaacatatctcagagggtttcattaagaatttttgggcttatacaaatttatgctacataaatgtttatagtcttgnctttctctgggatataccgtntttactttgcccttttactttaggccctcaaatcatgcaagttatattttaaattttgcttttgcctttcaaaantanctatggttactactatgataggtttaaggatggggaaaagggtaaatcttgcnttccatttttttaattttggnaantccanaattatggtttacctggccccaattttaatttttgggngttttttttccttcnaaagccgttaaaangttttgggntttnanggnccaaggggggnggnngggcctcaccncccn

SEQ ID NO: 8268 - DNA, 1113 bp, Homo sapiens
  misc_feature 18, 30, 33, 38, 42, 43, 44, 53, 55, 56, 59, 60, 71, 101,103, 110, 113, 121, 123, 128, 129, 133, 139, 140, 153, 156,166, 172, 187, 188, 190, 202, 207, 212, 214, 245, 251, 254,275, 287, 288, 291, 292, 296, 317, 323, 325, 327, 340: n = A,T,C or G
  misc_feature 345, 346, 354, 358, 368, 377, 378, 380, 383, 392, 398, 406,418, 419, 420, 423, 429, 433, 435, 440, 443, 451, 458, 461,463, 470, 471, 477, 478, 482, 483, 487, 489, 493, 496, 501,503, 509, 510, 512, 513, 514, 518, 523, 528, 530, 535: n = A,T,C or G
  misc_feature 537, 538, 542, 551, 553, 563, 566, 568, 569, 577, 578, 581,582, 585, 586, 587, 590, 611, 612, 613, 615, 616, 617, 621,624, 626, 634, 636, 639, 640, 644, 651, 655, 659, 662, 663,669, 671, 673, 676, 681, 684, 686, 698, 702, 707, 708: n = A,T,C or G
  misc_feature 709, 710, 717, 728, 730, 731, 736, 738, 745, 746, 748, 753,761, 767, 768, 770, 779, 780, 781, 788, 793, 796, 798, 800,802, 804, 806, 809, 812, 819, 828, 835, 838, 849, 854, 856,862, 863, 867, 868, 875, 879, 890, 893, 894, 897, 900: n = A,T,C or G
  misc_feature 901, 909, 915, 919, 920, 921, 925, 933, 936, 944, 949, 954,961, 962, 965, 966, 971, 972, 976, 978, 981, 986, 994, 1007,1009, 1012, 1013, 1014, 1018, 1027, 1031, 1036, 1039, 1040,1050, 1051, 1052, 1057, 1060, 1061, 1070, 1073, 1074: n = A,T,C or G
  misc_feature 1076, 1083, 1084, 1087, 1094, 1095, 1096, 1099, 1100, 1102,1105, 1109, 1112: n = A,T,C or G
acgggggaggccctaccnggttaatgcggnaanattcngggnnnaacgggaangnnaannataggattttngtaaaagatatttcccaatgggagccaaantnggttcanctnggctagcntntctgnntatntgcgcnnaatctacgccctntancgtggccaantatggnatggggggttaagannanggctcgccactntgctntgtcntntactatctatatttatagggggggggggggngagccnctnttttcccgcccacactatctnggtatgacgccnntcnntctntcgcatggatgtggcacatantattgntntnaccatttaatgtntctgnnaatccatngggntaccacgganatatgtaannanttntatgcggcnctaggntctccgcnaaagtctattgnnnatnatgctntctncntactnccngcgtgaanattacgnctncngcccctnncttaannctgnntttntngaanatnctccntntacacnntnnntacncctanttgtntnctgcncnnccanaaatatccntnccataacttncangnntcgcacanngcnnaannnctntcccttctcccatcccatttnnncnnnattnaantntcgtatananttnngaancttattngaancganccnntcaacntngncgntctcnttntntaaattcgaagntctntgggnnnnaaaatgncctggccgccntnnaaggngnttccccnngnaacantcttcccnttgttnnangttgtggannntaaaatngggtnctnantncnangnccnaancgggctnggggagaanacattgnctnccgggtaaaantaaananatatanntccnnttactcntctncatatagaaanaannagnagnntcctctcnttttcntgcnnnaaanctattatncgncggtaatnggccnctagnaaacatnntgnnaaaannttcntntgncctcncatataantgccactaaatcntntcnnnaacntggtggggnttangaganaannttccttcagnnnttctnatnntgggatccnctnngnggaacannatnatttctnnncanngnggncaanatna

SEQ ID NO: 8269 - DNA, 736 bp, Homo sapiens
  misc_feature 1, 4, 399, 400, 442, 449, 462, 508, 516, 554, 575, 590, 600,640, 654, 662, 664, 670, 672, 674, 679, 685, 686, 688, 693,696, 700, 708, 710, 711, 720, 730: n = A,T,C or G
nccnttcgctgggatggctgactgctgtggccgggctgggcagtgtgccccaacagctcagtgctttcctgacactccagtgtctggggtggttgaggagccgagttctctcttcctcccagaccaagttcctccctcgggtttgccttgagacgtgttgcgtttttgggccccgtggcctctccctgttaggctgccacaggccctgcttctggaaggtgaacagctcctggctgctgccgagagggttctcgttggggtcaccaaagtgtgcccggctgctatgaaaaacgttgggaatcttggtttcagttttttattctatgctaggttgtacagacttatttatatcatcgttttgagggactaatggaggcttattgtaacatataatattanntgaaaccatggaattatatgaaaatgatacatgagaaataangaaactnttttgctgattgnaaatttttgtgggaaattttgtgataaccttgagaattatacttgnttgaatcnaaggccacttcttctagaatttattggtcaaattctgncatatttaccttctaaatctnctctcaaaggggccnaaaagatacntatctttactgggaaaaaaaaaaaaaaaaacccccccccntttaaaacttttangggggccntntcccgnananccccncctgannanacccnttngtgngttggggncnncccccaccntaaaaaaccnccctcc

SEQ ID NO: 8270 - DNA, 835 bp, Homo sapiens
  misc_feature 2, 4, 5, 7, 13, 14, 17, 29, 37, 38, 40, 46, 53, 55, 90, 100,111, 112, 113, 119, 125, 126, 127, 131, 135, 138, 141, 158,173, 179, 183, 190, 192, 193, 194, 200, 203, 211, 212, 213,220, 226, 231, 245, 250, 252, 254, 268, 269, 273: n = A,T,C or G
  misc_feature 278, 298, 300, 305, 316, 325, 326, 327, 334, 336, 354, 358,374, 380, 386, 394, 399, 401, 409, 412, 416, 418, 426, 427,429, 434, 445, 446, 448, 449, 456, 457, 460, 464, 470, 478,480, 482, 483, 488, 491, 493, 497, 498, 502, 503, 512: n = A,T,C or G
  misc_feature 514, 518, 521, 524, 525, 534, 535, 536, 537, 547, 562, 564,567, 579, 580, 581, 584, 598, 600, 601, 609, 620, 630, 632,636, 640, 655, 657, 658, 661, 671, 672, 673, 679, 680, 681,690, 693, 701, 702, 705, 706, 711, 712, 713, 723, 727: n = A,T,C or G
  misc_feature 730, 731, 732, 733, 736, 739, 740, 744, 746, 747, 749, 750,752, 754, 759, 765, 777, 789, 791, 793, 811, 815, 818, 829,831, 834: n = A,T,C or G
tnanncntataanngtnccaggagataantagactanntncgcctncgaatgncntgccgctcggctcactgatattggagtactccganaagggggatntattttggcannnatgttncttttnnnctgntgtnttnaangcttcctatttttatancatatcgcgaacttngttcanaccnacttgcncnnnaacaanatnacagcccnnngctgtcngtgaantagcnggatatcacaccantgcanantnttggggtattggcnngacntgtgnctcgaatcctccagagtttnangcggngggaatcacangctctggtnnngggtgcntntggaaacattgtgttgcngaangcccacatgttatgcncaaacnaaaacntggcgccntttgngncatatgtncantganantaaattcnncnccccnatacctctatnngnntgtggtnntgnatgncctaanaccctatnantnnctcgntcntngtcnncaannggtccatcntnaatnagngannttctcctgnnnntttcatttgntaccccaagaacaananttncaaagtttattnnnaanaactcaacggaaantnnctttgttnctattaacaanaattaaaatncntggnaatnataatcaaacatagntnntantccctttttnnncgtcannnaataagctncgncatatacnngcnnaaatnnnagaataacantatnggnnnntanacnntacngnnanngngngtgcntgtacnttacatttctantaatggcagggntnanatgggttatctatatcangggnctntctcgaaaatnantcng

SEQ ID NO: 8271 - DNA, 773 bp, Homo sapiens
  misc_feature 1, 3, 5, 11, 12, 15, 16, 20, 25, 42, 45, 48, 73, 87, 110,113, 143, 152, 169, 191, 201, 211, 221, 243, 244, 252, 274,279, 289, 298, 312, 340, 343, 350, 359, 363, 371, 372, 381,385, 391, 392, 395, 398, 404, 413, 442, 445, 454, 482: n = A,T,C or G
  misc_feature 490, 498, 506, 511, 517, 522, 533, 534, 537, 543, 551, 560,562, 570, 581, 592, 596, 605, 608, 611, 614, 631, 635, 636,638, 641, 642, 644, 649, 650, 652, 655, 658, 664, 667, 676,679, 690, 691, 692, 697, 698, 701, 708, 717, 718, 730: n = A,T,C or G
  misc_feature 731, 740, 744, 745, 747, 752, 753, 756, 761, 771, 772: n = A,T,C or G
ntntnttccannccnncaanatatncctaaataacatgtctnacntgntcggtaagacttactgcaccctgtnctataagatagaanatgccctgcccttacaagacaanganactgtagagctatgccttctaaatcttaanccactcttnagataatggatcccttnatggccagcccaaacatctcangaacttttantttgcaccgntctgtttttntttccatttatttaataccacnnattcactntattattatgaagccaatatcnacatnttttcacaangattctctnaagaaatgcagaantggccgggtgcagtggctcattcctgtnatncccagcnctttgggangccnaagcgggnnggattaccntgtngtcggnnagntcnagaccncgcctgacnaacatggagaaacccctgtctctactaanaanacaaaatcngctacgcgtggtggcacatgccctgcancccagctnctacggangctgaggnagaanaatccnttgancctgggaagcnncangttgcngtgacccncaacatttncnccattgcncttccagcctnggggaacacgnagcnaaaattccngtntcnagnaaaaaaaaaaaaaaaanacanntntgnngnccttnnanaantcnctcagnggngtttctttnccnctaaatcccannncatgnnaanaataaanctttgggtnncgtcttgggacnnaaccccttntttnnanaattnnccnttccnctcctctctnna

SEQ ID NO: 8272 - DNA, 1067 bp, Homo sapiens
  misc_feature 4, 5, 17, 22, 25, 26, 32, 35, 47, 48, 49, 51, 52, 85, 86,90, 94, 96, 98, 104, 106, 115, 131, 138, 145, 153, 159,163, 166, 168, 170, 171, 180, 186, 190, 195, 196, 201, 204,209, 210, 212, 215, 220, 231, 233, 235, 239, 244, 261, 265: n = A,T,C or G
  misc_feature 272, 276, 278, 284, 293, 297, 303, 305, 308, 309, 311, 313,315, 316, 318, 319, 322, 323, 324, 325, 326, 328, 329, 331,337, 341, 349, 359, 362, 365, 368, 370, 374, 377, 378, 380,382, 384, 386, 389, 397, 398, 400, 401, 402, 404, 407: n = A,T,C or G
  misc_feature 408, 409, 411, 412, 413, 419, 423, 426, 427, 429, 431, 432,435, 436, 437, 441, 442, 444, 447, 449, 457, 458, 461, 462,463, 464, 466, 469, 473, 475, 478, 479, 481, 485, 486, 492,504, 505, 506, 507, 510, 516, 519, 520, 521, 527, 533: n = A,T,C or G
  misc_feature 539, 541, 546, 556, 557, 559, 564, 565, 566, 568, 571, 572,573, 575, 576, 581, 583, 585, 587, 588, 601, 602, 604, 625,627, 629, 631, 635, 636, 640, 646, 647, 654, 655, 656, 657,660, 661, 664, 665, 668, 674, 675, 677, 685, 686, 687: n = A,T,C or G
  misc_feature 688, 694, 696, 699, 701, 704, 708, 718, 720, 721, 727, 732,736, 737, 738, 744, 745, 747, 748, 749, 753, 754, 759, 761,762, 765, 768, 772, 773, 774, 777, 781, 785, 799, 802, 807,808, 809, 814, 818, 827, 828, 829, 833, 839, 840, 856: n = A,T,C or G
  misc_feature 857, 858, 864, 871, 874, 880, 881, 891, 901, 903, 905, 906,909, 915, 917, 922, 923, 925, 928, 929, 937, 946, 951, 955,957, 959, 960, 967, 972, 973, 976, 982, 983, 985, 988, 991,993, 997, 998, 1002, 1006, 1008, 1022, 1025, 1029: n = A,T,C or G
gaannggggggggatcngtcanccnntgctanttnctggtgaaaggnnnannaatgataaattgattaattttactagaagaacnncganactncncnctaatntntggactggnggtggggataggagtnttgacgnctcacancacaatgngaattnagantgngngnnagtatatanatttancatnatagnntggcntangggtnngnggnggggngtatgtttttntncntatngccanacttgtgcatcacatgnttanacatganagcncncgatantatatttanttcntgtcgngnctnncntnanntnnttnnnnntnnanaatgtnattntatcgatngtcatgatgntantcnttntngccncgnnanananangtntacgcggnncnnncngtnnncnnnaagccncgtnggnnancnntgnnncgannantgncnatatactnngtnnnntnacntaantnaanntnatgnnccgganatacgttgtttnnnnacnacgaantannnatgtgntagacnagtagntntgttntaagaaaggnntnacgannntnatnnncnngacangnancnnaagcagatttgtnnantggtgttcggcaaagtcacancnangncacnnaggngtttgnntgtgagnnnnatnnctnncgnagaggnnanatctatannnnatggancnctnangtnagancatatctatntnnctgttnaattncggnnngtgggnnannnatcnntgatntnntanccncgtnnnaangtgncgcngatgtatcgcgtgntgntatcnnnatacnaaanatttaatannnatgncgcggnnttatttgataacggannngcgacngtgtgtntgntttatnntaccgcactncgcgtcgcgncncnncgntatatnangagtnnanatnnttgatgtnagatgtctngggangatntncnngttacgnacgcnntcngtagcnngnacncgntnggcnnatancgancntcgatttctatcanttntggnnnncgatntagacanatatnnagtcgncgatatngngn

SEQ ID NO: 8273 - DNA, 978 bp, Homo sapiens
  misc_feature 8, 9, 15, 20, 27, 28, 35, 36, 41, 42, 50, 58, 59, 64, 67,71, 74, 77, 83, 88, 90, 93, 107, 112, 118, 125, 135, 147,148, 149, 151, 155, 156, 160, 161, 169, 173, 192, 195, 199,201, 206, 208, 213, 215, 226, 230, 231, 241, 247, 251: n = A,T,C or G
  misc_feature 252, 255, 258, 261, 264, 266, 273, 274, 276, 287, 290, 298,300, 306, 315, 320, 325, 333, 334, 338, 341, 344, 350, 351,352, 356, 357, 364, 366, 368, 378, 379, 387, 400, 408, 410,411, 426, 433, 434, 436, 439, 443, 448, 452, 461, 473: n = A,T,C or G
  misc_feature 476, 487, 488, 492, 496, 497, 498, 503, 504, 505, 512, 525,528, 530, 531, 538, 539, 542, 545, 553, 554, 555, 558, 560,562, 563, 579, 582, 590, 595, 599, 602, 605, 613, 618, 622,627, 633, 638, 646, 648, 651, 652, 658, 663, 665, 668: n = A,T,C or G
  misc_feature 676, 677, 679, 682, 690, 697, 703, 716, 719, 721, 723, 735,739, 745, 748, 750, 754, 755, 756, 759, 764, 771, 780, 781,793, 795, 798, 802, 805, 808, 814, 818, 819, 829, 833, 839,840, 846, 854, 860, 861, 864, 871, 878, 880, 883, 890: n = A,T,C or G
  misc_feature 894, 896, 906, 908, 909, 915, 918, 937, 945, 956, 958, 960,970, 975, 976: n = A,T,C or G
gatcgtgnnagattnctcanctctagnntcttaannctacnnaaatatgncattatcnncacanacntgcntcntgngatgcntgatngnttncccatcccttctgnatatnaaccancttgccnttccgagcancagtgccacatnnntntggnntgtnnacagtccnctcnccatttttcctgaaccganagntggnangactnanagtananaatgcaatatnttcnnaaccacttcnttaccnagannaanttnacncantntaaaccnnantattcttaaanaantttactcncnaaaacncctattatntaaantgccntttgaatnnaagnttnttntcattnnnggtnnatccggncngnagcctaatanngtgtacgntactttggccgcnttggatgngnngaactcttcattaanctgtggnnanggntcantaatnccgntcgggtatntcctttatgaancangaatcatatcnnaggnttannnctttnnngtctatncccctttctaggntancnnctaaaannacntgnggccttgnnntcntntnncaaaataatctcacantgnatgagcantgtangaanacntcncttgtggntaganaatnatctnatatantccanaccctctntnggnnaaaagnggcgnanacnttccccgnnantcngatagtangtccccngcctcntagtgacttttcntgnananaaatagaacatnacancatttnttncngcannnttncctcncaatggnatccccctnngggtcctttagntnatntcanacnatntaaggntgannttcctctctnaaanaatctnnctacangggtcacncaaaannggnatataangctcttntnctnttccctnggtngngagagtcttntnnatcttnganggatcccacaaccatagtntatattanttgggacgcgngngngcgggccctnttgtnngt

SEQ ID NO: 8274 - DNA, 739 bp, Homo sapiens
  misc_feature 5, 8, 526, 551, 632, 675, 680, 689, 700, 706, 713, 715, 723,725, 726, 732, 737, 738, 739: n = A,T,C or G
cgggnggngcgaattctcacccttttagttctccaaaatttaagatacttgatttcttaggtaaaatgtttttgtttttgttttggagacagagtctcgctctgtcgcccaggctggagtgcagtggcgcgatcttggctcactgcaaactccgcctcccagattcaagcaattctgcctgagcctcccaagtagctgcgactagaaagcgcatgccaccacgcctggctaattttttgtattttagtagagatgggggtttcaccgtgttgcccaggctggtctcaaactcctgagcttaggcaatcctcctggggcagcctcccaaagtgctaggattacaggcgagccatggcgcctggccagtaaaatgttttctatctagaatgaatcaaggtattttccttgctcagtagcttctagaataagaaaaaaatagcagcaagatctgattcagaaatagttgggagcagaaagttaatatgaaggagttgctacttgttaacagcctagagttgagatctanaagaattattacctttttaaattgntgatgaaagcttaaatccacatttgggaagttactctattggctgaactattttggagttttggtaagctttggattaaanattcctgatttaactgaaacttaattttgccacatagcttttnaattncattcccangttttacttgnttttanctggccntnaaaaactnannaatttngaacnnn

SEQ ID NO: 8275 - DNA, 773 bp, Homo sapiens
  misc_feature 1, 5, 6, 13, 36, 47, 56, 111, 112, 167, 170, 171, 193, 212,214, 226, 244, 269, 273, 293, 296, 297, 304, 337, 399, 456,498, 515, 519, 523, 538, 544, 549, 554, 557, 561, 567, 571,577, 583, 618, 628, 629, 630, 633, 637, 639, 676, 678: n = A,T,C or G
  misc_feature 679, 682, 683, 688, 695, 696, 701, 712, 723, 725, 730, 731,739, 745, 749, 771, 772: n = A,T,C or G
ncccnnttgcggngaaatactagcgctcctctactntctctaacggnaaagcagcnggaatacaagagactgaactgtatctgcctctatttccaaaagactcacgttcanntttcgctcacacaaagcccgggaaaattttattagtcctttttttaaaaaaagtnaanntaaaattatagcaaaaaaaaanggaacctgaactttagtancncagctggaacantccgcagcggcggcggcngccggcgggagaagaggtttaattnagtngattttctgtggttgttggntgnncgctagnctcacggtgatggaagctgcacattttttctangggaccgagaagctgctggaggtttggttctcccggcagcagcccgacgcaaaccaaggatntggggatcttcgccctatcccaagatctgagtgggacatacttttgaaggatgggcnctgttcaatcataagtgtgacaaaaactgacaaagcaggaancttatgtactcagtgangagncccntgttttgtctccaanagacgntttcnttttnaanactngtggtncccncccttntttggntgaaagcattgtttccccctgtttgaaagctttgnttaagggatnnnagngggntntgcactcaattttcaactttctttttctttccttggnannaannttccnttgaaannccttntttcaccaaanggggtccccancncccgnnatttttcnggaaanaaantaaaagctttcttttaatgccnna

SEQ ID NO: 8276 - DNA, 744 bp, Homo sapiens
  misc_feature 2, 394, 491, 496, 506, 532, 551, 568, 589, 611, 618, 630,633, 642, 645, 673, 677, 694, 697, 706, 714, 715, 720, 721,731, 744: n = A,T,C or G
cntttttttattcgcacgaagaacgaccccgaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttganaactgtgtacttctggtgactgtacagtttgaaatactattttttatcaagttttataaaaatgcagaattttgctttacttttttttttttaaaanctttntttgttaccncacaaaacacttcattgttgtttttnggggaaggggcatatgtcnctaatagaatgtttccnaagcctgggattgatttgganaaaacacctttcccttctagtnttgaaanacttccttttgngtncccaaggangangggaatcccttgacttttgacacacatnggcncccttttgccacaaaanccnttggggttnaaaaaaannaaatnnggtttttatntcccctttttccn

SEQ ID NO: 8277 - DNA, 741 bp, Homo sapiens
  misc_feature 3, 5, 6, 7, 9, 11, 15, 21, 393, 514, 515, 608, 644, 659,662, 689, 694, 716, 733, 739, 741: n = A,T,C or G
ccncnnntngntganaccaanaggtacagatgaaagtttttagttgacccatgaggcgaccagaatttcatggatgctctacagggctttcttgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcnaaattctcacactattatgcaaattcagtgcaaaggcggcttgaaaggtgcctgcagttcaacagccacacactacatcagtggctcaaagacaagaacaaagggagaaatatatgatgcnnccattgacctgtttacaccgttcatgtgctggatactgtgtagctaccttcattttggcgaattggagatcgtcacaatagtaacatcatggngaaagacgatggacaactgtttcatatagattttgnacactttttggatcncangaagaaaaaaatttggtataaaacganaaacntgtgccattttgttttgacacncgaattccttaataacngattantn

SEQ ID NO: 8278 - DNA, 770 bp, Homo sapiens
  misc_feature 1, 5, 6, 8, 24, 25, 43, 61, 63, 80, 83, 126, 139, 188, 190,191, 214, 221, 224, 240, 259, 279, 285, 301, 318, 325, 329,336, 383, 385, 395, 404, 417, 422, 423, 442, 455, 458, 462,467, 468, 477, 494, 495, 510, 513, 515, 519, 524, 527: n = A,T,C or G
  misc_feature 529, 534, 535, 536, 542, 561, 567, 568, 575, 581, 582, 600,602, 606, 608, 612, 613, 617, 620, 624, 626, 630, 635, 637,646, 649, 654, 659, 671, 675, 678, 688, 693, 702, 714, 717,725, 727, 737, 743, 744, 751, 758, 761, 766: n = A,T,C or G
nctcnntnttatctcccaagccannccttggatgaaaacatgnacctcttggaaggtatancnggctttgaagactctgnccnacagtttatctgccatgttgtgggtatcacttaccagcacatngaccgctggctgntggccgagatgctcggggatctgccgggtaacgccctctgggtcctggngnnatctgggaggttgggggtggctngggcagnggncctcagtcagctcctncaacaggcctgtctgggtnttatcaggtcagcatggaangcccancccaaggaggaaatangaacttggctaagacantctctgncttngaggganatcctatgccatttgctcattttatttttgcattaattgagtgcctncncgtgtgtcantgtgctaanctgggcgttccancattnnacaaagtgggatggctccnattcattctcatngangtancaacnncacatggcnacaatgggaggtgtccnntcggtgaattccctntcntnaatngaaanccnangacannnttacanaccaagtggccatctgaancccttnncctcccnttacannagaggcccgttggccctncntgtntntgcnnaaangangatncnccanttacngncccctgacnttntaacntttcntgggctaacccnaggntgnactgcgcccnatcanagctaaatntcgcgccaaaantcnaaaacttngngggtttgcanggggcnnttctaangtcatgntgnggccnttcc

SEQ ID NO: 8279 - DNA, 711 bp, Homo sapiens
  misc_feature 7, 49, 63, 74, 83, 94, 101, 104, 116, 124, 126, 130, 133,135, 148, 152, 154, 156, 166, 172, 175, 179, 183, 187, 192,200, 202, 207, 219, 223, 225, 232, 236, 247, 250, 252, 263,267, 275, 276, 282, 288, 291, 292, 295, 302, 307, 314: n = A,T,C or G
  misc_feature 316, 319, 324, 326, 331, 339, 347, 365, 370, 378, 381, 382,386, 404, 406, 410, 412, 415, 430, 433, 439, 443, 460, 462,475, 492, 497, 498, 502, 506, 509, 512, 520, 526, 539, 579,580, 582, 584, 591, 599, 608, 613, 620, 632, 634, 649: n = A,T,C or G
  misc_feature 660, 671, 685, 686, 688, 692, 695, 710, 711: n = A,T,C or G
cctcctntccattcggcacgaggaattttttttttttttttttttaaanaaaataaaactttntttttaataanaaaattaangtttttagtanggaaaanccngtttgtctttcntttaccantncaancantnttttttccaaaanaatncntngggttttatngggccnttngtcngaanccanccccnggggaatntntaaangatcccctgctntgancnccaagtngaangtaagtttttnttntncttgggggaancaangggttcanntgtttnttgcanggnncanttgccanggganagttaancncanttccngnacccntcctgaanaaaaaatnctgccaaaaacaaaaatnccccngggtaaanacnncccntgaataaaaaaaaatcgncntaangngtntcaaatttttatttnttngggcancaanggactttgatcctttgncnggcttggaaactnctgccagcccaactcantacanngcanctanaantgnttccaatntggccngggaaaatcaaantacccgggggcccaaatgtttgaagttttttgaccacaannananaggaaanacaaaaanaggaaaatnccctncccttgntttaaaaacatntncttttttgccaaagngctttaagggnggaccgggaanaaaaaccttttttnncnccanacnaaagggttcaacccnn

SEQ ID NO: 8280 - DNA, 749 bp, Homo sapiens
  misc_feature 5, 7, 9, 13, 15, 29, 87, 147, 464, 468, 491, 546, 591, 595,615, 630, 671, 685, 686, 688, 689, 695, 718, 728, 733, 738,749: n = A,T,C or G
gcccntngncccngncccacagaataccnctggttggagcctgcacatcctccagcctgatcaaaaattattctgcatagttcccantgtgctttctgggagctatgtacttcttcaatttggaaacttttctctctcatttatagngaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaancacntgtttgctgtgcttgcaccccangtaaacctgcattgtagcaatttgtaaggatattcagatggagcactgcccttanacattctcttggggggattctctgcttggctttcttggaactttntggnaaggataaattctggataanggcacttcaagaaancgtaacaacccccagtgcttttcttccaaatcattatgganaaatactattgccnntnncaaggnagaatgccaaacccccccacggnaaaaattttngaagnttccngcccaaatttn

SEQ ID NO: 8281 - DNA, 741 bp, Homo sapiens
  misc_feature 2, 3, 6, 19, 113, 383, 431, 464, 473, 493, 522, 541, 562,581, 582, 591, 598, 628, 630, 631, 633, 637, 646, 652, 653,657, 658, 663, 665, 666, 667, 668, 674, 676, 683, 688, 691,695, 698, 704, 711, 715, 718, 722, 729, 731, 732, 733: n = A,T,C or G
  misc_feature 736, 738: n = A,T,C or G
cnnccncgctgacttggcnttttcttctatttgctgggtagaaaagtccttaaagtggatgctcatgttcagtggcctgggcatatattgtttcactggtatcaataatattntaggatataattttctagcagctaggttttacatgtatatacactatggttcagatataaattacccatctctctatattagcccagttagctagtacatggataagtcattagataatttgctacccatgtatttgtcctattaagatgtagttataataaaattaccaagttatctgtagtttgctattatgggtaatatttcctcatgtaaactgtataaactcacttatatacatatatacacatgtacacatatgcatacataancacacacaaaggtaataaaagtgattctatatgtagctagtaacaagntaatttcagaatatttattttgtttttctctantggacaggngggaaaatatgggaaaggangtcttcagggctgcttctgacctgactangacatgattaaaacacttnggggagcctttagaaataaangggctgtgatggtcagaannttatatacnttttttnaccctatgatgaattttttttttttttttnannanaaanttccccctnttattnntttnngctgnannnncgaaangnccccttnttggnttnattnganacctgngcctttntggntcnaacnaattctncnnnctnancca

SEQ ID NO: 8282 - DNA, 795 bp, Homo sapiens
  misc_feature 3, 4, 5, 9, 119, 140, 201, 203, 230, 269, 276, 336, 378,394, 421, 432, 434, 474, 477, 483, 494, 495, 504, 505, 524,533, 544, 552, 572, 578, 588, 592, 601, 607, 610, 612, 623,628, 631, 635, 644, 654, 659, 674, 696, 727, 735, 739: n = A,T,C or G
  misc_feature 749, 751, 755, 768, 776, 777, 778, 789: n = A,T,C or G
ccnnnatcnaatcggccgaccaacaaaagtcgtgagtgatcactgaaagctctgctgtgaaggtgacatttgataactggggaagactgttcaggtaatgggggcacatgtgtgtgcanaggcctgaagaaggtgctggngtggcaagaatagccaagagactcatcactggacccgatggggagaggagtaaaagaaaangnccaagaattggaagagatggcgggcangtcatgtagggccttacaaagaatttgactttggctganagggganccgttagaaggttgtgaacagaggagcaatgtgatctgacttctcttttagcttttagtnccctgtacctgccttgtggagaacagccagagacaaggctanaagcagggactccagntagatggtggcatggccttagggcagngaggtttggtngnagttgtaatgtcttcaatgtcaagaaacttgaatttgacntgntccaanagcattgaganntcatggaannatgagggttggggttgcgnaaatttacntaatcagcaancaccccgnctcttgttcccctgttggcnataccnactcgttgtntccnattgtgttnaaattnttncnctaatgctctnccaanaanttangccccttanagaataattnatttnttaaggaataatttngccttgaaaagggccccattanaaacccccatctttttccccaaccccttttnaagttttnattnaaaaaaaacncnatanccttcgccccaantggacttnnngggccttatantccccc

SEQ ID NO: 8283 - DNA, 750 bp, Homo sapiens
  misc_feature 1, 4, 9, 10, 16, 20, 40, 150, 289, 303, 307, 337, 355, 366,369, 457, 530, 532, 536, 537, 547, 579, 586, 621, 622, 625,634, 637, 651, 653, 658, 660, 661, 664, 667, 671, 678, 684,687, 688, 699, 708, 710, 713, 719, 727, 728, 729, 737: n = A,T,C or G
  misc_feature 743, 750: n = A,T,C or G
ngcncattnnttctgnacgnaggcccgttctccctttctnggtaaacggatgaagaaataaaaatgccattttcatttgtaaacttgtatttttgtatttatatttaggagtataaaatgtacttatatttaggactacaaaaatgtacntgggaaggtgacgggacctctatactcaggttaagtctcgactgcacactgacaggagtatgtagaccattccatttccctgaagactcagccttgttagtatcaggactggtcggcagatgtgcaggaaaaggtggcnagaaagtgcaagtnctanaagcagatgatatttccagatccacagcancccgaaatactacaaaangaaaatatatnacntagcctcttcagatcatcgggcagggcctttaatcctctgtccattacaaataaaaaaactttattactgattcatcataatgaacantattaaatttttaaaatcacataaagctgtgtcaattttaaaacccaactggccgtctttccaaggacataancnagcnncttaaaaaanaaccacattgatgaccacccaaccttctttgntgctccncttcggggggattcctacctttctgaactttggannacntcccgacangantctgaccccctttngnaaggngnnttnacntgancttgatngggccnacnngggaaattgtnggaagggtncncantaagtnggaacccnnntggtttcnccgganaattccn

SEQ ID NO: 8284 - DNA, 930 bp, Homo sapiens
  misc_feature 23, 30, 38, 41, 46, 50, 51, 53, 72, 77, 78, 79, 81, 83, 89,90, 91, 95, 100, 125, 131, 134, 140, 165, 169, 179, 182,185, 188, 195, 209, 210, 217, 220, 223, 233, 236, 244, 255,260, 262, 265, 268, 269, 281, 285, 290, 291, 300, 302: n = A,T,C or G
  misc_feature 303, 304, 306, 308, 309, 316, 325, 328, 331, 332, 336, 345,347, 349, 361, 362, 371, 372, 373, 374, 378, 381, 384, 386,390, 394, 395, 397, 400, 410, 413, 414, 415, 423, 427, 430,432, 438, 442, 445, 447, 448, 449, 455, 461, 474, 476: n = A,T,C or G
  misc_feature 477, 491, 498, 502, 503, 515, 517, 522, 523, 531, 536, 537,538, 541, 548, 551, 557, 558, 559, 577, 580, 584, 585, 589,590, 597, 598, 600, 604, 607, 612, 615, 620, 622, 626, 629,631, 639, 641, 646, 647, 648, 651, 660, 664, 665, 678: n = A,T,C or G
  misc_feature 679, 687, 688, 692, 697, 700, 714, 715, 718, 722, 726, 728,730, 731, 732, 735, 742, 750, 753, 770, 779, 781, 783, 791,792, 793, 794, 796, 801, 809, 811, 812, 816, 821, 822, 829,830, 841, 843, 852, 856, 857, 871, 876, 877, 878, 882: n = A,T,C or G
  misc_feature 887, 890, 894, 901, 902, 905, 912, 913, 920, 924, 927, 930: n = A,T,C or G
ttgaataccccgatggtaatttncaaccgnccccgtgnttntcgtnttcnncntggatcccctggtgcccanattannngntncttcannngtanagaangtaaaattcacaatctccttttttnatgggnggngacttntttctaatttgccacttattaatcntggncaaaatgatntgnccnagnttcatcnctatctgaatttgnncattacnccngcnatttctaatngcngggaatantcttactgctnaactnanccnttnncatttggaaatntttnggccnnatcaattangnnngncnnctttaanggcgggttnttngannctgnttttcgccntncntgctggtcctgnnctccccttnnnntcgnaanatngngctngtgnncnttngtttaaatantgnnnatcgcccntggnaantngtcctnttgnggnannnctccantggtangtcctgttttaantnnaatggcgcaaacantcgattngctnnctcatttcacgntncctcnntttttgtncttannnccnaatttanacncaaccnnnatttaacttagcaattcncgnaccnntttnnggtaaanntnttcnggntctcntcnaacanangganaantntttttacncncaatnnnccncggggcctnacanncacataaaattgnnttttcccnncctntaaanttncccctaattaatannggnattntcangngnnnttnctccttncaactcanatnccttggtcacctcctantataaaagncncntttcagtnnnntntattntccaaacnanntttnaaacnnaaaaatnntgggaccaggnanttctcaccntaannagcctacccccccntattnnnaaangaaantgnctcntttaagnntanccaaacnntaatccncccncgncan

SEQ ID NO: 8285 - DNA, 745 bp, Homo sapiens
  misc_feature 1, 5, 8, 11, 14, 18, 27, 35, 251, 280, 417, 457, 469, 499,515, 538, 556, 561, 565, 570, 624, 646, 653, 684, 696, 699,706, 711, 715, 719, 723, 724, 727, 729, 730, 738, 740: n = A,T,C or G
ncccntcnaancgncganactgattcnttcctttntttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagntcttggagaagaaagagcatttctttaantacctggggaatacagctctcagtgatcagcagggagtttatttgaggacatcagtcacctttggggttgccatgtacaatgagatttataatcatgatactcttcggtggtagtttcaaaagacactactaatacncatgaagccgttccagctatttaatgctggcaactactgnttaatggtcagntaaatctgtgataatggttggaaagtgggngggggtatgaaattgnagatgtttttagaaaaacttggngaatgaaaaatgaattcnaatgnttcnatggnaagaatggtgaacccattgctatcattccattcctggtctcatggcaaaaaaanttttggaacattaaaaaatcanaattaancccaaatggtttccttttttttaaaaaaaanaaaaaaaaaaanccnccccccntttanaacntttngggnngcntnnttcccacnancccca

SEQ ID NO: 8286 - DNA, 765 bp, Homo sapiens
  misc_feature 6, 7, 8, 9, 10, 12, 13, 14, 15, 79, 125, 350, 374, 459, 500,509, 515, 550, 555, 567, 584, 591, 592, 595, 621, 631, 632,636, 638, 644, 648, 650, 657, 686, 698, 699, 703, 712, 713,715, 723, 730, 734, 736, 739, 758, 761, 764, 765: n = A,T,C or G
actccnnnnnannnnccgaggtttggggagagtgatggtagaaggactcccaggagggccctggagacagtgtgaaatncgagggaggtgaagatgcttctgtggctgcggagtggtccgggganggcagtgggaccctgcagaggagtggctctcttggcaagatccgggatgtgctccgcagaagcagtgaactcttggtgaggaagctccaggggactgagcctcggccctccagcagcaacatgaagcgagcagccttcttgaactatctgaaccaacctagtgcagcacccctccaggtctcccggggcctcagtgccagcaccatggacctctcttcaaagcanctgacatttcaacccggcccccangtctgctgggtccccccaccccccacagtccctcacaagcattccccattgctctctggctcttccccacccctaggtgggacantgaaggggagcagtttaaccagaagattgctgtgcccttanggtcttaanctcccntcctccaggaatccctctttaagaagggacccttnagganaccttctctgcnaccttgtggtacttttnagagtannctngcctctgaggccccaacggtggggtncaaaagccanngtantngccccntaananaatccancctgctggccggcttttcaagccaaaaangttttggggggnnttgncaaaacaanntngcctttgnccttggncggntnttnactcccttccttttggtgnttnaann

SEQ ID NO: 8287 - DNA, 754 bp, Homo sapiens
  misc_feature 6, 17, 25, 44, 48, 511, 568, 586, 608, 619, 627, 635, 646,658, 661, 694, 709, 716, 718, 727, 734, 737, 742, 746, 754: n = A,T,C or G
ccccgnttcaatccgcncgaggggntcccaacttgccttgcagntgtnccctgagacctcaaaccagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcngtaaaaaaaaaagttcttctgggcccgggcgtggtggctcacaccctgttatcccangcaccttgggaggctgangtgggaagatcatttgagggcnggaagtttganacccttgncttgggcnacattaaatgnaactttcttttncangggagaaaaaaaaaaaaaaaagccttttgaaanccatttttttttttnttaaaangncaaaaaaanaaaattnccnttttngggnaaaaaaan

SEQ ID NO: 8288 - DNA, 782 bp, Homo sapiens
  misc_feature 4, 8, 22, 27, 30, 46, 55, 74, 75, 86, 101, 172, 466, 502,517, 535, 549, 586, 616, 640, 649, 650, 655, 662, 682, 684,689, 712, 732, 735, 744, 745, 749, 752, 756, 780, 782: n = A,T,C or G
cccntttnattcgcccgaggangcaanagnaacctcttccagcccnctgttcctnagaaggtgccaggtttccnncatcacacacntacgcagcgcctccntccactcggaaggactatcctgctgccaagagggtcaagttggacagtgtcagagtcctgagacagatcancaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgttcaagcagaggagcaaaagctcattttctgaagaggacttgtttgcggaaacgacgagaacagttgaaacacaaacttgaacagctncggaactcttgtgcgtaaggaaaagttaggaaaacnattccttcttaacanaaatgttccttgagccantcaccttatgaacnttgttttcaaaatgccttgattcaaaatgcaaccctnacaaccctttgggtggagttcttgaagaantggaaagaatttaacccctcaatngtaaaactnnccttnaaaattnggaccttttgggccataaanangaacnttttttattggccttacccatcntttttttttttttttttaancanattttggcnntttnaanaaanttgggtttttaaaaaaatttttanan

SEQ ID NO: 8289 - DNA, 1413 bp, Homo sapiens
  misc_feature 3, 11, 17, 18, 19, 20, 21, 29, 31, 32, 33, 34, 36, 74, 79,84, 85, 86, 87, 104, 112, 115, 133, 136, 138, 139, 142,149, 155, 156, 157, 162, 164, 168, 170, 179, 183, 186, 189,190, 191, 203, 204, 206, 217, 225, 226, 230, 236, 244, 246: n = A,T,C or G
  misc_feature 254, 255, 257, 266, 268, 274, 276, 279, 280, 283, 286, 295,296, 299, 304, 308, 311, 312, 313, 314, 316, 318, 323, 329,330, 333, 335, 344, 353, 357, 363, 364, 374, 377, 379, 385,393, 395, 396, 399, 401, 407, 412, 417, 418, 423, 429: n = A,T,C or G
  misc_feature 430, 432, 436, 437, 441, 453, 456, 467, 471, 474, 476, 477,483, 487, 488, 492, 494, 495, 496, 503, 504, 505, 506, 507,514, 520, 525, 528, 536, 537, 538, 541, 545, 548, 549, 552,559, 561, 563, 567, 572, 573, 576, 581, 585, 586, 587: n = A,T,C or G
  misc_feature 590, 594, 595, 598, 600, 602, 604, 606, 609, 610, 615, 619,624, 625, 628, 630, 636, 639, 642, 646, 647, 648, 649, 651,652, 653, 654, 656, 658, 661, 663, 666, 676, 683, 696, 698,700, 702, 704, 706, 716, 717, 720, 721, 725, 729, 734: n = A,T,C or G
  misc_feature 737, 738, 748, 756, 759, 760, 765, 770, 771, 777, 779, 783,788, 796, 797, 800, 808, 812, 813, 814, 815, 824, 827, 828,829, 841, 846, 847, 848, 855, 858, 859, 870, 871, 874, 875,883, 890, 891, 892, 895, 896, 906, 907, 924, 932, 934: n = A,T,C or G
  misc_feature 936, 941, 952, 956, 957, 969, 970, 971, 975, 984, 986, 998,999, 1003, 1017, 1018, 1020, 1029, 1034, 1035, 1037, 1039,1041, 1052, 1056, 1058, 1062, 1066, 1067, 1080, 1082, 1085,1088, 1089, 1091, 1093, 1094, 1098, 1099, 1101, 1109: n = A,T,C or G
aanggaggggnaaaggnnnnncggggggncnnnnanaaaaaaaaagggggaagaaaaaaaaaaaaaaaagcccngaaanagttnnnncaaaaaaccccaagggnaaaaaaanatngtttaaatcgaggggggnccngnncanccgggcnccactnnncaaangnggananaaacccccngggnggnaannngggggggggggnntnttttaaaaagnaaaaaagnngganaacacncacacggntncacgggtnngngcgagggcngncacggngnggnnaanacngaagagaannaanccccngagngcnnnngngncgccncagacnncgncnacacattancgaaaaggncggnaacaanntccagggcanaangnccggangcgactanannacngnaagggnggtcntcaannggggnaggccnncnaagnngacntcgcaaccacangantccaacggaanaacncgntnngggganggcnnaaangnnncccggannnnnggccccncggggnggaangancgaccccnnncanaggnggnnacnaacgacngntnaacnagggnncgntaganacannncgncaannggngncncncnganncgggncagnaatannccncngggacncgnggnacannnntnnnncnanggngncancgccaacaanaacccgnaatcgccaagccncnangnangnaggaaggtcnncanncgancagnaaaangcnngaagtacgancccgccgnccnngaaanacggnncagaantncggnccagncccagggnnatnggcaacanagcnnnnacactcgtnccnnnaccaggggacanatagnnncagatanacnncaccggagagnnacnncgcggcangccggannnacnnacgtgagaannacgccacatcaacgagngacgacgngncnacganagtcgacacgncacnnggaagcatccgnnnggcngcgcgaaananaccgtcagaganntgcnagagccgatatacnngncgaacgacnatacnncngngnagacatcgcgnaagncncganacgnnagggaagaaaaananagnccnncnanncccnngncaccacgnccccnaacacnncacgngatggggananaaaagangnntanncgnacaaggtnagggatgtgatgacnacgngcgccgnnccaancancannggagncgaaatacgacanggagccagacgngagccacccancgcacgnaaangcacggngccccgngccatnccagcgagnanagnnanctcgnncggtanacgggcggccnnagaggcggccanaccannacnnnnacncaccgagngacgagananancaaaatccacgnacgcgngcnntcanaagangacnncnnccnngnnaaangn

SEQ ID NO: 8290 - DNA, 745 bp, Homo sapiens
  misc_feature 3, 4, 5, 6, 7, 66, 389, 479, 537, 547, 555, 564, 610, 659,660, 670, 671, 688, 717, 724, 725, 745: n = A,T,C or G
atnnnnnaaaccaggggctcatgtaactgtgattaagctgtttgttggcggaattaaagaagattntgaggaacatcaccttagagattactttgaggaatatggaaaaattgataccattgagataattactgataggcagcccggctatcagcccggatgacagtgacgaggagaactgagggcacgtggggtgcggcagcgggctagggcccagggcagcttgcccgtgctgccgtgcagttcttgctcctcacggggcgtcacccccagcccagctccgttgtacataaatgccttgtggcagagctcccggtgaacttctggatcccgtttctgatgcaaattcttgtcttgtctcacttgtgctgttagaactcactggccantggtgttctactcctaccccacccaccccctgcctgtcccaaattgaaagatccttccttgcctgtggctttgatgccgggcgggtaaanggtatttttaactttaagggtaagtcctgctgtgagtggttacagctgatcctcgggnaagaacaaanctaaagcnggcttttgnctggtattttaattttttgaagttaaataaaagttactaattttgnaaaaaaaaaaaaaaaaaaacctcgagccctttaaaactatagtgagtcnnattaccgtanncccagacatgaaaaaanacattgatgaatttggacaaaccccactngaatgcnntgaaaaaaatgccttttttn

SEQ ID NO: 8291 - DNA, 766 bp, Homo sapiens
  misc_feature 3, 4, 5, 6, 7, 8, 36, 528, 565, 599, 627, 640, 660, 661,662, 663, 664, 665, 666, 667, 668, 670, 671, 672, 673, 674,676, 677, 678, 679, 681, 682, 683, 684, 685, 686, 687, 688,689, 690, 691, 693, 694, 695, 696, 697, 699, 700, 702: n = A,T,C or G
  misc_feature 706, 708, 709, 710, 711, 713, 714, 715, 716, 718, 719, 720,721, 722, 729, 730, 745, 746, 766: n = A,T,C or G
agnnnnnncgaggaaggatctccttggttaccaaanggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgcctgtggtcttganatttttattttttgcatatgtaatccattctgtacangtaactaactttgtaaacgcttgtgtattccctnttgcccccatggcttgctggtgtaaaanaaactggcatctncccgtttggtaaaaaaaaannnnnnnnncnnnnncnnnncnnnnnnnnnnncnnnnncnncncccncnnnntnnnncnnnnnccctccnnccctttaaaacaatnngggggccttttaacccaaan

SEQ ID NO: 8292 - DNA, 918 bp, Homo sapiens
  misc_feature 3, 4, 5, 6, 7, 9, 14, 15, 17, 18, 20, 21, 23, 24, 25, 26,27, 29, 30, 31, 32, 33, 34, 35, 36, 38, 41, 43, 44, 45,46, 47, 48, 49, 51, 52, 54, 55, 56, 57, 58, 59, 60, 62,63, 64, 65, 66, 67, 68, 69, 70, 71, 72, 74, 75, 76, 79,80, 81: n = A,T,C or G
  misc_feature 82, 83, 85, 87, 89, 91, 92, 94, 98, 99, 100, 101, 103, 105,106, 107, 108, 109, 110, 111, 112, 114, 116, 117, 118, 119,120, 121, 125, 127, 129, 132, 135, 151, 155, 159, 201, 203,262, 292, 306, 318, 320, 425, 426, 427, 428, 430, 433: n = A,T,C or G
  misc_feature 465, 466, 474, 486, 487, 488, 489, 516, 545, 549, 556, 570,571, 582, 633, 637, 646, 652, 675, 683, 690, 691, 697, 702,747, 752, 756, 760, 768, 772, 775, 776, 777, 782, 783, 785,795, 801, 815, 817, 820, 846, 850, 856, 858, 859, 864: n = A,T,C or G
  misc_feature 870, 884, 901, 905, 911, 917, 918: n = A,T,C or G
atnnnnntncaaanncnntnnannnnnannnnnnnntncanannnnnnnannannnnnnntnnnnnnnnnnntnnnttnnnnnancnananngnatcnnnnanannnnnnnntncnnnnnnccancncnggngcngccgttttgaaatccntatnccanctacttgggttctttttgcaggaacccatccgaatccgcctnanataaacagtactctctctcaggattctcttggaacattcaactcattagtgagtggtcntccccagtcatttccatttttctttatttnggctctgatagttnactgtttttgtntntcagagataatcctttactatactaaattctacgtgattatattttccacctctatttgcctatatttaatctgctgacttttccttttccatatatgggcttannnnantgnttccctcttcttccttttctacctttggtatnnaaaaagtnacttagggactnnnnccactggcttacgtgtgtaatcccacnactttggcaggctgaggcgggaggatgcntganccccggngttcaaggctgcanngagctaccgantggagcccctgccactccagcctgggcaacaagaatgagaccctggctggntttnggggggaanaagttnatttcacaacgtttttgaaaaanattctttngcccaanncatggntggcncacacctgttaatcccagccacttttggggaggcccgaaggccgnatggntcancttngaggccanaagnttnnnaccanncntgggccaaanaatggngaaaaacccccttntnttncttaaaaaaaacaaaaaattagcccnggcntagtgnannccaanccctgnaaaacccaaaatanctgggggaaacctccancctngggggncaaaann

SEQ ID NO: 8293 - DNA, 855 bp, Homo sapiens
  misc_feature 12, 34, 35, 36, 39, 40, 41, 45, 50, 51, 52, 239, 543, 554,555, 567, 574, 637, 638, 649, 672, 696, 711, 716, 721, 764,771, 782, 788, 790, 798, 816, 820, 827, 843: n = A,T,C or G
ctatcctttcanctcttgttctttttgcaggatnnnatnnnagcncagannnaaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcanatactaattaagtgccctaatcaaattgtgagacagatgtttcagcgtttgtgtatccatgtgattcagaggctgagacctgtgcatgctcatctctatttgcagccaggaatggaaagatgggtcagatgatatggatacctcagtagaagatattggtggtcgtcatgtgtcactcgctttgtgagaaccctgttattaattatggacatggtgtaaaacctcacagtaaacatcttacagagtattttgccttcctttacgaatttgcaaaaaatgggtgaagaaagagagccaatttttnctttcattgcnngctatatctacnatggtancatttttacattggggaaccaaaagggaccctgaaaatccttcaagtttggaagtggttatcnngaaggaagaangggggaaagaaagaaagaagggngggaaggaaagattatccttcttntctgggcaggaaagnaaaanaattncagggcccaccctgcccctttgaaaaaggaatggaatagcctntaagttngctcctttttnggggtngnaacaagtncttcggaatcaagaaaangggnggaaatngtttcccgaaattttnaaaaatgtcttt

SEQ ID NO: 8294 - DNA, 787 bp, Homo sapiens
  misc_feature 28, 31, 32, 33, 34, 35, 36, 37, 38, 40, 44, 48, 50, 76, 77,108, 110, 439, 564, 600, 654, 712, 725, 763, 780, 785, 787: n = A,T,C or G
tatcctttgaactcttgtctttttgcangannnnnnnnancgtnttcngnccgaggctttagctgttagaaagganntttcgtgacatgacacagacacacgtgaacncncagcccgccggtcctagcagccagctgtgaaagctgtgtcaagtcacgggggttcccgtgtgtctgtgtcatggatgcaatgcgggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgnattcctgtgctgcctccacctgagagttgctagggggttcttgtcgagatcatgtcatcagcacccctaagtcaagtcacgggtttccatagccaggcaagttggtatgtacaattcagttcaancgtatgaacttgtatctctaatctgatgtccatttntatattttttgaaactgagcccaatgaaatcctttcttgaatcattttcctttnggataataaaaatatgggggaaaatgctatgatgaaatttatgcaataaatgtatacntgtgtgcaccttncccccatcctggggaaaaaaaaaaaaaaaaaaacttgngcctttaaaacttttantgagncn

SEQ ID NO: 8295 - DNA, 1305 bp, Homo sapiens
  misc_feature 1, 2, 3, 4, 5, 6, 7, 8, 9, 10, 11, 12, 13, 16, 17, 18, 20,22, 23, 25, 26, 28, 29, 31, 35, 36, 39, 41, 44, 45, 49,50, 58, 59, 60, 61, 62, 63, 64, 65, 67, 70, 71, 72, 73,75, 77, 78, 80, 82, 83, 88, 89, 91, 92, 93, 94, 98, 100,101: n = A,T,C or G
  misc_feature 102, 103, 105, 107, 108, 109, 111, 113, 115, 116, 119, 123,124, 126, 129, 130, 138, 142, 143, 147, 148, 149, 150, 152,153, 158, 166, 173, 175, 177, 179, 180, 181, 184, 185, 186,189, 192, 195, 196, 197, 201, 203, 205, 209, 212, 214: n = A,T,C or G
  misc_feature 215, 217, 218, 221, 222, 227, 228, 229, 230, 232, 237, 247,249, 253, 265, 269, 272, 278, 285, 292, 295, 297, 300, 302,307, 308, 313, 330, 332, 335, 340, 342, 352, 363, 368, 375,377, 381, 382, 383, 384, 385, 387, 390, 394, 395, 403: n = A,T,C or G
  misc_feature 408, 411, 413, 420, 426, 431, 438, 440, 441, 443, 449, 450,453, 456, 458, 460, 471, 480, 483, 488, 492, 500, 505, 509,519, 523, 526, 527, 529, 536, 537, 541, 553, 566, 570, 573,578, 584, 594, 595, 596, 607, 611, 614, 620, 626, 636: n = A,T,C or G
  misc_feature 648, 652, 654, 657, 662, 664, 668, 671, 673, 674, 675, 676,680, 685, 693, 697, 703, 704, 708, 713, 714, 719, 722, 723,737, 752, 756, 769, 770, 783, 787, 790, 797, 799, 807, 818,823, 827, 837, 843, 844, 850, 856, 865, 868, 874, 880: n = A,T,C or G
  misc_feature 887, 890, 902, 905, 906, 907, 910, 911, 926, 929, 944, 945,950, 952, 958, 962, 964, 968, 973, 977, 985, 986, 989, 995,996, 1000, 1002, 1012, 1020, 1021, 1025, 1027, 1028, 1031,1049, 1058, 1061, 1070, 1073, 1074, 1076, 1082, 1087: n = A,T,C or G
nnnnnnnnnnnnnagnnncngnnannanncngcgnnganancannaacnngaaaacgnnnnnnnnangannnnananngncnnccganngnnnnaaangnnnngngnnngngnannggngacnnancanncggcgaangacnnacgnnnnannagagngggggagngggaggngngngnnncannncgnganacnnngcanangnacgnganannannaanncccannnncncagcngcgccccttntngggnaaaaaacccccncccnttnagggcnaaacccnggccccnccnanttnanggacnnggganaaccccccaaaccgggnangcncccgngnccccgggggnggccgggaganaaaanaccaccngngggnnnnngntcnaagnncaaaccantcaanctntnggcaagnaccccncccantaggggnannanggaggnngtnagngnanaccaataacanaaggggccntcnacccnaccntaagcccnggaanatantgccaatgcngtancannangggaatnncaancgaggggaacanaggagccgtggcnaganggnagggngtgccncgcagccgcnnnacctacggaanggangtnagcacngaaacncaaaaaaaancaacgggggctnaaangncanaggcncnaatngcnannnncccnccaancaacctcntganaatganncggnaccanntccantgnnagaggaaaagaggngacacataaagcccngcangagaatgaagagnngctcagggacagntggnggncgaaaananagggcggntagtctacagnagggntcangggaaaaggncacacnnaaaccnatgggnaaaaaaacngangcccgnaagggnggcccancancttaaacggggnacnnntgnnacacgggaaccggantgnaaccaacctactcannaaacnancgcaangccngngggnggggnggtnaaacaaannganctacgnntganangggccccagnggggccannaaanannganagggggcatcgatcaganataaaacgnccnggggggggntcnngncagacnaaaangggggaaaaaagtaacaacancccccanatataccctcatcaaaaanaaaaaannggnggccacaggaanacncccnccgccanaanaaaaggacnacanagtnntngcaaacacnaggggccncacnncggnggcncaaancggagccatggggngattatnaaaaaanaggggggnanacannacacaaaanaancccccnnggggggaccngcgg

SEQ ID NO: 8296 - DNA, 856 bp, Homo sapiens
  misc_feature 17, 19, 29, 34, 35, 36, 37, 38, 39, 40, 41, 42, 44, 50, 51,53, 109, 112, 579, 585, 588, 600, 607, 615, 618, 622, 630,641, 683, 693, 694, 696, 700, 737, 746, 751, 759, 760, 809,845, 847: n = A,T,C or G
ttatcctttcaactctngnctttttgcangatcnnnnnnnnncnggctgnncntgttaacaacatgttgcatctgtacgccagtatgctgtacgaacgccggatactcnttntttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgcttctgaaaatcgagccggaaggagccgatcactttctgtgaggaagcctttcgtgtccccactaccgctcccggaaccattgaagcangtttcntgncagaaacgcccncacaagnttgcaagnttnttcnaagccagnttaattggatnggtccgaattcagaatccttctcaaattttccgggcggaaanggttttcaanntngatngttttttggaaagaaagggaaaatctaaccattgggnccgaaatanccccntggcaagnngaccaaaactggtaccatccagtgggctttttcaactgtcccggaaaanggaaatcgggaaccaattttggaatactggtaaaananccaaaaccc

SEQ ID NO: 8297 - DNA, 781 bp, Homo sapiens
  misc_feature 1, 7, 8, 9, 10, 11, 33, 68, 71, 97, 220, 221, 242, 244, 287,310, 326, 328, 334, 339, 397, 400, 402, 408, 418, 448, 456,457, 458, 485, 493, 517, 528, 534, 543, 549, 579, 592, 596,606, 616, 620, 638, 639, 640, 647, 662, 665, 671: n = A,T,C or G
  misc_feature 676, 683, 700, 701, 704, 715, 716, 718, 719, 721, 739, 740,750, 751, 756, 758, 760, 765, 766, 769, 774, 779, 780, 781: n = A,T,C or G
ngagttnnnnncgaggagccatgcgagcagctngttcttttggagaaagaactgtaacagaactgatnttncattaccagaaccctcagcagttgtntgccaatctatgggccgctgtcagggctcgaggatgccagtttttagggccagctatgcaagaagaggccttgaagctggtgttactggcattagaagatggttctgccctctcaaggaaagnnctggtactttttgttgtgcananactagaaccaagatttcctcaggcatcaaaaacaagtattggncatgttgtgcaactactgtatcnagcttcttgttttaangntaccanaaganatgaagactcttccctaatgcagctgaaggaggaatttcggagttatgaagcattacncananaacatnatgcccaaanttgttcatattgcatggaagcaggactccngtattttnnncttgaacagaggtccctttcttttggntggtgatntggctccataaattacaacatgcngtctatcaatngattanggtttgtgnacattnagagatgcctgatgttctatcattgctgtncctttggaatatntttncaattttttnaaagagtttntacnccaaaccaggtgggagannncctattntttttaaatgccagnctnttatanaattnacccctnatttccctctttaattnnccncctgcaaaaannannanggatgccacctcggggtnncctaatttannatcanananaaaanntanctctnttccnnn

SEQ ID NO: 8298 - DNA, 850 bp, Homo sapiens
  misc_feature 1, 2, 5, 6, 7, 8, 9, 10, 24, 40, 44, 45, 47, 56, 59, 72,76, 91, 93, 99, 124, 125, 146, 147, 148, 150, 160, 161,167, 168, 169, 180, 182, 184, 194, 195, 196, 199, 205, 218,228, 243, 247, 266, 280, 281, 307, 329, 335, 337, 349, 351: n = A,T,C or G
  misc_feature 391, 392, 393, 399, 414, 429, 430, 431, 448, 451, 452, 456,457, 461, 469, 470, 476, 480, 482, 487, 493, 506, 507, 512,516, 517, 518, 529, 536, 542, 544, 556, 568, 570, 590, 593,599, 602, 607, 620, 621, 623, 629, 632, 641, 645, 648: n = A,T,C or G
  misc_feature 649, 654, 659, 663, 675, 681, 682, 692, 694, 706, 714, 715,724, 734, 737, 746, 747, 761, 763, 768, 774, 777, 794, 799,802, 812, 813, 818, 824, 833, 847, 849, 850: n = A,T,C or G
nnagnnnnnnggtgcctcccaatncccagcatgttttttnaacnngnttccactanaanaaagacggtttanttangccttttcaagtaanangtgctnggaatggttctatgaatatgcaggnnggtattcatttgtatcatctnnnantgatccttannacaatnnngagttccttananangattaaagannntanaaatgngtacatttcaccnttgggtgtgngtgcgtgtgtgttcntgtnagagggagagagggacatngctgtaaccaatcnncagatagcctattttatagccagcancttaagccaaataatttcagancactanangggaacttgaananatgaaatgactttgggagaaatacttttggattgcttggnnnaacctntttggaatgcctgantaatgggtgatcatnnnggtcaaagcacctgtgntannaatnngctnttgttgcnnttgaancccntnctcantgcagntgcaatattcttnnatatntcannnccttttatttnggcaaanaccacncngggaaacaaaantgtttgtttttncncactttaaacaactggtctnttnaaactnacnttctnttctctttttgcnnantttacntancaactgggntttnggnnttaanaatantcgncgccgcccctgngggccnnaactccggtncntcggtggggctntccggccnnggtagtaanaaaaaaaaanccntctttcgcnnccccttcggttgangncgctnttctcncgnccactcccctattatcncatcnccnctcccttctnntctgncctctngcgaacatnaccccccccccttngnn

SEQ ID NO: 8299 - DNA, 754 bp, Homo sapiens
  misc_feature 8, 9, 10, 19, 20, 21, 22, 23, 197, 391, 416, 469, 477, 492,505, 520, 523, 534, 549, 570, 572, 577, 579, 582, 588, 595,600, 603, 606, 610, 617, 635, 638, 643, 654, 655, 656, 663,684, 696, 699, 711, 712, 730, 731, 745, 746, 754: n = A,T,C or G
atcccatnnnattcgaatnnnnnacgaggagctctctctggaaagctcgcactggaatggagaacacaagcaggaaatgtgaaaagtaacggttgaaagccttacttatgatgacacatagggaggcaggtgcatatcttacaattctagacacttggataccttgggaaaccatattgaaagttaccttgatttcntttctttcttttttttttttgagatggagtctcgctctgtcacccaggctggagtgcagcagtgcgatctcggctcactgcaagctccgcctcccagcttcacgccattctcctgcctcacctcccgaagtagctgggactacaggcgcctgccaccatgcctggctaattggtttgtattttttttaataganacagggttttcaccgtgttggcccngatttggtctcgatctcctgaccttgtgatcagctacttgggacctgagacangagaaatnctttgaacccaagangcggaaagttcanggagccaagatcgcnccnctggactttancctgggcaacgagangaaaactcttcttgaaaaaananaaatncnacnaaaaanccctcgngcctntanaanttantgagttntattacctaaaccaaacntgntaaanaaacattggtnnngtttggnccaaccccaactttaatgccnggaaaaaatgcnttntttggaaaattnngatgcttttgcttttttnnaaccctttttaacnncaataaan

SEQ ID NO: 8300 - DNA, 1412 bp, Homo sapiens
  misc_feature 8, 9, 11, 14, 17, 18, 20, 21, 22, 32, 33, 34, 35, 37, 38,40, 42, 49, 53, 58, 59, 61, 62, 63, 74, 75, 84, 88, 90,91, 93, 98, 100, 102, 103, 106, 113, 114, 116, 122, 131,140, 141, 142, 144, 153, 157, 160, 167, 169, 170, 171, 172: n = A,T,C or G
  misc_feature 173, 175, 176, 184, 185, 200, 205, 206, 215, 217, 219, 239,250, 264, 267, 272, 274, 276, 312, 313, 314, 321, 323, 327,335, 337, 341, 343, 356, 362, 364, 365, 369, 372, 376, 377,382, 383, 385, 390, 402, 407, 412, 415, 416, 418, 420: n = A,T,C or G
  misc_feature 421, 423, 429, 433, 436, 438, 442, 444, 446, 448, 455, 456,458, 467, 470, 471, 475, 487, 499, 502, 503, 506, 514, 517,520, 522, 527, 536, 542, 547, 559, 564, 565, 566, 567, 569,572, 581, 599, 600, 603, 614, 620, 625, 627, 628, 641: n = A,T,C or G
  misc_feature 647, 649, 655, 659, 660, 661, 662, 663, 664, 665, 666, 667,668, 677, 678, 693, 695, 700, 709, 725, 727, 728, 729, 731,732, 737, 739, 760, 765, 769, 782, 790, 792, 801, 809, 813,822, 823, 824, 834, 839, 843, 848, 862, 868, 869, 874: n = A,T,C or G
  misc_feature 881, 885, 887, 897, 905, 910, 912, 921, 924, 926, 934, 935,943, 952, 963, 964, 966, 968, 974, 976, 987, 999, 1000,1003, 1028, 1039, 1040, 1043, 1044, 1049, 1058, 1062, 1063,1065, 1095, 1099, 1102, 1105, 1107, 1111, 1125, 1127, 1131: n = A,T,C or G
  misc_feature 1136, 1141, 1145, 1147, 1165, 1169, 1171, 1173, 1176, 1180,1184, 1192, 1196, 1199, 1203, 1205, 1208, 1212, 1214, 1216,1221, 1223, 1224, 1229, 1237, 1241, 1244, 1268, 1275, 1276,1289, 1291, 1295, 1296, 1301, 1323, 1324, 1325, 1337: n = A,T,C or G
ggaggacnnanggngcnnannnacacacgggnnnnannangnaggcggngaanggacnngnnnggaggcgcagnncaagcgcangcgncnnanagaangngnnggnacgagcnnancagagngagaggggncgagggaannngnagagccgcngcanagnagaaaancnnnnngnngggccgtnngggaaaacccccccncaaannaccgcgggnanangaaaggaagccaaagagaancccaaatcgangagaggaggaaaangcnggggngngnaggggcgagcccctgtgaaggcaagcaacgggcaannnacaacananccanggcagacncntcangngggggaggacacngaaggngnngagnganccannaaagnngnaaggngaggtgacaganggaangggcnccnngnanngnacaaanaggnagnangcanangnanaggcccnngngggaacaanggnnaaangaggggagcganaaaagggggggnaannggngaacaaangangancngggangaaccggangggcgnaaggnggcggcaacggncgcgnnnnancgnggaggcgancacgagaaggggaaagcnnagngggcgtatggnagacgnccgangnnagggcgaagccgncaccangngcgaanacgnnnnnnnnnnagcggcagnnggacaagaaaactancncgagngggggggcnctcctagaatcgaaanannnannagcgnanaaagacgagaggggggggggnaccgnaaanaggggacgaaganccacgatntnggggggggncagaatanccgngcggcgtannncgcgaagagnaaaangagnggggngtcacagatggggngctgcnnggganaaaaagngaananagagggggancacaaggnggganangacacagcnggngnagaggagnngggggagnaaaaaaaangcgggacggannanangggggncnagagcccgccntggccacaaaannacncgtagctctccgcccccggggggcnccgcatgtcannacnntgggnggggggacncccnngngatggggggcgacatctgggaaaaaaagangggncanacntncccncagaaaagcaccancnctgngggancagangganantgggggaggggggcgcangaanananggnaaancccnttcggaancggnganacananaanaaanantnggccncnnggccnagggaaangggnccnaaaatccgaaaaaccgacaggaangacgatnngcaaaagaccgancncaannctgangtgggggggaaaaaagcgggannncaccaaccaagnnaanaaangcttnnnnaggggntngganggacnanncangtggnangancccggtcagacggggnaaananannn

SEQ ID NO: 8301 - DNA, 784 bp, Homo sapiens
  misc_feature 10, 35, 36, 37, 38, 39, 40, 41, 42, 51, 52, 53, 55, 200,395, 498, 501, 605, 662, 665, 694, 711, 713, 715, 726, 729,730, 733, 734, 738, 743, 748, 749, 754, 764, 767, 769, 772,773, 777, 780, 784: n = A,T,C or G
ttatcctttnaagctcttgttctttttgcaggatnnnnnnnnaggggtaannncntcaggctccaccatacccaggctcttaccttagcagaagcctgtgaagctggtagcagaaacgagaaggaacaaaattaactccaaggcagtaagccatccacaagaccactacacgaagttaaggctgtgtgaaagagggagcntatttaattttattgttaaagaggcaataaaatatctagagaaacagccattaaaaaattggcaaatccagcctggccaacatagtgaaaccccatctctacaacaatacaaaaattagctgggtgtggtggcgcatgcctgtagtccccagcttctcaggggactgaggcggggggattgcttgagcctgggangtccgaggcttcagtgagccatgattgtgccactgtactccagcctgagcaataagagcgagacccttgcctctaaaaatacattaattaatttaaaaattangcnaaagatgtgaacagatactttttccaaagaaaggtatatgggaccaggcacggtggctcatgcctgcattctgggaggcttgagatggcggatacctgagatcnggagttgacaccccctacccgacatggtgaaaccccattttacttaaaatacacacnccnccccccaaatttctgggcatgtggcaagncccctgtagccccactncntnaggagcttgangcnnggnnaatntctgnaaccnnggagncgcaggtgtnggnanccnnaccnccncttn

SEQ ID NO: 8302 - DNA, 779 bp, Homo sapiens
  misc_feature 3, 17, 18, 19, 22, 23, 24, 25, 27, 28, 29, 30, 31, 32, 33,34, 37, 40, 41, 127, 566, 622, 624, 633, 679, 693, 703,707, 710, 746, 773, 779: n = A,T,C or G
aanaccttgaaccccgnnnttnnnnannnnnnnnccnaanncgtcaatgacaagagcaggaagagcgtttttgtgaaggtgattgacgtgactgtgcccttgcagtgcctggtgaaggactcgaagntcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggcccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctgcccatggctgttttcccaaggatcaagttcctgganggaaaggctcttggccctgacttccgttgtgtcccgagcacacgtgcttgacccgnancccgcccgncctgtaattcttggctgggtctggaagtgtctgtggagcaccctgncctcaccacagganccgtgaaccncttnttncagtcccgctgaacatgggaaacaacctgaaaaagnagcagccctcccgtcagggaccctttntttgcn

SEQ ID NO: 8303 - DNA, 817 bp, Homo sapiens
  misc_feature 4, 9, 12, 13, 15, 16, 17, 18, 19, 20, 24, 25, 26, 31, 32,33, 34, 35, 36, 39, 42, 43, 44, 73, 74, 105, 480, 579, 585,591, 594, 617, 619, 626, 641, 670, 723, 731, 734, 759, 799,801, 817: n = A,T,C or G
ctanccttnaanncnnnnnntttnnngaccnnnnnncgnggnnngcccaacatttcagattttccaaaatgtnngttaggaagtctccattgtctctgcattatnaaaatacactgttactatcttaatctcaagagtgtcattacagtgagaatctcatttaaaagcataccagtgaaattaatagcagtgcttatcaaagaacactgaaatctgtgagaatctttctaggagcattcttttcttcttttagttccaagttccagggtatttttcattcctagtaggtttatatgactcacagaatgtggacttttttcctgtttggagtatttttgtaatgtaagtatcggatagctgcaccacagcatgcataaattgcacattttgttttactttctttatagaatatttaatttcaaaaatataatttatgccaaaaaaagcatacctttcaattttgctacttggttgatttancacaaaatgcaaagtcttggggcagagagggggagtgaaaaaaattttataggtaattgttcaaaaataccctgtcagaaaccctaaagctgcattgtnaaacanatggtngtnaactagtttttgaaaaagtggtnanggaattngtgaaaaaaatcttnagacttaatggctctctaacccacatgangtttccttcttttttaatttaagtaaataccgcctgcttccataatttggganggtttttnggngttttgtaaggtcacttggaacaanacattggaaaacctggatttataatttgggataaactggnanccataaaaaaagaaan

SEQ ID NO: 8304 - DNA, 991 bp, Homo sapiens
  misc_feature 5, 13, 76, 81, 94, 111, 115, 125, 128, 130, 143, 150, 152,157, 164, 167, 169, 176, 216, 222, 223, 228, 229, 239, 246,264, 274, 289, 302, 303, 308, 314, 315, 319, 323, 341, 351,388, 409, 417, 435, 436, 458, 459, 460, 461, 462, 463: n = A,T,C or G
  misc_feature 464, 470, 471, 483, 484, 491, 513, 516, 524, 531, 551, 557,575, 588, 598, 602, 607, 622, 640, 642, 647, 655, 669, 672,697, 698, 705, 706, 716, 746, 762, 768, 787, 795, 819, 873,885, 915, 916, 919, 938, 958, 961, 964, 967, 991: n = A,T,C or G
gcganagagaacntcttttggcaaaactcccctgggctctttttttgggcaggggaatccccaccccgaattccgnaaatntccgggccaccgnagccccaaagaaccctnccancggggccctnggngnttttttttaaaanccccccncnaaaangtgggancangnggaaaanggaaggggaaagggggggggacgtttcctccaagagagtncactcnnccctnnttgggggganggggggngccaattgggccctccanggaaatttcnttgggaaaaggtggngggaaggggaagnngccangggggnnttantatnaatccctaatcccagggnaaggggggangcctcttcttacaccaaacctcattctccccctcaangacctaattggacaatataanggaaaccncctgaagggaagaagccnnactgaaaggagggaaaccagcnnnnnnncggggnnattggtttttgnngggatgntggccgacacctaatcggaaanggnccctgccnaaaatanttggaccttctaattgaatnggactnggggggaaaaccaccganccttcaaatttangtccgcttgnaagnacagnatggaatgaactggntacaataaaaaccctcgnangcctngcattttnaaataagggaattnggncccaaaaaagaaaatcttgggaatnngggcccnnaaatttttcnggggggggggaaaaatttcaagaacttggnaaattgggggccaagnttgganccgaaaccccggaaaaggngggccaanggaagtttggaagttaccccgaanccccccgctttacccctggccctttgccattgggggggtccagggaatattggngaacctcccaangggaccatcgtcaaagtgggcttggccaannccnaccctccgggggaagggtnaaagaaccctatcaaggggnggnaanaanggtaaaacatggggccatctgggn

SEQ ID NO: 8305 - DNA, 941 bp, Homo sapiens
  misc_feature 1, 2, 3, 7, 8, 9, 13, 38, 39, 68, 86, 172, 260, 271, 273,277, 290, 296, 309, 317, 327, 334, 339, 340, 348, 349, 382,386, 390, 392, 408, 409, 416, 443, 446, 451, 458, 460, 478,480, 490, 495, 503, 513, 515, 517, 520, 526, 529, 533: n = A,T,C or G
  misc_feature 534, 536, 539, 545, 550, 552, 553, 558, 561, 568, 591, 598,599, 606, 607, 608, 613, 617, 618, 620, 622, 637, 639, 666,669, 670, 671, 675, 689, 692, 695, 697, 701, 713, 720, 734,735, 740, 752, 770, 785, 798, 800, 814, 826, 831, 840: n = A,T,C or G
  misc_feature 843, 861, 866, 869, 875, 897, 899, 904, 912, 920, 925, 936: n = A,T,C or G
nnngttnnnagangtatagtgtaagtatgaagaacatnntgcaactgtacaggtagtcaccagttatngtgatatgataaataatngggctattttgatgaagaaaactttgttcatttgtttctactttctaagagaaattgccacgattcctctgcttttcaacatttcntatgacttttttttcgggtgggaataaaaagctgtgaaattgtcaacctactttgtaaccaaagaagcaaagctgtgtaatggagttnggttttttttngngttnttttttttcgccntttttntttttataatgcncattcttnatgtattccntatttangcgtnntttcagcnncaattttctttactgtctagcatgatctgcatnaccnatancnttgaaccacttttgtnncctcatntttttattccacccaccctttatctgnaantaatngtcctancncttggggaacaacatgtncnaattaaaaangaagnaaccgaancaaggcctgntntnggngggganccntganncntantcggtncccantnncaacntanactctgntataaaaaaaaaaaaaaaaaaanaaagcgnngagcccnnnctttntcgnngntnccatttttaaaaaanangggggggtttttctggaaatttatccntcnnngccnacaaaaaaaaacgnttnttngnttcnatatttgggcanaaaatcntttaaaatggcgcnnttttnaaaaaaaaaaanggccaaactattgccaanaaattaaaaagtccncccaagtgggttntnaccttgggagcttnttttttaaaaanttttnaaaaaatgnggncacatttttttataatanaaaanccncagctntttcaaaaaaaaaaaaaaacgncnttctnattttttnggggggcnttaancttaaaaaaancattt

SEQ ID NO: 8306 - DNA, 786 bp, Homo sapiens
  misc_feature 2, 6, 7, 8, 9, 36, 39, 70, 493, 495, 522, 556, 566, 571,574, 597, 618, 631, 664, 689, 698, 702, 706, 727, 728, 764,770, 777, 785, 786: n = A,T,C or G
cnattnnnnacgaggagcagctggcccgcactctgnttnctgaagcccacttccctggagctcttccganccaaggtgaatgcgctcacttatggggaggtgctgcggctgcggcagactgaacggctgcaccaggagggcacactggctccccctatactggagctgcgggagaagctgaagccagagctcatgggcctgatccgcagcagcgcttgctccgctctgtgaggggacgctcttccgcaagatcagcagccggcggcgccaggataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgccccatgtccgggagaagggctccgggaagcagaacaaggacctctatgaatttggccttcttaatcactatnanccgtggggaggaaggaagcgtaccttnaactttcatttgcccccttcaaagcgggaattcntaccttgttngacangantgggcttcaatggcctttgcttngggcagtccccattggggcangcgaagcaaaacnccggcttggaccttggaagcaaccttgcttgancattggaagaaccaagcttccttcntgcttggancttngaanaaccttgcccattccccgaanngggcaccccccttgtgccccccaccccccaacaaantttaancttttgnttttgacnn

SEQ ID NO: 8307 - DNA, 766 bp, Homo sapiens
  misc_feature 3, 5, 7, 8, 9, 10, 38, 40, 41, 69, 72, 97, 483, 538, 554,563, 601, 608, 666, 721, 725, 728, 739, 766: n = A,T,C or G
gcngnannnncaaacagaccttctgtttcatgaacagntnntgttatatctgctaacccatatctaggnttncctccaacggctatgcccaccccancgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctttcgggctcaactcgcaggtacggcatcttcttctgtaagattctagaaccaccttcaagtcacattgctccaacagagtttttgcaacttgtagtaaatgggacncatcaaaggcaaagcataatgtgttttttttttctcaactagaatataatttgcngccttgactacccaanggaactggntgaagatatttctaaccaagctcatgggttaatctganccactgnggtttcctttgcccaccatttgggctctctttcttggtcttgggaaaattcccagtgnaaattttgttgaattattgtccaacctaaaggcagaaaaagttaaaaaagaaacnggtnatnaaaactttccncaaaattctttgaaaaaaaaaaaaaan

SEQ ID NO: 8308 - DNA, 1410 bp, Homo sapiens
  misc_feature 3, 6, 7, 9, 10, 12, 14, 15, 20, 22, 23, 26, 27, 28, 30, 31,32, 33, 35, 37, 46, 49, 51, 53, 55, 59, 61, 62, 66, 77,84, 86, 92, 94, 96, 97, 99, 112, 120, 123, 137, 139, 145,150, 153, 158, 168, 171, 173, 180, 182, 184, 186, 187, 199: n = A,T,C or G
  misc_feature 200, 204, 206, 209, 210, 211, 214, 215, 220, 221, 223, 224,226, 234, 242, 248, 257, 271, 273, 280, 281, 282, 283, 292,294, 302, 304, 305, 327, 329, 336, 342, 344, 345, 346, 348,352, 365, 374, 384, 388, 392, 393, 399, 410, 412, 421: n = A,T,C or G
  misc_feature 424, 426, 431, 437, 438, 448, 453, 458, 459, 465, 467, 470,478, 482, 489, 490, 498, 504, 508, 510, 511, 516, 518, 519,523, 529, 530, 538, 541, 544, 547, 552, 554, 560, 565, 567,570, 593, 603, 605, 606, 619, 621, 629, 631, 634, 639: n = A,T,C or G
  misc_feature 642, 644, 645, 647, 648, 658, 660, 661, 662, 663, 669, 675,681, 682, 687, 688, 693, 696, 703, 707, 708, 720, 728, 732,744, 747, 764, 765, 766, 768, 770, 771, 772, 776, 778, 782,787, 795, 809, 810, 812, 813, 823, 826, 827, 833, 836: n = A,T,C or G
  misc_feature 843, 853, 855, 857, 860, 862, 863, 866, 882, 883, 887, 888,895, 903, 910, 919, 922, 934, 937, 942, 943, 947, 957, 961,973, 978, 992, 994, 1022, 1029, 1036, 1043, 1044, 1046,1049, 1052, 1060, 1062, 1063, 1064, 1077, 1079, 1082, 1085: n = A,T,C or G
  misc_feature 1086, 1087, 1089, 1090, 1095, 1096, 1097, 1098, 1103, 1105,1108, 1113, 1119, 1122, 1124, 1133, 1136, 1138, 1139, 1140,1141, 1149, 1154, 1158, 1160, 1168, 1172, 1180, 1190, 1191,1192, 1193, 1200, 1203, 1205, 1213, 1214, 1215, 1216: n = A,T,C or G
ganacnncnnangnnacccntnngannnannnntncnaccgcatcnagnanangntgtngnnaganggcgagggggnggtaggncntgcagnancnncncccccgcggcgtnggaaaccnttncaacaaacaagggntnataganaaganccnctagngtaccccgcnagngnaggggcngnananntaggggagggcnnggcngnctnnnccnnaacgnngnntngaaatccnaacctggngaaacnggagggaantgatgcagaaaaangnacgatannnncgggacgcnanccggggcnannaaaccgaaaaaaatcagccccnangggaaangagggncnnnangatnatgaaagggaaangggaaaggnggaaaggaanaatngggnnaaaaanggctggggcangnacgacaatnagnanatcgnggaaannggccaaccgnggtgngccanncctcgncnaangaagcagncagnaacggannggcggatntccggngggngnngagangnnctcnaacgannagaataanggnagnggnggcangnaaggtntgtgngnacncatgcagatatcgatatacaganggagcgtgancnncaacacaagagancncgaaaaananacnagagncgngnngnntaaacgaggngnnnnacgatnacacgnatatgnngacanngggtnctnacatganacannctatgaaagacngacgatangaangcgaacggggtncanggcgcgcggtacatgcnnnanannnagcncngggngcgantcaccaantctgatgcataacnntnngggccacagnggnncatgtntanagtaacncacacacagngngngcncnntanccacgaagagccgtannctcnnggagaanaggggaanattacangacatatcnganctgtacgagganacnctgannatcngagagatgangctntgtggggagaanccgtntgaccccgaaggtngnggaacgacaccacacaaaacgaggaaantcagtgngggacangcgcctnnantanaanacgaaaantnnnaaacgaaaagaananagngcnnnanntgggnnnntcatncnganaaganaaagangcnantacagagangtncnnnngatgcccncagtnaagnanactggcgncaangggacaanacaaagtaannnntgggaanaangncgcagctnnnnnaangaaatngnnatcnnaatanngganacntctnaagancgacnggggatncgaaacagnacnngannaagnccngaaancnanntngantggngcanncgaannngnggnncnacgcgngcggatnacgaacaacaannacgaanangnagcgtgggcgnnanggcaaaaaccngnnagannagnctcgtac

SEQ ID NO: 8309 - DNA, 1170 bp, Homo sapiens
  misc_feature 5, 9, 16, 17, 18, 20, 22, 24, 25, 26, 27, 28, 29, 32, 34,43, 49, 51, 61, 62, 68, 69, 70, 83, 84, 97, 101, 103, 104,106, 107, 108, 111, 115, 118, 123, 127, 136, 143, 144, 156,157, 158, 164, 167, 182, 184, 190, 191, 193, 194, 197: n = A,T,C or G
  misc_feature 201, 204, 216, 230, 232, 234, 235, 237, 238, 242, 244, 245,247, 250, 257, 262, 263, 268, 269, 271, 272, 278, 283, 285,288, 289, 290, 291, 293, 294, 307, 308, 311, 312, 321, 322,323, 328, 336, 337, 340, 342, 344, 345, 348, 353, 356: n = A,T,C or G
  misc_feature 357, 363, 368, 369, 370, 372, 373, 374, 380, 381, 385, 387,389, 392, 396, 397, 400, 402, 404, 408, 416, 418, 420, 421,429, 431, 436, 440, 442, 443, 453, 454, 456, 457, 460, 462,467, 469, 473, 475, 476, 477, 480, 482, 486, 489, 491: n = A,T,C or G
  misc_feature 492, 493, 497, 499, 501, 503, 505, 506, 508, 510, 511, 515,517, 532, 533, 541, 543, 545, 550, 551, 554, 567, 569, 570,576, 581, 586, 592, 596, 600, 601, 603, 610, 611, 613, 618,619, 624, 627, 630, 632, 633, 635, 636, 640, 644, 667: n = A,T,C or G
  misc_feature 672, 675, 680, 685, 689, 696, 698, 700, 709, 711, 721, 723,727, 730, 731, 732, 738, 745, 746, 758, 759, 760, 763, 767,768, 769, 781, 792, 795, 800, 802, 805, 809, 814, 818, 819,824, 830, 834, 835, 840, 846, 851, 852, 856, 859, 860: n = A,T,C or G
  misc_feature 869, 881, 907, 908, 910, 912, 913, 916, 918, 924, 925, 926,931, 939, 941, 950, 952, 953, 954, 960, 961, 964, 966, 970,972, 978, 982, 987, 988, 990, 1000, 1010, 1012, 1015, 1017,1026, 1030, 1034, 1036, 1037, 1040, 1047, 1048, 1050: n = A,T,C or G
caggngggngaggagnnnanangnnnnnnagngncgagggggnaccacngnggaaaggggnnagagannnacgcgcgcaacanncagcttttttttntgananngnnnggngcgnaanaaccnaccnagagggaangaaaagnncgcggggggggnnnataaanccntgcgaggggaaacgngngcaacnncnnaangganaanaaattttgaggnaaaaaaggagacgncnanngnngaancnncncgnggagatnatagnnccccnncnncaaagnaggantngannnncnngagggcggagacnnccnncggagaccnnnaagcnaggcgaannaanancnnganccccncgnncgagcnccacnnncnnncccccnngaancnanaancaanncgncngncccngaagcggncncnncacgagancngaccncatngnnccccaggccnncnnacnanagcgncnacancnnncgnancacnccnannnggcnanantnanncngnnaggncncaaacacgccacccnncccacgcnanangcaanngcncacaaaaacggcncnncacccnccgancggtntcgacnagancganncngccaagnnancacgnngaagnccnaancnngnncganaacngcagagacgaggaacgagccacnccggnganagacngaccncgcngaacgangnanagcggccgngncagaccacgnanacgngcnnnacgcanaagagtnnacgcagacacgnnnacncggnnncggggggcacgngagaggcaccncanatggncngangacncacgngcannacgcnggcganacgnnccccnccgtgngaggnncccnagnnacccgagtncacccccgccgngcaccacacgggagcaccgccgcaanngnannaancnacgagnnnggagncaaaggangngcccgcgcntnnntgaccnncgncncgcngncacggncacnaactnngncgagaggatntatgcaccgnangancncaccccgcnccgnatgncnngcnccacacnncnnggagagcgacacacgncngagngngagcccnccccagcganggacncncnnagagngagccccncacgnctnggaagcagcacancaagggggggagcccngagggggngntacacnng

SEQ ID NO: 8310 - DNA, 753 bp, Homo sapiens
  misc_feature 7, 8, 9, 10, 37, 70, 71, 485, 500, 512, 562, 579, 590, 596,612, 630, 647, 678, 703, 743, 746, 753: n = A,T,C or G
tcaattnnnncgaggtcctccaagacctgattcagcntttcacacggtggtgccactggtcccagggttnnccggccccatctcctcagggcagtgggtggggaagactcaccactacccctaaaatgggaagagaccagggttccaaagtgacccccagtgggggcttcacacgccagggagtacatgagatgatttctgtggtccctgatacacagcttttcattttgagagacacaattatttgagtatctagtaattcaagcctgggattcaaagatatcatttaagatgaaactgaatatttctcttctggttaagatgaattaatgagggacgggtgcagtggctcacacctgtattcccagcactttgggaggccgaggcaggaagattgctttgagcttaagagtttgagactagcctgggccacatggcaaaaccaaaaatacaaaaattagctggcgtggtcgtgcgcgcctgtngtccccacttattcnggaggcttgtantgggagaattgctggagactgaaaaatccaagcttgcaagtgagcttgtngtcacgccactgcactncagtatgggtnacaganccgagacccttgtctnaaaaaaaaaaaaaacctntttatgtttattttgtnacaaaacatgactttgagccctgttcaggcntcaaccttaaattaagtaaaaaacnaattttttaaaaattttaaaaaaaaaaaaaaaaactcganctntaaactn

SEQ ID NO: 8311 - DNA, 806 bp, Homo sapiens
  misc_feature 8, 9, 10, 11, 37, 71, 279, 501, 537, 574, 579, 589, 599,602, 607, 633, 636, 653, 657, 671, 674, 683, 686, 695, 702,720, 736, 742, 744, 747, 759, 767, 779, 788, 791, 793, 797,806: n = A,T,C or G
ccgagtcnnnncgagccaagacctccacggccttgtntttagaaatctccacaaagtgacagtgaatgatngagggggagttctcagagtcattacagctggggagggtgcattgcctcatgaattcttggaaggtgtggagggagttgcaggtggttttatatatactattcaggaaggtgatgctctcttacacaaccttcattctcgccctcaaagacttattgatcatataaggaatctccatgaggaagatgccttactgaaggaggaaagcancatctatgatgatattgtttttgtggatgttgtcgacacttatcgtaatgttcctgcaaaattattgaacttctatagatggactgtggaaacaacgagcttcaatttgttgctgaagacagatgatgactgttacatagacctcgaagctgtatttaataggattgtccaaaagaatctggatgggcctaatttttggtggggaaatttcagactgaattnggcagttgaccgaaccggaaagtggcaggagttcgnagtacccgacccccgcttaccctgccctttgcctgtnggtcnaggatatgtnatcctccaanggncatcntccaagttggctggccaagccaaacntcngggggaggtttaaaaanaccntatccacgggtcgnaanaatgttaancantggggcccntctttgnattggcctcgcccttaangaacccttaacaagantacccnancgncaaggtcttgtnggcttggngttgaaaaaacnaccctgttnaanancagngcaattgcn

SEQ ID NO: 8312 - DNA, 789 bp, Homo sapiens
  misc_feature 2, 5, 11, 12, 17, 24, 29, 32, 33, 34, 35, 36, 38, 39, 40,41, 50, 51, 52, 53, 572, 600, 639, 645, 713, 754, 757, 766: n = A,T,C or G
tnatnctttcnnctctngtctttntgcangannnnntnnnntcgaattcnnnncgagattgcctcccagcttgggagcatccaaagtagaaccatgactgggtcatgaaatgggttaatttggtttctttcattacagggcaaagttctccctgtggactgagaaataaacatattataaaagttacatatgctcatagaatagaaatcaaagagtaaaaagtattgagtgtaaaaaacaagtgtcttttttccccccagtctaactccccagaagtaaccttttttattttttatgttattttttcttaccttcaaggaaggagaaaagtaaccatttttgagttgatgcgtatccttcgcctgagagctatctttgtaatcatcctttttggttcctttttcattttttgctttctttctgtcgtagctgctgtgtaatatagagaaaaaaaagtattttttcagctctctcactcaattacaattacacagaaaggtttctgtgacacatttgtgggagtttctccccacacagcaaacaggcagtcaattctggagagaggtcaccangtgggtgtcctctaacccaattcaattncaacattgtggtactcggagatagtgtcagatcccacangttganggctctgcccacaagactggcccccaacttgcccaccaattgcagctccaagctggtttacctgggcnttttgggccaaccgatataaatggggttccccaccccttcnttnggtcaaatnaattgccggaaccggctcacaaa

SEQ ID NO: 8313 - DNA, 881 bp, Homo sapiens
  misc_feature 2, 4, 11, 56, 57, 64, 70, 84, 86, 88, 90, 93, 95, 113, 126,133, 139, 163, 168, 170, 176, 178, 191, 192, 232, 247, 253,255, 277, 295, 316, 339, 340, 341, 342, 345, 348, 364, 369,384, 390, 394, 406, 407, 413, 414, 419, 435, 439, 448: n = A,T,C or G
  misc_feature 473, 474, 483, 506, 521, 527, 529, 532, 547, 552, 557, 569,574, 576, 607, 610, 623, 626, 627, 650, 658, 660, 665, 667,676, 678, 685, 692, 693, 697, 708, 710, 713, 723, 730, 743,754, 757, 759, 803, 812, 813, 815, 818, 824, 826, 829: n = A,T,C or G
  misc_feature 833, 841, 854, 857, 862, 870, 871, 873: n = A,T,C or G
gncntttgaanccctttcaactacttgttctttttgcaggatcccatcgattccgnnttatggnacgcgntgctctttcgcagntncncntgntnattccactcattggtganacggattccccanacattancattantctctatttggctctgatactaanctggntntgttgntnagagataatcctnnactatactaaattctacgtgattatatattccacctctanttcctatatttatgngctgananttccttatccatatatgggctnattttttttttccctctncttcttttctacctttggggntttaaaaagttacttaaggactnnnnccnctntcttacgatgtgaatnccagntcttttggcaaggcntgaggnaggngagggatatgcnngaaccnnctgtntttcaaagggcttgcncttnacgcttatngacgggttgccccccttgaaaaaanncccaaaatnttggggccaaggaaaaaatggangaaccccctgacctnggggantnttngggggggaagaaaanttttnttttnccaaatggtttntgggnanaattattccctatttggcccccaagacaatnggnggggcttcaccanccnnggcttagcccccaagccccctcntgtgcccngnccccncnggctggggntngcaatcnacctatnngggnccaaccaattntntanggacccctcncttgggncaaccaattggcnaaaaacccccnatntncttatccttaaaaaatttccaaaaaggtttgcccccggggaatnattggatanncnttnccccgntnaanaacnccaacttncttgggtgaaacnctnccaanacccgggnnanaaaaaaca

SEQ ID NO: 8314 - DNA, 794 bp, Homo sapiens
  misc_feature 1, 5, 7, 8, 9, 10, 37, 67, 68, 200, 209, 233, 249, 312, 315,338, 341, 347, 358, 360, 386, 394, 437, 441, 463, 466, 477,483, 499, 509, 542, 580, 585, 593, 607, 610, 615, 617, 625,647, 658, 670, 676, 678, 683, 684, 698, 705, 711: n = A,T,C or G
  misc_feature 715, 720, 728, 744, 755, 760, 772, 774, 775, 783, 791: n = A,T,C or G
ngagnannnnaaagctgtgtccttaatgacagcaaanttttagcacttcctttgtcctagagacatnnattcattctaaagaaaagcccacgatgcttcagtggattgaactgttgacgaaacagtttaataatagtcaggcagcttgtgagtggtttttagatcgtatggctgatgacgactggtggccaatgcagatnctaattaantgccctaatcaaatcgtgagacanatgtttcagcgtttgngtatccatgtgattcagaggctgagacctgtgcatgcttatctctatttgcagccaggaatgnaanatgggtcagatgattggataccncantagaanatattggcggncnttcatgtgtcactcgctttgcgaganccctgtancaattatggaaccatggcgtaaaacctcacagtcaacatcttnacanagtattttcgccttcctttacnaantttgcaaaaanggggtnaaagaagagagccaantttttgctcncattgcaagctatatctacaatggcacattttnacatggggaacaaaaagggccctggaaaatcctcaagntgaantgttatcntgaggaagaaaggngancaaananagaaggangaaacaaagaattttctcttcncctgggcagancaaaaaattacntggccnancttgnnccttggtaaaagangaataangttctncctnggctnctttccgntttgaaccaccctcgnatccagaaaanggccnaaatgttttccnannctccaaantgtctcanacg

SEQ ID NO: 8315 - DNA, 750 bp, Homo sapiens
  misc_feature 13, 14, 17, 19, 23, 31, 40, 42, 44, 49, 65, 66, 67, 124,134, 186, 300, 312, 361, 406, 412, 511, 514, 516, 538, 549,566, 592, 594, 613, 616, 630, 638, 643, 655, 670, 686, 690,692, 705, 707, 717, 725, 747: n = A,T,C or G
cctcaccccgaanntcntntatnggcccatnatatccttnantntcccnactccaatatccaaannnctgtcaaggatcacatactacatttggttctttattatagactttttaaatatcgtngtataccatngtgattctatccgtctcctttaataaagaggagaaccagaaaaatgaaaggncataagaggaatgaggtttggagaataggtgaaaaaaggcatcataatgtttataataatgtttgcctgttcagagaaacaagaatcacagataaagtcacttatatgtagatnagagaatgctgnattactttttgctattctattcactgatcatttttctaagaactctgtntgcttcttgtttaactcttatgtcagcatgtatgagaaaactganttaaanagatgttaagtaactcattcctgctttactagaaattggttcgatgagggacataaacctagcccggtgtgattttagatgctttttttaacccattgngtngnattggcctatatttctaagctnattcatggtcnctgagaagcaaatcatngttctacctatgactttagaaaagtnanaataaagatgttgggcaanaanaccctttttatttnggggttcnttttngaaggagcagantaactttggttcctngcattcccttgggtangctngnggcggggcgtccntntttaaatccntcaaaaangaaactggttaaccccttcaanccc

SEQ ID NO: 8316 - DNA, 757 bp, Homo sapiens
  misc_feature 5, 6, 7, 9, 17, 34, 296, 304, 493, 529, 550, 551, 561, 601,623, 647, 667, 676, 714, 736, 737, 738, 745, 748, 749, 757: n = A,T,C or G
ccccnnncnaatcgccnaaggttggaacaaaccntgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaggcttttcccccaaagtatcatgtgtgaacctacaacaccctgacctctttctctcctccttgattgtatgaataaccctganatcacctnttaaaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgccaaagcgagacacagctatttaatctcttgccanatatcgcccctcttggtgcgatgctgtacaggtctntgtaaaaagtccttgctgtcnnaagcagcccnatcaacttatagtttattttttttctgggtttttggtttngttttggttttcttttctaaancgagggggggaaaaaagttcttanggttcaaattggaaagtttntgatgaaanaaaacccattggagaatttttttccaggggaaaaaaancctggcatattttgggttttcnnncaaatgngannccttaaan

SEQ ID NO: 8317 - DNA, 847 bp, Homo sapiens
  misc_feature 6, 13, 18, 21, 23, 24, 34, 40, 42, 43, 44, 45, 51, 52, 53,54, 55, 56, 57, 139, 632, 663, 672, 694, 697, 704, 718,727, 761, 772, 777, 778, 788, 793, 810, 819, 843, 847: n = A,T,C or G
tttaanccctttnaactnctngnnctttttgcangatccntnnnnccgatnnnnnnncgagtacgaccatgaaatcacagggcttttgggtgtctgtaggtcttctcctggtgaaaagtgttcaggtggaaacttgganactcctgggacgtgaaactgggagccttaggtgggaatacccaggaagtcaccctgcagccaggcgaatacatcacaaaagtctttgtcgccttccaagctttcctccggggtatggtcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcaagcaaactcacccgtgggtcgctagggtggggtatggggcccatccgagctgaggccatctgtgtggtggtggctgatggtactggactaactgagtccggacgcttaatctgaatccaccaataaataaagcttctgcaagaaaaaaaaaaaaaaaaaaaactcgaaccttntacaactatagtgaagtcctatttaccttanatcccagancattgaataaagaatacattgnttnaactttngggaccaaaccccncaaccttanaaatgccatggaaaaaaaaatgcctttattttgntgaaaaatttngcganngcctttttgnttttnatttggtaacccatttntaaacctgnaaataaaaacaaggttaaacaacnaacn

SEQ ID NO: 8318 - DNA, 803 bp, Homo sapiens
  misc_feature 3, 6, 25, 27, 38, 48, 55, 58, 59, 60, 62, 71, 76, 82, 91,106, 112, 113, 114, 116, 119, 123, 125, 131, 134, 135, 168,171, 174, 176, 182, 188, 195, 196, 200, 201, 203, 206, 208,213, 214, 215, 227, 230, 231, 233, 240, 243, 248, 250: n = A,T,C or G
  misc_feature 257, 260, 264, 268, 275, 283, 284, 285, 286, 291, 307, 324,325, 349, 352, 378, 389, 398, 410, 414, 420, 436, 445, 446,456, 464, 476, 494, 503, 506, 510, 513, 518, 523, 535, 557,559, 571, 594, 604, 620, 621, 622, 623, 628, 643, 663: n = A,T,C or G
  misc_feature 669, 682, 684, 692, 693, 694, 699, 701, 709, 715, 717, 730,733, 740, 747, 749, 750, 775, 777, 780, 783, 792, 793, 795,802, 803: n = A,T,C or G
ccncgnatcgattcggcacgagatnangtcacaaattnatgatattgncctgggngannntnctacttgtntcccnaagacncataagctnctacaagactttttnaatggnnnanaantgantnatagcntcnncctgatgaatctgttgcttatggtgcagatggncangcngncatctngtctgnagacaannttgnnantgntnaaaannngctgatcttggntgnnantcctctntcncttgntnttgaaantgntggnggantcattantgcctcannnngcgtnataccaacattcctancaatgcccacacagacnntcactacctattctgacaaccagnctngcgtgcttattcaggtttatgaaagngaacgtccccntgacaaaanataacaatctgnttgncatctntcaaactccacaggcntaactgccnnccgccccaangtggttcnctcaggattgtnagtcccctttttgacgtntggaagccnccngggngtnccctncaagngccctcgggctnggggggaacaaaaaattttccngngaaccaaaaagnaccaaaggatttcccaattcacnttaaaagaanaaaaggggccgctttnnnnccaangggaaaaaccttttntgaccgtaatttgccccgangaaacnttgaaaaaccttnanagccttannnatggntnaacccggngggacncnggggggtaatgcnaanaatttantttgaancnnttttggccttttgaccgggaaaaancnctnttnggagaaatnngnaaacctnn

SEQ ID NO: 8319 - DNA, 1001 bp, Homo sapiens
  misc_feature 4, 17, 25, 29, 30, 34, 36, 43, 61, 65, 71, 74, 75, 86, 87,94, 103, 108, 125, 128, 135, 149, 154, 178, 189, 196, 204,219, 222, 224, 225, 231, 235, 238, 241, 243, 247, 250, 260,261, 264, 273, 292, 296, 305, 307, 313, 314, 317, 319: n = A,T,C or G
  misc_feature 321, 322, 329, 334, 338, 339, 355, 367, 372, 378, 379, 382,383, 385, 386, 389, 399, 409, 410, 418, 426, 430, 435, 438,441, 443, 445, 447, 452, 454, 456, 458, 460, 463, 464, 474,479, 480, 482, 484, 486, 490, 491, 496, 503, 505, 509: n = A,T,C or G
  misc_feature 512, 513, 515, 523, 528, 530, 535, 536, 540, 543, 550, 551,554, 555, 556, 557, 559, 561, 563, 569, 571, 577, 578, 580,581, 582, 584, 586, 588, 589, 596, 600, 601, 604, 605, 610,612, 619, 620, 623, 626, 627, 628, 631, 634, 636, 638: n = A,T,C or G
  misc_feature 644, 647, 648, 652, 653, 661, 663, 664, 680, 681, 683, 684,690, 693, 695, 699, 703, 705, 706, 709, 715, 716, 718, 719,720, 722, 726, 728, 740, 746, 748, 750, 754, 757, 758, 759,763, 769, 771, 779, 780, 785, 796, 797, 802, 804, 808: n = A,T,C or G
  misc_feature 814, 817, 825, 829, 830, 835, 837, 845, 850, 859, 868, 873,876, 889, 892, 900, 906, 912, 916, 918, 939, 944, 953, 954,962, 978, 979, 983, 985, 993, 994: n = A,T,C or G
aaanaaagttgttcganttaacganatanntgtngncagtgtntgttggccgattaatatncatnattganagnntgcattgtacnntgtgttntcatatgancattntattatgtaacgctgtngtngtgatcncatcttatatatanatcantttatagaagggggggggggagcnatgaatatacngtagagntgacggtnacatattgtatgatntantnncattanagcnagnatnanattnttntatattgtanncangataaggtntcataaatatagtttagtnacgnactctattncngaattnnaantntnnttactgngttangtanntgaactcaaacgtccnaataatttattnaattnggtcannacnnannatnagggtaatgnctatttgaanntcaaacantcctaaangggnggcgngantgngngntntaacnangncngnttnnagaatttatngcatnnantnanttannaattngttatgncnttanatnnantaaatggncagananttccnnatanaantggtttnnaannnncncngnctatcncntttaannannnanancnntactatnttannatnnctttnanggtaacnntanacnnnaanagnanangtttgngannttannacatctgntnnggaaaatatgcgtatnnannccatgngantntctnagcncnnatnatatannannnangatnantatgggggtgcntatatncncntganttnnnatanactatntnttgtgtcnngctcngaggtgacaannatatntncatntctcanacnaaagtatnttgnnacacncntcattgtntaagntccaacacnggagagagnagganagnagattttctatantanaaatactncacatnttatanatgngngggaggtgtgttttatttttntgtgngagaaaaannaatcattntctatgccataatganntctntntgggagannaaagagt

SEQ ID NO: 8320 - DNA, 743 bp, Homo sapiens
  misc_feature 6, 9, 454, 526, 602, 611, 618, 638, 673, 688, 694: n = A,T,C or G
tacccncgntcgaattcggcacgaggttactcagactatatttgcttaattgaattaaacacagttgcctatgccctttgaaattctggactttcaacagagggcctctagcccaatatttgcttaccaaactggacatcattgatgatctggattcaggcagggtctggaaaaagagagactgggccaaattaaaataatccattcactgatgacacaaaactaaactacaattgtttggcaccctctcttctccttatcttgcaaaatcaaattaagcactagtggaaagaaacagttcagagaggaatatgggaaagggaaaaaaaaccaaaatgtgatttccaacgagactagagatttgttctttatctacatggtcatgttactcatttgatagcatctatctcaggggtattatgttatctcttggccaggacttatgaaagttaanatttgcattgataggaaaagttttgcagaaatatggactcttgagagggtgggaggtatataaaagcagcanagcaatttgcatttcttatacaccctgcttgagactgatgtcattagtgttggttaggcccaaggcttggggggangctactcanaatagtngggtgacccaattaccccanaccttttggaaaaaggaaatgactttgattggaanaagcccattcctttnaaatgnatcttactgctcaaatttcccccattggccttttggaaaaaatgccccc

SEQ ID NO: 8321 - DNA, 1411 bp, Homo sapiens
  misc_feature 2, 3, 4, 5, 6, 7, 12, 13, 17, 19, 24, 26, 27, 33, 40, 41,47, 50, 51, 55, 56, 62, 76, 77, 84, 88, 91, 96, 110, 111,112, 117, 122, 123, 130, 140, 144, 146, 148, 152, 153, 175,183, 188, 192, 193, 195, 204, 212, 218, 225, 228, 231: n = A,T,C or G
  misc_feature 233, 242, 244, 248, 251, 257, 259, 263, 270, 283, 284, 286,292, 296, 298, 299, 301, 308, 310, 312, 314, 318, 319, 322,324, 327, 331, 335, 342, 344, 353, 355, 364, 365, 373, 375,376, 378, 383, 388, 390, 402, 403, 408, 411, 414, 418: n = A,T,C or G
  misc_feature 419, 425, 426, 427, 429, 433, 435, 441, 443, 446, 448, 450,451, 458, 463, 465, 467, 475, 476, 477, 479, 484, 485, 487,494, 495, 496, 498, 504, 513, 519, 522, 534, 536, 537, 538,545, 546, 547, 549, 558, 559, 562, 564, 567, 572, 575: n = A,T,C or G
  misc_feature 577, 582, 583, 585, 589, 591, 594, 602, 603, 608, 612, 613,614, 615, 616, 621, 624, 625, 626, 633, 635, 638, 642, 644,645, 646, 652, 655, 660, 663, 672, 681, 683, 684, 686, 690,693, 705, 720, 726, 735, 737, 744, 746, 757, 760, 778: n = A,T,C or G
  misc_feature 784, 787, 790, 795, 803, 808, 811, 812, 814, 817, 819, 820,833, 837, 842, 848, 858, 861, 869, 871, 879, 888, 891, 896,898, 903, 906, 911, 914, 915, 916, 918, 929, 932, 938, 948,949, 952, 953, 960, 968, 973, 976, 978, 987, 990, 1007: n = A,T,C or G
  misc_feature 1013, 1027, 1030, 1031, 1033, 1036, 1039, 1049, 1050, 1052,1059, 1063, 1065, 1066, 1070, 1073, 1075, 1076, 1079, 1080,1084, 1086, 1088, 1090, 1100, 1111, 1117, 1121, 1123, 1130,1134, 1136, 1138, 1145, 1146, 1147, 1151, 1153, 1154: n = A,T,C or G
annnnnnctgcnncccntnttgantnngactangataatnntaaaanggnnaccnnacgctnctattatttaatannacgaacncgcnccnggacnctaatgatatactnnnttctntgtanntgaaaangacatgtatntccncnangganngtgggtgaagtgctcccccccncctcttgnatatnctcnnangacttaatntataagtnatatgnacactcnccncantntttaaatgnanagtntgngggggngnggantattgtntatacaaacgccnnanctgtcnctcnanncnataacgntncnantatnnatncnacntgtntatnttttccncncatgtaagntnatatcattnncgctgcantnnanatatnctctncnctgtttcaactnnctctnccntanccgnntttagnnntntgtntntgtgancnacncngnncgtatanaattntncnccaccacnnnantgatnnantttgttnnntnagtgtnggcctatcnttcggnatnttacatataaanannntatctcnnngncgggacatnncgncnttnctggntangnagatnngngttntntgnttgagtannatggnctgnnnnntggantcnnngttttantngcngtanannntaactnacnttcantgnagattatanttcgctaananntntccntancagtagacgtcnccgtggttgatacanagtacntacgcgccncntcaatgncntctgctacacncanacttatgtatgtgtatanacgacnatntancgcgntacatttnggcangtnncnagngnntagtgcccctccnattntgagncacacnccctgtttgntanatcccagncntctatatntgttatatnggncagcngngatangtnatatnctnnnancacccatcatntantgatancgcagcgtcnntgnngtatatngtactatncccanatntnctttgattntcncactgctcatgatgatnctcttntattgtttttgtgntanncncgntcntatagtcgtnntntggaganttgntnngtgnatnannttnncgcngnananaatatatatngatgaaacccnacaganacancnatgtgtnaacntntnggtgagnnnggtntnnagtgttgtntcgcacntcggtntgcgacgcnagcntgcnntccgcgagttatggtagttntaannatatagntatntgccgagnganagagtnatgatantggngtcncatnnatcattntctgatacntntgntgtgntaccnaccnagttcgnttgtntnnangcgagtatacntntactccganacagngtatntcntggcnatanntgatanacnnnncnctgcgtntntttatacatnatctntgnnanaga

SEQ ID NO: 8322 - DNA, 783 bp, Homo sapiens
  misc_feature 1, 4, 5, 6, 8, 21, 31, 38, 51, 78, 91, 107, 110, 129, 146,187, 193, 198, 218, 229, 235, 284, 291, 347, 356, 358, 372,379, 406, 419, 437, 447, 460, 469, 472, 483, 507, 532, 533,540, 552, 572, 573, 578, 579, 588, 596, 606, 614, 619: n = A,T,C or G
  misc_feature 628, 635, 636, 650, 653, 654, 655, 658, 661, 665, 668, 669,683, 686, 701, 715, 716, 719, 735, 740, 746, 752, 753, 759,761, 765: n = A,T,C or G
nctnnntnaaaatcccccacnaccctgattnaaagtangaccttcccatangggcgcctttgtgtgctaaaggcagancaggcaggcttcnccactcctatctcctncgnaggccaccaccatcacatntataggaggaacaagancactgggggaactctggagtatgagtaaggaaatgcttctnaccttntctgntccaaagagatatctgttanatcagggaacnagtccnctaggtcaggcacttcctcctgaccagtgcaacgggcactccaggttanaaactgngtgtgctccctctctgtcagttacttgtctaagggctcctatacgtggccatcaanctctctggncntgagttctgtttgngcttatngcagcagcatctttacaacaaacaggntcagtaatcaacntgggaagggaaaaagacnacagtcaatnttaccccctgtanagccgggangcntttacacctgnaatggccttcttaactgatttctngccgggcccctcacccccatccaanntctgaancttgaacaaatncccacggcaccagaagaggnngtctnnctttgcaanctcccaancccttggacnaaaaaaanaaaanctggaagcntggagannggcttttacggcanccnnngtnggncccncgnnccaaacttggttcnggncatttatttttaggntttcccccaaatanntcncttggagaatccactntggantttttnccttanntttctntnaaanaaaaaacccaggttccct

SEQ ID NO: 8323 - DNA, 829 bp, Homo sapiens
  misc_feature 4, 5, 6, 8, 9, 10, 17, 35, 39, 41, 43, 56, 67, 73, 82, 91,104, 110, 127, 134, 137, 138, 140, 145, 147, 152, 155, 167,173, 174, 175, 181, 187, 189, 194, 195, 201, 209, 211, 215,219, 221, 224, 227, 229, 234, 238, 252, 255, 273, 274: n = A,T,C or G
  misc_feature 283, 286, 304, 306, 308, 310, 314, 317, 322, 325, 330, 331,332, 333, 335, 340, 341, 342, 345, 347, 348, 350, 351, 357,360, 370, 376, 383, 384, 385, 391, 392, 393, 396, 399, 400,407, 410, 412, 413, 415, 416, 422, 428, 430, 431, 433: n = A,T,C or G
  misc_feature 436, 438, 439, 441, 444, 445, 446, 454, 456, 462, 467, 468,472, 476, 478, 479, 486, 489, 490, 498, 504, 505, 507, 511,512, 514, 517, 518, 520, 522, 529, 535, 536, 537, 538, 539,541, 542, 546, 547, 548, 550, 562, 563, 566, 567, 569: n = A,T,C or G
  misc_feature 570, 572, 573, 574, 575, 576, 577, 583, 584, 587, 588, 590,591, 592, 601, 602, 604, 608, 612, 613, 614, 622, 624, 632,636, 642, 648, 650, 654, 656, 657, 659, 661, 663, 664, 666,673, 675, 676, 677, 678, 679, 680, 684, 689, 690, 691: n = A,T,C or G
  misc_feature 692, 693, 698, 700, 711, 714, 718, 719, 721, 725, 726, 728,729, 732, 733, 734, 737, 738, 739, 741, 745, 746, 751, 752,757, 758, 762, 768, 770, 774, 775, 776, 779, 787, 788, 789,794, 799, 802, 805, 806, 809, 810, 811, 813, 815, 817: n = A,T,C or G
  misc_feature 821, 822, 823, 825, 829: n = A,T,C or G
atgnnntnnnttcgttnttcctccacagtttatgngtanananattaatatttacntcccatacatnaatgtntctatatgngtatgatgngatccgataaccnttatantgtatccatcctcacancgcgatntanntnttatnanggtcnctnacgaacatgctncatagnnntatgtntataancnttctnngtgatnagtggatngnctanggcncntgnacnancgggngggnagttttttgtatcnganataaatatgcgacgttcnntatatgtangtntaacatttgtgaacgtanancntntaanacnctatngantctcnnnncnatggnnncananntnntaaccnatnaccctttctntttcgnacatgtnnncgcatnnnttnttnnacctatnatngnnanngaatgnatgatntnntnttncnntnttnnngttttcananactcanttatnncatngccnannactcatntcnntgtaaccnctattnncntccnnantanncntntctgatncgagtnnnnncnntttnnntngtttctggccanncanncnntnnnnnntgatanncgnnannnccacgatgnntnaagntaannnaataaaancngctgcctnttgntatttntggaananttcncnntntngnncnaattgangnnnnnnaganccgcnnnnnagatnantcgatttaccnttncttnnanatannannttnnncannnanttgnnctganntgtgnnaaanatgctnanacannnccnatttacannnctatnttacnacntannaannnangnancacnnntncaan

SEQ ID NO: 8324 - DNA, 1341 bp, Homo sapiens
  misc_feature 1, 3, 4, 6, 7, 10, 12, 16, 19, 20, 22, 23, 27, 32, 33, 35,37, 42, 46, 47, 50, 53, 54, 55, 57, 61, 62, 70, 72, 73,75, 79, 81, 84, 86, 89, 91, 97, 99, 100, 107, 110, 120,121, 122, 124, 128, 138, 144, 150, 154, 157, 158, 161, 162: n = A,T,C or G
  misc_feature 165, 166, 168, 170, 172, 179, 181, 188, 191, 192, 193, 196,198, 199, 201, 202, 207, 209, 211, 212, 213, 217, 218, 230,231, 247, 250, 252, 254, 260, 262, 269, 271, 275, 277, 278,284, 286, 288, 296, 303, 310, 312, 318, 320, 327, 330: n = A,T,C or G
  misc_feature 334, 337, 339, 348, 353, 356, 358, 364, 365, 366, 367, 371,373, 379, 380, 386, 390, 397, 400, 402, 404, 406, 410, 416,423, 437, 443, 445, 448, 451, 454, 459, 468, 469, 471, 473,476, 478, 480, 491, 502, 510, 524, 543, 551, 566, 571: n = A,T,C or G
  misc_feature 575, 577, 582, 584, 589, 591, 596, 600, 601, 619, 625, 629,630, 638, 641, 646, 649, 655, 658, 662, 670, 672, 673, 675,683, 684, 687, 693, 697, 698, 714, 715, 717, 720, 721, 725,726, 727, 741, 742, 748, 750, 753, 757, 760, 765, 766: n = A,T,C or G
  misc_feature 767, 772, 773, 777, 778, 782, 787, 788, 789, 791, 797, 800,804, 806, 808, 822, 823, 824, 825, 827, 839, 844, 845, 846,852, 854, 855, 858, 871, 872, 879, 880, 881, 884, 887, 890,893, 894, 895, 900, 902, 904, 905, 906, 912, 913, 914: n = A,T,C or G
  misc_feature 919, 927, 929, 933, 934, 940, 941, 943, 953, 955, 962, 964,965, 966, 968, 969, 978, 979, 980, 983, 990, 997, 999, 1001,1003, 1008, 1010, 1015, 1018, 1020, 1026, 1033, 1035, 1040,1049, 1054, 1055, 1059, 1060, 1061, 1069, 1076, 1077: n = A,T,C or G
ntnncnncanantttnccnnanncgcntattnntntntgagncctnnctnttnnncnatcnnacagttgncnnantctnanagntnttncnaattcntnntctgctntantggggggggnnngngtanataataattntaattngtaatntttnatnntgnnacnncngncnaaggttncnctcattngtnnngtntnntnngattngntnnntcanncctttgtcatanngtgactgcggggtgtncantncncctcgntnatctggntntttnannactctngntngctttgtnattctgntatgcancntaggantnaggagtnacntttntcnangtagatagnttttnacntngtcatnnnnagtngncttatnngatgtnttanatcgtcntcntnangnaaancctctncgtgaanagctttatcgactnctcttnanatntcngtntattnaaatcttgnntnantcncnangatcatgactntcacgcgaaantatatgtncatactcatataanagatgtgtgacgtgcgatnatactccntcgcgtgatgtttanccacnacananactancncagcntntattnagcnnatatataagtagtatcanccatantatnntgtttatntcnatatnacnaataantantctnctggaacntnngngccaaatnnctntgatgntacnnccatgtaatatgtctnntnctnnttcnnnacgtctttttatannagttgncnttncgantantgtgnnnctatnnacgnncganatatnnncnatgagntancgtntntntacgcacatacacnnnnanaatagagtcacnctgcnnntacacntnngtntacggatcctatnngcgagannncangtntangannncgttntncnnnttcgtnnntaacntattgtangnagcnntccatnnangatgatacancnttgtatnannngnntcgagtgtnnntcntacatcnagacgtntntnanttagncntctcnatntngtacgncgccgtntnattgngacctctcnatctnngagnnngctctccnccgtagnnnatantatntanatttgcgtacataatcttgtntactgntctancgcnnnntgaccatatcttnngannatgagatgtgnnacnntgttaacgacncgacgcncntannagagnttgtnatnatagtanatngnttagtnnananantatnnatgtaganactncnccaccnccatanatagtanatacgctcannattgtgtcatcgtacgagaaatganagangttttttnnagacgatnanagtactcggangnantgngg

SEQ ID NO: 8325 - DNA, 727 bp, Homo sapiens
  misc_feature 4, 7, 12, 655, 714, 716, 722: n = A,T,C or G
accncgntcgantcggcacgaggcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagcttgcagtcagatcaagaaactgaatactgccagcatctcagaagccatccatgtgaccccttcaagtcattattctttctgggaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattcttgngcaattttttcttcaaaatggctttactttggttttaaaatgaccttcaaaataactgncnaaacancattt

SEQ ID NO: 8326 - DNA, 825 bp, Homo sapiens
  misc_feature 4, 8, 41, 184, 189, 195, 200, 202, 223, 228, 238, 252, 263,279, 283, 298, 300, 304, 305, 319, 321, 330, 338, 341, 342,344, 346, 362, 368, 373, 375, 377, 378, 381, 388, 390, 392,404, 409, 436, 442, 445, 446, 453, 454, 459, 468, 490: n = A,T,C or G
  misc_feature 495, 511, 515, 517, 527, 528, 530, 539, 541, 549, 552, 554,562, 601, 602, 608, 615, 619, 644, 645, 650, 652, 658, 663,671, 676, 678, 700, 716, 718, 726, 727, 734, 736, 742, 749,757, 760, 764, 765, 778, 789, 792, 794, 795, 797, 807: n = A,T,C or G
  misc_feature 818, 823: n = A,T,C or G
accncgancgaatcggcacgaggctaaccttacacacttgncctgtgcctttgttgtcgtatccctatgtaaataccttctccaccttcccattccttcatggatgacttcccagaccttcccactcatcttttgaatgtgtttattgctgacttggcaatgcatcaaaatctttttttttttnggccncaggtnttacngntttacagggggaatcccccangaaancgtaaaactntttgcaacttatgncacacctgttnttcaagggcaaggatnattngcggctatagttttnangccnnctaaagtccctttnanggtcatatncatagcanaanncncngggataataattattnaaaaangactnanannggncaaagtngncncaggaaattccnaaacnctttaataaaaaactggaaaaataaangttggngannacctatnnaaccnctttaaggncccgagtaatttttttttttcnccggnttcccccttccatggncttntnaaaggaaccnngngaaaaaggnanccctcccnttntnatttaaantaaaaaattctttcccttttggaaaaattttaaactttnnatttcnggggaangggnaaggaaaaaaaaaaattttgaaaanntgtcnanggtttnacccntccccttnggganancaagattttttccctttttttngggagggtctttttanantttaaccnnggggccntnctaaanggacatnggggaaancanacanngggttttccttgnccaaaaaaaanccntnncnttttttaaantttccgggggnggcanaa

SEQ ID NO: 8327 - DNA, 736 bp, Homo sapiens
  misc_feature 1, 6, 21, 26, 72, 100, 148, 149, 150, 185, 186, 235, 243,260, 309, 329, 352, 353, 396, 452, 455, 465, 477, 484, 496,515, 522, 526, 534, 535, 555, 559, 572, 578, 579, 586, 595,613, 619, 626, 631, 641, 644, 645, 646, 649, 663, 667: n = A,T,C or G
  misc_feature 675, 695, 700, 701, 706, 711, 716, 722: n = A,T,C or G
nccccncccgattcgcacganctcantctcttgacctcatgatccacccgccttggcctcccaaagtgctgngattacaggcatgagccactgtgcccancccctcccttccttgtttttgtaaaataaagtcagagaaacttttccnnntatagtcaactaatacacattgatttgaaggagtnnaaactgagggagtttacataaaataacttctctgtgaagtattagtganatgatcangcctggggtgggagctngaagagaggagtggataaagcagtcaaggtcaaacaggagtgagacagngagcaggactgaaggcacangtgaaggtgaagctgctcatgtnntttttctcccacagcaacacgcatgtatatagctttgaagcangaacagaaaaaaaatagattacttaggttgatccacctgaactaagcaggtattgnggncattcattgnggagaagcactncagtganagaggtgagtanatatggtgagctaacccangagtcanagcntatgtgannctcggagagaactgaacagntcanaggtcggttgccngaaacnnaggaaanccgcaaggnaagctgggagagcggtcncatggnatttacnctacncagggaagcnaannnaancagggccaggctangctnagtgggantcttcttccacggtccatgncctgnnccatnttaanggagntgcaangttcattacgacga

SEQ ID NO: 8328 - DNA, 731 bp, Homo sapiens
  misc_feature 4, 8, 288, 450, 514, 668, 679, 686, 693, 703, 705, 707, 717,729: n = A,T,C or G
accncgcntcgaattcggcacgagtgagctgggagaaggggagaaagtttgtgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaaaaagagaaaacatatgcgttgtattttgcttcaattatnaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggntgcagaatgaaagagaagatgaagtcaagagattggtttagaggctctagcagaagcttagtcntatttcaaaatgatcaaatatcaagaaaaattctgagctgcataacttgtataaagtaattttcagtgatttttttcatgggtatgataaaagaactggattagcagaaacttttaccctgaatcaagatttaatttttcttttgacctcattntaaggatatcnggacatngggagcnaaccgatggngngnctgcctcagngcttgattttanct

SEQ ID NO: 8329 - DNA, 840 bp, Homo sapiens
  misc_feature 5, 18, 20, 21, 22, 30, 33, 34, 35, 36, 37, 38, 39, 40, 41,42, 51, 52, 53, 110, 115, 181, 489, 525, 546, 552, 564,579, 585, 606, 631, 638, 646, 647, 656, 658, 660, 662, 668,669, 671, 674, 676, 677, 678, 679, 680, 688, 689, 694, 700: n = A,T,C or G
  misc_feature 715, 718, 719, 721, 722, 725, 729, 736, 743, 744, 745, 748,762, 763, 767, 773, 777, 780, 785, 791, 792, 800, 805, 832,834, 835, 836, 840: n = A,T,C or G
ttgancctttcaactccngnnnttttgcangannnnnnnnnnaggagtcgnnncgagggtaaaaggtggagaccatcattgtggaatcttgtattttctattaaggtttntttantcctacaaacttgaacataaatttttaatatttgggaaggaacattcactgaagaattgataatanactaaaaaatatagctgttatcaattaatacatgatctgtccttgaacacatattcaccattatgtaaacctcacattatttcagcttatttattccacagataccaatagacatgttttcacattgtagcatctcccaaatcaaaatacttctaaaaattggtagtatgtcggccgggcgcagtggctcacgcctgtaatcccagcactttgggaggccaaggtgggtggatcacctgaggccaggagttcgagactagcccggctaacatggtgaaaccccatctctactaaaaataaaaaattanctgggcatagtggcaggcatcttgtaatcccagctncttgggaggctgaggcagganagtccncttgaacccagnagggtggagtttgcnggtgancccaagatcatgccaggcatnccaaccctggggtgacaaagaagcnaaaactntcaatctnnaaaaacctnanananctttcnntnctncnnnnnaaaaaacnncgaancccttncaaaaacttataggnganncnncanttcnccgttanaaccccnnnctngactaagaattccnnctgnttggantttnggnaccancccccnnccttgaancgccnggcgaaaaaaaactgcttttttcgggnannntttn

SEQ ID NO: 8330 - DNA, 728 bp, Homo sapiens
  misc_feature 19, 22, 603, 627, 628, 632, 636, 637, 644, 652, 654, 655,664, 667, 673, 674, 678, 688, 694, 696, 701, 702, 703, 713,714, 717, 721, 723, 725: n = A,T,C or G
acctcgattcgaagaaaangangaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgccagatttatcaagtagaggctggactccctctgtgtcctgcccatggttgcagcagccatgggcctatgagcggtctaactgtggccaagtatggtgacctctatttttctttatattgactctttgnatttcaataaatatattttaaaanngaanaaanntccatcnaacccccncnnccccccccnccntcaaanntttngggggccttnttcccnanacccnnncttataaaannccntttnancntca

SEQ ID NO: 8331 - DNA, 733 bp, Homo sapiens
  misc_feature 8, 604, 632, 645, 651, 662, 672, 682, 683, 687, 690, 702,704, 710, 714, 723, 724, 725, 728, 729, 730, 731: n = A,T,C or G
accctcgntcggtcctcctcgtgggcctcccaaatgctgggattacaggcgtgggctcccgtgaccagcctggaacgtgctgatgagcctctttttctcctgaaaccccggtgggaacagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaaaganctgaaaaaaaaaaaaaaaaaacctcggncctttaaaaactntagggngtccttttccnaaaccccacncctgaaaaanncccnttngtgagtttgggncncccccnaccnttaaaaacnnnccnnnnca

SEQ ID NO: 8332 - DNA, 823 bp, Homo sapiens
  misc_feature 1, 40, 43, 49, 56, 73, 74, 77, 83, 84, 87, 89, 94, 96, 104,106, 107, 109, 121, 123, 131, 148, 159, 187, 202, 212, 213,217, 220, 240, 243, 288, 290, 296, 310, 343, 400, 425, 430,435, 462, 473, 478, 483, 492, 499, 505, 521, 525, 532: n = A,T,C or G
  misc_feature 533, 541, 548, 554, 559, 564, 576, 577, 584, 585, 586, 588,592, 593, 596, 599, 603, 606, 609, 618, 625, 626, 640, 647,650, 652, 658, 659, 666, 668, 670, 671, 673, 694, 702, 703,720, 725, 728, 729, 732, 745, 752, 753, 756, 762, 764: n = A,T,C or G
  misc_feature 769, 771, 778, 782, 785, 788, 790, 797, 800, 804, 808, 816,818, 820, 822, 823: n = A,T,C or G
ntttttggggggtgtttggatacattagaaattactgctnganaaaaanggtcctngagtgggtttttaggannaanccgtannctnancgtgntncatatttncnngngccctacaccancnctagtggnattgtcacttcatccgnctggatatcanaacgtgttcaggaacactgaagttcatnagagaaattcacaanctctacgaanncacngtnatttctttttcctgggctgnggntggactgtggatgacaccactttccaggcccttttcttggaggcngncaagcntaaatctgacctanaacatttcatgctggttcggagaggagacgtanatgagttcaaaaaagctttgagaaaacatgctggataaggggattaaagtcatcttntatggagatgactattgcccgatcnttcanaatantttcaagccgactgaccatgtgagatntccacaagggngcacnttatnggatggcgngagaaangtcaantttaatggtttatccngctngcacacnngtgaaatnaagaagnctgttntacantgaancccacctaaaannaaatttnnnanccgnntantanccangtntgntaagggtcntattacnngaaatgtgtcttanacaaagnaancnttaccnngaacccnancnncnatttccccaaaaaaggtgaanccaaattnnctcccaaggtttttaangggcnggnngtnccaaaaaaagggngggaaanngtntgcaanangttantncccttcnattnacnccntngggttcnttngaanattnccgggccncntngnn

SEQ ID NO: 8333 - DNA, 729 bp, Homo sapiens
  misc_feature 2, 8, 12, 16, 387, 597, 660, 666, 723, 728: n = A,T,C or G
cnccccanctanctcntggtgggcttcaaatttactttctcccctctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagnatatcagctaagagagtttagttctaataaaaatcaggcttcccaggaacttgattgcttgctagtaattaaggggtttgccttttaggctgtcaaaacaaacattagtaaccagaacctgggagatagcttcttcagcaaggaaaagtcacaggtttggggacggtttacgggaggggaaaaggttgatataataatgccaggttgctnctcgggtgtcgatctagaaacaattttacagaacttcagttgtaactcaataaccttacttgnataatnggggctggccatgttgtggtttaatcagtggctctttttaaaagaaatttttttggnaaacnt

SEQ ID NO: 8334 - DNA, 1200 bp, Homo sapiens
  misc_feature 12, 13, 14, 15, 20, 21, 22, 23, 25, 28, 30, 33, 35, 49, 56,59, 67, 69, 72, 78, 79, 86, 93, 97, 101, 108, 113, 114,115, 116, 121, 122, 127, 133, 135, 152, 158, 164, 167, 168,173, 174, 178, 180, 187, 188, 194, 198, 201, 203, 205: n = A,T,C or G
  misc_feature 207, 211, 214, 215, 216, 225, 245, 249, 252, 256, 259, 263,275, 284, 290, 291, 295, 301, 303, 304, 306, 311, 314, 317,319, 324, 325, 327, 328, 333, 334, 343, 351, 353, 356, 362,367, 370, 373, 377, 381, 383, 385, 392, 394, 401, 410: n = A,T,C or G
  misc_feature 413, 415, 417, 427, 438, 440, 441, 449, 451, 453, 454, 455,459, 465, 469, 472, 486, 487, 491, 492, 505, 516, 517, 521,524, 525, 531, 551, 553, 554, 557, 562, 564, 566, 567, 568,570, 574, 575, 577, 579, 582, 598, 599, 606, 611, 614: n = A,T,C or G
  misc_feature 624, 628, 632, 633, 644, 645, 647, 649, 654, 662, 666, 668,682, 691, 694, 697, 699, 702, 705, 706, 718, 722, 725, 726,728, 731, 734, 739, 743, 744, 756, 761, 765, 766, 771, 774,779, 784, 787, 789, 796, 797, 802, 805, 812, 816, 817: n = A,T,C or G
  misc_feature 819, 823, 834, 840, 844, 846, 848, 850, 852, 853, 856, 866,869, 874, 878, 884, 895, 896, 901, 902, 904, 907, 909, 910,913, 923, 928, 933, 934, 938, 943, 949, 951, 952, 953, 955,957, 961, 962, 964, 966, 968, 974, 975, 980, 982, 991: n = A,T,C or G
  misc_feature 995, 997, 1010, 1011, 1019, 1020, 1027, 1033, 1037, 1048,1049, 1050, 1052, 1059, 1071, 1074, 1077, 1078, 1085, 1086,1087, 1088, 1095, 1101, 1102, 1120, 1121, 1127, 1130, 1137,1142, 1143, 1144, 1155, 1163, 1165, 1167, 1172, 1173: n = A,T,C or G
aagggaagaggnnnnggggnnnnanagncnggnancgcaagagaaaaanaaaaaanagnggaaacgncnacncaaaannaaaatgntggtcgnggcnaaancacccanacgcnnnnacagnnaccanacaaangngcccacgaggccgcggnggtttnttacgnacnncccgnnaaancncccaccnngcggcngcgnccngngncnacgnaannnaagagaaangggccgagaggaaccggtanggcnacnaccnaanaagnacagggaaaagngggcacacnactccnnaccnggaaanannangcaanagngcncngacgnncnnacaanncaactcagngaagcaancnagnccccgngacancanaanaccnagcntncngagacanancgggaancaacggacnccnancnaaccaacaantgactagacangnnaaaacccnangnnngacnccgacnatcnggnagcgcgggatggcnnacanngaagtaccgccancaaaaatgganncctnacnngggccnggacgcaagcaggcgggaangnntgngatananannnanacanngncnggnagggcaaaagggcgcnnatggaanaaccngangcccagacanaccngcannaccagggtcgnncnanacatnacggccanaacncncacggcggcacgcnaaaaacganagncancnacngcnnggggagcacgancagnctnnanganacngtgangaanncaccacaccacnacctnaganncagcntancaggnaagancananccccccnncgaanagnccaaggncacnncncgcncacaacaggcncgcggngcancngngnanngangccaaacganctnccccncacnaccganacccgccggtnnaggannanacncnnatncgcaggcaanaaaanataanngcanacccncccgantnnngnanactnncncncnaaacanncgcgncnccgagtcgncgtnanagtataacgcgcnnaggacgcnnacagacngacatngtangccaccccggnnncntgactangcagacgacccnccnacnnacgcgcnnnngatatcnccgccnngcaaacgtccaacacccnncccctncancacgccngtggnnncgccccaccanaagaccgncncncccannnancccnncgcgaaacacgagnggngn

SEQ ID NO: 8335 - DNA, 735 bp, Homo sapiens
  misc_feature 6, 9, 521, 556, 578, 583, 584, 601, 604, 627, 628, 660, 662,663, 674, 677, 680, 683, 697, 705, 715, 719, 724, 725, 728,729, 730, 732, 735: n = A,T,C or G
ttaccncgntcctcagcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtgaagcagcagctgcacgtccgaggcttggggaggaccaggactgtgtgggtttcttacctgcctgaccacctnaaggaatcttccacctaatgcaagcttttttgcancttttggggtcatgctttttancaagnntctcccttgcgaacctnccnataaaatttggccccaccggggnngatttttacaaaaaaaaaaaaaaaaaaaactncnnccctttaaaanttnttnggnggccttttcccccnattccccnccctttaaanaaancactnntgnnngnttn

SEQ ID NO: 8336 - DNA, 738 bp, Homo sapiens
  misc_feature 8, 464, 550, 556, 573, 581, 614, 635, 652, 670, 698, 703,714, 718, 723: n = A,T,C or G
cacctcgntcgaatcggccgaggtttagaaactgattctagacatttaagttcccagactaatgtcacagaagctaatgaattgcagaggttaattggaagcctggtcttaacactcccaggttatcttaatgagttcatgaggatggcatatggataatgcacttcaaagggtgttgtaagtattaactaagttaatacaggtcaaatgcatatattagcactcaatgcacggccattgatcaataaatgctagtggttctgatcagtgagaatctaacctctgcttaaatacctttagtcatcagcagcttccactccctgagtaacatgttgcatttcttgatcaattatatttttacagaattcttcctttactgaagttgaaatcgtctccttgaaatttctacttggtatggcctctctgtttgctacacaaataaatttaatcctaattttatctancttattttccaagcataaccacaccaatttcattaaatgattcctcatgttggcatgacttaaactccggtcaccatcctatttgnttttcncaaagagcttccagttngactgctnctgtgaaaatgtccatctattaatggaaatggntttttctaaaatttacaagancttccccgttgtattgnggtacaagggttaaaaanagttttctggagaattcctttgactctnttttncccaaagtttnttgnggggncctttctcttttcct

SEQ ID NO: 8337 - DNA, 721 bp, Homo sapiens
  misc_feature 5, 13, 603, 649, 715, 721: n = A,T,C or G
caccncgttcgantcggccgaggtattcagtaagtaccaactatggtgctaacgtgagttcgatacgaaaaaagctgagattcatctatatccattttagaggaaagaagtgctatgacctttccaaactttcatttctctatcccaaagtctcatctaaacagattttactactttatgatctatgtttaaagtccttgggataaaaagaacaaacccaagaatgaggagtcttacttctacacttttatgatttcttatattggcattagacataaacatgtctgagaggctgtctggtccaactgtctctggtcacttcgatcttccaactgccaactcccaggccatgggatcacttcctcctctaaattctacctactttttataccattcaactggaaatttaccccacacaagatttttggcatccctcagatattgttatataactggaaaagggcaggaaatgtggattataattttttgcaataccgggagtggcatacatggagctttgcaccattgctgataattgatacacatctgattaatgtataaattaaccaaacagtactgactctcaagttttcagaagtgtangagtctctaaatgggtctgaagataccatagatgaaactttcattnacactgccaatcgaaaaaaaaaagccattgccaacataatccaatttttcctcaaaagattttggnaatttn

SEQ ID NO: 8338 - DNA, 743 bp, Homo sapiens
  misc_feature 1, 4, 9, 12, 21, 23, 26, 47, 160, 194, 237, 300, 328, 348,356, 359, 361, 376, 380, 387, 398, 400, 409, 411, 413, 427,479, 480, 521, 537, 563, 564, 573, 579, 584, 592, 597, 609,618, 633, 643, 644, 651, 659, 662, 663, 669, 680, 687: n = A,T,C or G
  misc_feature 698, 705: n = A,T,C or G
nccnccgancgnttacgtgangnatnacttactgtggaattgcattncaaactgggctgaggtgggatggtggtggtagataagaggccagctctttatttcaagccaatacatgttgcaggctatggacacaaattcatatgaacctgttagaatgcanaatagccccatgttaaactgtaaacaccttatcntcatcaccattcatataaattagttgatttcatattttgcgtntgctttgtgaatgagaaaacctgatacttagcatcatcttccctaaatacagtcctgaccaancaaataacagaaaagccttctacagtanatattttgttttttagaatntatcattnacntntttaatttaatgctncaanatagatnatacacgtccncnaatttgaangncnaaacaatgtaaaanggtatatgcagagaagtcttattcttacccatgttggtaaattatatattgnngaccccacctaccccacccaggtaactatatttattagttntcatttattccttccngcggtttgtttattgccaaattttanntaaaagatnaatttntttgntcataatntctgnctttttctttantagaaaggnagtatactatttacntcggtctgcnnttttttnttcgttgncgnnggtttnttggtttttgncttttgnccctttggagnaagggantcttggttttgtctttcagcctggactgccatggcccc

SEQ ID NO: 8339 - DNA, 773 bp, Homo sapiens
  misc_feature 4, 7, 13, 22, 76, 449, 493, 562, 574, 575, 584, 591, 598,606, 613, 621, 642, 662, 700, 715, 732, 752, 757, 760, 764,766, 768, 771, 772: n = A,T,C or G
accncgnctcgantcgcacganggatgctgagatgatagtccttttgaccaggatgtctcaagtatccaagcccanaaatcatctcttctaggctgaatcaagatggtttgcataagagaccatgcagatgcacgtctctgctatcttacattaaaaatgcagaatggctcacctgccctttgttgtcatatgttatatagaaaaacctatttgcatgagaactgtcacccacagttttgggtagggtcagtgtgtgccactgagcaggaacgccgagggccataacctgtctaatgtattaaattctcaggaatcgggattaaaagttaaccagccagcatcctttgctataaggttgaatggcgcaaaaggcaagattgatgcaaaggtgcacagcccctctggagccgtggaggagtgccacgtgtctgagctggagccaggtgancaggaagcctgctggggggtcccagcaccagcacttttcagcanaatgttcctgtaaatgtgtgtcccaaggggagggctgatcaatttcattactggcagtgaagcctttgnaattcccttttnntggtgccanaatattngttattnaaattaangggtttnaaaacatntgcccaaggggataagggganaaaccccttttatgccttanggaaaaaaaaaggcccaattcccttcctttcctttttntaaaacaaaatggcnttgggctttgggtccanctggccctttaacccttganaaggntcnaagncntncanna

SEQ ID NO: 8340 - DNA, 722 bp, Homo sapiens
  misc_feature 4, 7, 526, 549, 619, 642, 668, 677, 682, 694, 697, 700, 706,719, 722: n = A,T,C or G
accncgntcgaattcggcacgaggctgggtgcatgtgctaccacacccaattatgaatttcatcattagtttcttagtagagtccacatgtcctcagtagtaagttcatcagtgctaaatatttgaaggtatttctactgttttgtaaaagtaacttaagcctacctggtctgctatcttttgagtatttatactttctacgggcttgtaggtaaacataaaaagagaaaaaatatcccaataatacagtttttaaccttttatgataaagacatgcttagaattgctgttaagccttctgagatttaaccactgaaactaagtaaaagacaaagcacttaggtaaagcttcattcagtatccattcacccaatactggtttgattctagggcctaggaaaataggactgagcaaagcccttgtccagatggaacttatgttttagaggggaaaacaaaccataaaaaggtaaacagtataaaatcaggaaaggataaatgtatatgaagaatcaaaatgaggacngtgatgggggataagaagggaangtttttgaggagagcagagcaatgatgtaaaagccagacacacagataggggaatagctttcctactaangggatgggaaataaaagctgagntttggcttgaggcctccaacattganaattgctanaactntgggaacaaggntanagnggaaanattttagccaagntcn

SEQ ID NO: 8341 - DNA, 746 bp, Homo sapiens
  misc_feature 4, 7, 555, 578, 606, 642, 676, 708, 726, 727, 729, 737, 745: n = A,T,C or G
accncgntcgaattcggcacgagggtggagggaggcagccggcatggcatggtgaggaagggccatggaagaggacagaacctgtccacggagtcaatgctgaggaaggaagacggaggatgaggccagtcaggtttttcgtggtggcagtgccttatgtttttatcgaagtgtatattcacacagaaaagcacatctcccaggatcctgagagagcttgaaccagaccactgtggacacggtggccacccgtcaccactacccttcccaaggggagacgaggagcaagtaggcttgagggaaaagctgcacaggactcgtgtcttgaaatgtctaagacgcatgtcagaaatgcaggtaagggggggtgcgggtgctcgcacctgtgatcccagcactttgggaggctgaggcaggaggatcacttgagcccaggagttcaagactggcctggacaatataacgaggcctcatctctataaaaaaaattaaaaattagctgtgccccaggtgtgttggctcacacctgtaatcctggcactttgggaggccaangcaggtggatcacctgaggtcangaattcaagaacagccttgcccaacatngaagaaactgcattttctactaaaaaataccaaaantagaccgggcgttggtggtgcatgccctgtaatnccaacttcctaagggaatcttgaggcaggganaaatcactttggaacccnngnaggccggnaggtttcnc

SEQ ID NO: 8342 - DNA, 844 bp, Homo sapiens
  misc_feature 4, 7, 189, 206, 223, 228, 230, 237, 242, 244, 246, 247, 250,251, 259, 261, 266, 267, 271, 292, 293, 296, 301, 307, 321,322, 325, 330, 331, 332, 336, 339, 341, 349, 350, 353, 359,361, 367, 368, 369, 375, 382, 398, 404, 425, 432: n = A,T,C or G
  misc_feature 434, 435, 436, 443, 444, 452, 454, 456, 468, 471, 477, 485,488, 489, 500, 504, 507, 508, 517, 518, 520, 521, 523, 526,530, 546, 551, 552, 569, 570, 572, 574, 584, 586, 588, 596,597, 599, 603, 616, 625, 627, 628, 637, 639, 640, 645: n = A,T,C or G
  misc_feature 646, 647, 654, 658, 660, 673, 676, 679, 680, 681, 686, 687,694, 697, 698, 701, 704, 713, 717, 724, 731, 742, 745, 751,752, 753, 754, 755, 764, 774, 775, 776, 778, 784, 788, 796,806, 821, 826, 827, 832, 833, 834, 842, 843: n = A,T,C or G
accncgntcgaattcggcacgagagggacttcgttgtaatgggttttgctgtaagtctaatggcaagatcaccattagcaaatggaaattacatttgaaagccattaggcctctagaactatagtgagtcgtattacgtagatccagacatgataagatacattgatgagtttggacaaaccacaactngaatagtctgcctcacnaagccgctttctcggcnactancncgccgcncgccnangnnagnntcccattntnccccnngttncccacatttccctgaattaanngcnatttncttatncagaattgcacttnnagnagcannngganccncnggcgtctnnccngctacntngtggannnctgccnctctccnaaaccgggctttaccnccccgnggccccccttcccttttctcntttaccngnnntcccccnnctttgatngnanccccttggtacntcnccaagntgttggcnccnnaccaattggancccncanngtcgcaccnntnncnctngcantttttgacccacttcntattnnaaccccacgttcccttnntngncccccgcganananccccgctnncngggncattcttccccanggttggccnannaaaaccccntnngcccnnntcggccntggntncgcggtctaactnttntcnnnaatanntcccctnttnnggncancttgccaancccnctctccnttgtccnggttccatttnccnctcggnnnnnatctcccanacatttggcnnncnttctcngaanagctctcncacactctcntaccgcctttaatcncctanncaacnnnagcccctnnt

SEQ ID NO: 8343 - DNA, 750 bp, Homo sapiens
  misc_feature 4, 5, 8, 13, 687, 698, 736, 747: n = A,T,C or G
accnncgntcgantcggcacgaggtccattcttataaagggaacttctagcaaacctgcccagccctttccctggagggaaacattatctgtattatcctaaagagcaaacaaatctgctcttggttccaaatagagacactttatctttcaagacaatgcctatgcaaatatcttagaaaagatagtctaggagaaacaagctgccacaagaactgcaaaaatgcaaacagcctataaagaattgtctcccaacatattgatcttttatattattctctttatgcgttgtcataaaaagttgagagactgcaatcctgcacctgaaatcctcatttcccttcttttcagtgttctttatctgatttttcaaaattcatatactatttgtacagtttctattgaacctcacctgaattccagttttatttactatgttaaatgattcattcaacagctatttactgagtatatattgaagagatagctgaactcccatgtttgttgcagcacaggtcatgatagccaagatttggaagcaacctatgtgtctatcagcagatgaatggataaaaaaaatgttgtacatatacacacaaaggtacgattcagtggatcaaaatgaaatggagatcttgtcatttgcaaccaacataagaatgggaatgggaagtcattatgttaaagngaaataagccnggccccagaaaggacaaaccattggcattaattcttcnctttattcatnggg

SEQ ID NO: 8344 - DNA, 1400 bp, Homo sapiens
  misc_feature 1, 2, 13, 17, 18, 27, 29, 47, 49, 51, 53, 57, 60, 64, 65,88, 95, 105, 106, 119, 124, 126, 127, 143, 154, 159, 171,187, 191, 196, 199, 225, 238, 240, 253, 255, 264, 285, 289,291, 293, 294, 299, 300, 303, 318, 321, 329, 339, 344: n = A,T,C or G
  misc_feature 346, 349, 353, 356, 361, 362, 368, 371, 373, 385, 390, 393,394, 401, 409, 413, 418, 420, 421, 427, 430, 435, 436, 437,438, 442, 443, 445, 446, 448, 449, 459, 461, 467, 468, 469,476, 478, 480, 481, 484, 486, 487, 488, 497, 498, 499: n = A,T,C or G
  misc_feature 508, 510, 511, 516, 518, 523, 524, 528, 529, 530, 531, 533,536, 537, 538, 539, 543, 544, 546, 548, 550, 551, 552, 554,555, 557, 566, 575, 576, 582, 585, 588, 590, 595, 596, 597,601, 603, 606, 608, 609, 610, 611, 613, 614, 615, 618: n = A,T,C or G
  misc_feature 619, 623, 624, 628, 629, 630, 637, 639, 641, 645, 646, 647,648, 652, 653, 654, 656, 661, 665, 670, 671, 672, 676, 678,681, 684, 691, 694, 697, 699, 701, 703, 704, 710, 711, 712,714, 719, 720, 722, 724, 725, 728, 737, 739, 748, 752: n = A,T,C or G
  misc_feature 753, 754, 759, 760, 764, 766, 767, 777, 781, 786, 787, 788,789, 796, 802, 804, 806, 810, 813, 814, 817, 820, 826, 828,832, 833, 839, 840, 842, 844, 850, 851, 852, 856, 857, 858,860, 861, 862, 864, 867, 869, 873, 877, 882, 883, 890: n = A,T,C or G
  misc_feature 892, 898, 900, 902, 905, 907, 910, 911, 912, 918, 919, 926,929, 933, 935, 941, 942, 945, 964, 967, 974, 976, 982, 987,1002, 1003, 1005, 1006, 1008, 1014, 1018, 1026, 1030, 1031,1033, 1037, 1038, 1039, 1040, 1061, 1065, 1066, 1071: n = A,T,C or G
nnaaaaaaaaaanccgnnttgaatcgncnaaaaattaatggtttggnantngnagangantaanngaatttacatttttaatcgtatngtttganatggtttaanngggcgggggaagnatatngnntaattggaggatcccnaccaaacactnttcgngatgtaaggggngttgagaaaatactantganatggntanctataacgaaacatacattcatcccncctatctgttgtnantatagtaacatgnanatatcatanggggggggggggggggagttntctntntnntcgannctnaataggttcgtacgnttntagtggtntccatatacntgcananatnatcnttngtganntatgtncgngnaccatataagtnacatntcnntcacgantattattngagngtccncnnattacntangcgcnnnnaccnngnncnntagtaaatcnanacacannngcgtgcncnanngtnannnaaatgtagnnncgtgtgaantnncgccnangaaannaggnnnnantannnntatnnananannnanngntattgatgngatgattannatttantcnaantncacgnnnattntntangnnnncnnntgnngttnncatnnncccaccncngntgannnnaagnnngnacatngccnatgtnnnttcnangtngangataatnatngcntncncnnaattannngntgacnncnannccnacctgtttncnccgaagtgncgannnatatnnaccncnnttttatacancatngcccnnnnttgcccnagtatnanantatncanntgntgnggatgngnggannatgccnntntntaggcnnntatnnntnnntnaantntatncggnacacnnacgcatntntatatncnangtncnctnnnatatgnnataagantgncatntngtatcnntgnctaaatatacgaccagcanatnttgtctntntcactnacatntatcatagacgatgnntnntnaatatnggcntctatgantatnncnggcnnnncatatatattattgatcgcgntccnnctacnnagatatctatcgcgagntcaccagtgtctncnngaanattacatgcncncgncntcgtntannagttnatgcgtntatgtgagncgtncgacctcncgtgcnatntannganagancgntagtctnantatgtagtcanagtatatatcgtcgagntaggagcggaatatatgtanananacgctntntataggaanntcggtatncnncntnanatntcnacaacnnacaanttnctaangnatattctttcatgataatctngaatcgttaattatnntannanngnacancactaaatgatantangatnaannncgtaccnagn

SEQ ID NO: 8345 - DNA, 1045 bp, Homo sapiens
  misc_feature 12, 15, 20, 32, 39, 46, 50, 51, 52, 54, 56, 66, 67, 69, 72,76, 77, 87, 90, 93, 100, 106, 110, 113, 126, 134, 135, 141,142, 147, 148, 155, 164, 178, 182, 195, 198, 205, 209, 210,215, 220, 226, 230, 232, 234, 238, 239, 249, 250, 256: n = A,T,C or G
  misc_feature 258, 260, 263, 265, 267, 275, 279, 283, 285, 289, 290, 292,293, 304, 306, 308, 317, 318, 320, 322, 325, 328, 333, 340,341, 348, 350, 357, 358, 362, 370, 372, 373, 375, 376, 379,383, 384, 385, 390, 391, 393, 405, 414, 420, 438, 439: n = A,T,C or G
  misc_feature 440, 443, 446, 447, 449, 452, 460, 464, 465, 471, 475, 482,489, 491, 508, 520, 527, 540, 545, 549, 555, 556, 557, 562,565, 569, 577, 578, 579, 581, 589, 591, 599, 604, 627, 628,629, 633, 635, 643, 649, 655, 665, 671, 676, 682, 688: n = A,T,C or G
  misc_feature 689, 705, 717, 718, 724, 742, 751, 760, 769, 770, 772, 777,782, 789, 792, 796, 800, 809, 810, 811, 821, 825, 827, 828,829, 833, 840, 845, 846, 851, 855, 856, 863, 864, 875, 878,887, 888, 899, 911, 924, 931, 933, 937, 938, 939, 950: n = A,T,C or G
  misc_feature 955, 956, 958, 962, 964, 976, 987, 990, 993, 1013, 1014,1022, 1027, 1035, 1041, 1042, 1043: n = A,T,C or G
ggggggggttgntanacganacgagcaagtcnctaattnttttttnaccnnntnantattatcacnntnccnttgnntaagaaaatntantantcaaacnttttcntcancancgggttatagccntctttatnnggggtnntcttnntgcaccnataaaacangcttttttgtccantaanttttttttgtggngcntcttacngcgnnctgtnttggnccccanttanangncccnnccggggtatnnattatnanantantncntttttttngaanatcncntatnngnnaaagagaaagncntnattatctannananggncgnggganaacaaannggatgcnanattttgnncttnatttggtntnngnngcnttannntcggnnanagtgggcccgcnataacaagntatcanaatgccccgggaaccctnnntangtnntnttntaaaaganaatnngtcccncccngaaaaanaatacanantttgtgcctgagagggntaaattaaaccnctcatcntttcatacttaancaaanatantattcnnntaatnttntgcngccgggcnnntntataaatnanttttcacncacanactggtgcggggcgcaacaacannngggnancccactcnttattnaatcgntccatggganttgtgnaaaanttttanttgcgnnacataataaaaagtgnctatataatganncgctantgatagaatccggcgcgntttcaatantatatggtngccgatgtnncnaaaanatatngagaagnatntacnaggngtgggcccnnnaaaagggttnttanannnatantcttgtncaccnnatatnttcnncctggannaaaattattcnatngggcatacnntcgtttatacnccactggggttnaaaagaaaaatanttgacgntngtannnggccaaaaacnagagnntntttntngggggggggaangtgggcataanaanacnaatttttttcttttgttctnnacccaaanatacnggggggtnttaaannnat

SEQ ID NO: 8346 - DNA, 735 bp, Homo sapiens
  misc_feature 4, 5, 8, 13, 632, 656, 661, 667, 675, 692, 700, 707, 717,733, 734: n = A,T,C or G
accnncgntcgantcggcacgagatcatgctgctagtgttcccgctactagtgctccgttagttttaaatcatgttccaacttgaatttgaggtcttttgactttcgttggctttttgtcagggaaaaaaacctgttagggacagggtttcacaattccttttatatttccattcacatgtatttacaaacgtgtgcctggagtagtaagtacacaataagtgagtttccagctgtttttgtttcggaaacaaaaaaaacaaaacaaaacaaaacaaaaaaacaacggaaggtgaatggaattgtgtttgtaacattaaactgatgtttgaaaagtagttgggaaaaaaagcttaggtactaaggagggttcatccaacttttttttaaacgaaggacgtgttgccttagttcaagtttgtataaggtgctatttaatatgtattgaagacttaactagagcttacttatgaaaactgaaaataggggccgggtgcgttcacgcctgtgatccagcattttaggaggttgaggcgggtggatcacaaggtcaggagttcgagaccagcctgtccaatatggtgaaaccaggtctctactgaaaatccaaaaattaaacgggcgtaatggcangcgcctgtaattcccacttaatcngggangctgangcaacaanaaatcgctttgaacccnggaggcanaaggttncatgggcccnattttggcccttgcanna

SEQ ID NO: 8347 - DNA, 1047 bp, Homo sapiens
  misc_feature 10, 16, 19, 20, 22, 25, 29, 34, 35, 39, 45, 46, 47, 52, 55,56, 70, 72, 73, 74, 79, 81, 86, 92, 96, 98, 104, 108, 115,122, 129, 134, 137, 139, 149, 168, 170, 174, 176, 177, 178,182, 184, 189, 196, 197, 202, 204, 206, 207, 210, 214: n = A,T,C or G
  misc_feature 219, 220, 223, 229, 230, 236, 240, 242, 244, 245, 246, 249,252, 255, 267, 276, 281, 285, 288, 292, 293, 294, 298, 303,304, 306, 313, 316, 318, 321, 328, 329, 331, 336, 338, 340,349, 353, 354, 360, 361, 365, 368, 379, 390, 397, 402: n = A,T,C or G
  misc_feature 405, 408, 409, 411, 414, 428, 429, 440, 441, 446, 451, 453,455, 457, 459, 469, 471, 477, 481, 483, 486, 487, 491, 494,499, 500, 514, 517, 518, 520, 525, 529, 534, 537, 539, 540,541, 545, 546, 547, 550, 557, 560, 561, 562, 563, 573: n = A,T,C or G
  misc_feature 575, 576, 598, 603, 604, 612, 613, 617, 618, 624, 641, 642,645, 652, 655, 658, 659, 663, 669, 672, 680, 683, 687, 688,689, 692, 698, 700, 706, 708, 712, 719, 722, 724, 728, 729,732, 741, 743, 744, 746, 747, 748, 752, 759, 767, 769: n = A,T,C or G
  misc_feature 779, 784, 787, 791, 794, 798, 802, 804, 816, 823, 836, 841,844, 846, 849, 850, 855, 863, 869, 882, 883, 885, 890, 895,901, 910, 911, 913, 921, 928, 941, 946, 948, 950, 954, 957,959, 960, 963, 965, 969, 972, 976, 982, 988, 989, 991: n = A,T,C or G
  misc_feature 1002, 1004, 1006, 1007, 1024, 1027, 1032, 1033, 1035, 1036,1038, 1047: n = A,T,C or G
tttttttttngaattntgnngnggntctntaatnncccnggcgtnnncggcnagnnaacttgtataccancnnnttttncntcttntatgtnctgntnttgttngaancctgcanattgctngggggtnacttnttnantaaataaacncctttaccatggatttccntnatantnnntttngngtcanattagcnnattcncncnnacncctntttanntcncggctnngtattnttanantnnngtnggnggngttaaaaataanatgacgggnttttntccntanttannngtantgtanngngccgtgncancnttntttatcnnantttgntncntttttatancccnnttctcnnatgnagnatattggccancgaaatttaancctcttnttatntanccnncnttnttatataaattggnntttttataatnntttanaagtnancntngnggtttatatntntgttanaaangnggnntttnatnttaanncaacggcttgttcncgnngnggttnagcnccaanttnannnttcnnnttngtatatntannnntattttgttnanncccacctgcatccttttatacncatcnntttatagnntgcnnatatanggctattagagcacgtnnatntagtttnttnccnnccanccattnttntcccgctngtnttgnnnctnaccgcntnatgttntncccntcattantantncccnntcnttgtatttngnntnnnattnattttantcgtggcncnattgttactntgtgnggntaanaanaggntctntntgggttggatanttaaagncaggcacaaatgnataanttntnggnntgtgnaatttatnttttcnggggggctttatnngntcttngattntgcgtnccccttttnntnaaacccgnggggggnggaaaaaaacttnttagngntncaangtnannaantntctnggnaacnaaaagnaaattnngnaaatttttttngngnntaaaaactggcaatttnggnatttnnannantgaggctan

SEQ ID NO: 8348 - DNA, 719 bp, Homo sapiens
  misc_feature 7, 596, 598, 675, 702: n = A,T,C or G
acctcgntcgttttagtccagtggcttgtaattaagtcatttttagtctttaattatgttggttgcttttagaattctcttttagagttggtctacatccttttaaaacatgggcaatccaaatttataacagtaaattaagatacataaaaaaaaacactggctaaatttaaaaggaaacacttctagaatatactgtattttgacacaagaccagactgtgctatgtgtatgtggtgtttcaagtaatttaagaaaactgttggaattttctgtatttccagtttcacaagaaacaacctcaaggagggcagtttaactgaaaattcagaggtattatagctctgaagaaaaatactgatgagcagttatacaaaatgagaaattgagttctaagaaatgcatccctaacttcaacataaagatagctatgagaaaacattctttgtcccaaccataaatgaataaaaatcacctcatttctcatcagatgtttactgggttgctagttatatatagaatcctgcaagaagctcaacagggaagtccaaagagtcaatcaagaaggtatgataatggctaaagatggggactgnangtcaatgctccacgaagtcttcttttgtgcccaatatagctgcactggtatcccatatgggtacaatccagcctcanaaaatgtgcagatgccctcccagaagntgagacccagttctcat

SEQ ID NO: 8349 - DNA, 738 bp, Homo sapiens
  misc_feature 2, 6, 9, 484, 570, 593, 601, 605, 612, 619, 625, 628, 632,634, 637, 640, 643, 672, 673, 676, 682, 694, 698, 704, 706,728: n = A,T,C or G
cnaccncgntcgccttttagtaacacaaagttccaagtatgttacctagtttacagagtggtactcaagaagagaattaacattcttactgtaaaacttcattgataacaatagtctacttctagaaacagaaataagaattaaaaacagtgctatctatttgtactggtgagtgaattttaacttttaagaaaattttaatgtttaagaagaacttcagtgtatggagttacaagctatcctgaatatttttataatagaaagtattagttttcccagtgtggcagcttcttaataaaagaaattattcccttaaatttgttctttctctaattagagcagtgtaaagtaccatgcagaagtttcaggatctcatacaaccaagtaaatagggtttttatccccctacccagaaggtcccatgtagataatgaaagattgtatttgccattctgtgaaaattgctttaagcccatcaaatgcntaccctgctttttaatcttaacagcctccacttatattttaaaaacccattcctttctttctttccttcttttttctggagacaanggcttgctctgtgggcccaactngagtgcantggnggccatnaacactnactggnagnctcnanctngtnggngttaagtggatccttccgaccctcagccnnctngagtanctggggactacnaggnggggcnanaaatgcaacctggggttgggtnggtttggtta

SEQ ID NO: 8350 - DNA, 752 bp, Homo sapiens
  misc_feature 8, 466, 478, 481, 496, 500, 506, 575, 588, 607, 611, 615,616, 630, 681, 683, 684, 690, 692, 693, 696, 702, 704, 705,707, 709, 713, 716, 717, 718, 719, 720, 726, 727, 740, 746,751: n = A,T,C or G
gacctcgntctccgccccacctggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgccctttgggataggggatggtagggcaaggcccctcaagcaggaggcagcaacaggactggaatgacgcggtccagggagggcggaggcccaggagaccaaagggaggggctctgccgcttagcagagaagaaagggcctgggaggtggtgggaggganaaagaaaggaanaanggggaggaagaatanatanaaatanggattggagacagtaaccctttaaagctcaagaaacttgtccttgcttgggcttgagttaaggaccttngcaaggaccggcntttaccccttggcttcttnaaanactnnctaaccacacaatnaggcatttcaattactttgttgaataaaataaaacttggcttttccccttncnnacaaanannttnctcctncnntncncccnccnnnnnccccannctccccccccttnaaaaantttana

SEQ ID NO: 8351 - DNA, 1369 bp, Homo sapiens
  misc_feature 10, 13, 27, 37, 40, 49, 51, 53, 60, 61, 68, 90, 117, 128,131, 138, 145, 147, 150, 152, 159, 171, 174, 175, 176, 177,180, 182, 187, 190, 192, 194, 198, 206, 213, 218, 227, 228,230, 232, 242, 243, 254, 262, 269, 273, 278, 279, 285: n = A,T,C or G
  misc_feature 286, 289, 293, 296, 302, 306, 309, 310, 311, 314, 316, 317,319, 322, 326, 328, 329, 331, 336, 337, 340, 357, 362, 364,366, 367, 368, 371, 374, 377, 381, 385, 387, 389, 396, 397,402, 404, 411, 414, 416, 417, 421, 423, 424, 425, 428: n = A,T,C or G
  misc_feature 429, 430, 437, 439, 440, 441, 446, 447, 449, 450, 462, 465,469, 471, 476, 478, 479, 480, 485, 490, 491, 493, 498, 499,500, 501, 503, 504, 509, 510, 516, 518, 519, 520, 522, 533,535, 536, 539, 541, 542, 543, 544, 545, 547, 548, 549: n = A,T,C or G
  misc_feature 551, 562, 563, 565, 567, 576, 578, 582, 583, 584, 587, 588,589, 592, 593, 594, 598, 600, 605, 608, 609, 610, 612, 615,618, 619, 629, 634, 641, 643, 652, 659, 662, 664, 665, 666,667, 671, 681, 682, 684, 687, 688, 690, 694, 699, 704: n = A,T,C or G
  misc_feature 710, 713, 717, 718, 721, 722, 723, 731, 732, 736, 739, 743,747, 751, 753, 760, 766, 770, 771, 776, 778, 781, 783, 784,788, 789, 792, 798, 799, 801, 804, 807, 810, 814, 816, 817,819, 824, 832, 836, 838, 843, 844, 851, 855, 858, 862: n = A,T,C or G
  misc_feature 866, 870, 874, 881, 885, 889, 891, 906, 915, 920, 924, 925,927, 931, 932, 936, 943, 953, 961, 964, 966, 970, 984, 989,998, 1005, 1008, 1015, 1023, 1025, 1033, 1036, 1038, 1041,1050, 1057, 1081, 1084, 1097, 1113, 1115, 1116, 1117: n = A,T,C or G
atttttttcnctnataaaatcgagtgnaatacttgtnaancctttatantnantttatcnnctgacgnccgcgccttgcgtatatatttntgatgatgagatggacttgattggagntgcatgtatanctnctctctntcattantnttnancacacancggtgtgtgtanttnnnntgngnatctntgntntngggngggggggnaattgtntttancagtaatannantnttagttgtcnntcacacttagngtgacgantatattntatntatannacagcnnttnttgngcnacttangccncannncantnngntgncccnanncnagttnntantacatcaccaccataangcggntnannnaanatnccncgtngcancntntattacnntagtnantgcccangtncnntatnannnacnnnatcgtgnannnttaanncnngttttatatacntcnctancnatgtngnnntatgngtacnncncattnnnngnncttannggaaantnnntntataacagtgncnngcntnnnnncnnntntgaacatatanntngngctatatancncccnnntcnnnatnnntgtngntgtancannnantanatnntaatacgacnctcanacgaacngnagtggaganaagctanganannnngtanttgtatacanncntannantgangactnatttnactagnatnattnnctnnncttatctnntganatntccncacncgtnantaattancaaacncgtnntgtgnancantnngatnntgnagaggnntncgncgngtnaacnanncnatatncccccctntttnantaccnntgcgttngagngtngttngttncacnaccnccgattntganacgngnggactgattagtggngacacacanagagnatanntntctnngcantacaaancgcgttaatntctcacgncgncnaacncgtgatcgagtgtnacgantagaccgtntgtgctnaancgagtgngatgcggntnactcatangtntntcngatgacatnttgtgcnaaatggagttgagccatatgtaanatntaaccacgccccnatgggtaaaaggaatngnnntntcnncggngtaggattgnactcgccatcgaagntatntgacatcgtgtntgtnacnanatnntcatcngatattagacgctnnatcancgngnggaaacgnngacnanannacgaanaanatncccccctngagtatngnccgtaaagacgtatatntgaccgnacntnangggnagcatttgtatacanntncccccncnacacatanggcgctntgtattatanttagctntanacnngtaatagcgg

SEQ ID NO: 8352 - DNA, 908 bp, Homo sapiens
  misc_feature 1, 13, 18, 42, 43, 44, 45, 46, 48, 53, 54, 55, 56, 57, 58,60, 119, 215, 241, 246, 256, 266, 276, 279, 288, 307, 334,340, 359, 386, 394, 428, 439, 450, 486, 492, 533, 549, 553,554, 573, 596, 600, 620, 623, 644, 649, 652, 672, 674: n = A,T,C or G
  misc_feature 682, 685, 689, 704, 711, 727, 734, 738, 753, 755, 757, 758,766, 772, 785, 786, 789, 809, 834, 839, 848, 861, 862, 863,865, 866, 868, 870, 877, 881, 882, 883, 886: n = A,T,C or G
nctaatcctttgnaactncttgttctttttgcaggatccctnnnnncnaattnnnnnntntgagccatgcgagcagctcgtttttttggagaaagaactgtaacagaactgatttttcngcaccagaaccctcagcagttgtctgccaatctatgggccgctgacagggctcgaggatgccagtttttagggccagctatgcaagaagaggcctngaagctggtgttactggcattagaanatggntctgccctcncaaggaaagntctggtactnttngttgtgcanagactagaaccaagatttncctcaggcatcaaaaacaagtattggncatgtngtgcaaccactgtatcgancttctttgttttaaggttaccaaaaanagatgaanactcttccctaatgcagctgaaggaggaatttcngagttaatgangcattacgcanagaacatgatgcccaaattgttcatattggccatgngaagcngggactcccgtattttcaccctgaacagcgggtccttctcntttggtatgggggacnttgnnctcataaaatcacacaatngccgcttttatcattgcataaanggtntgtgaaaatttagaagaagnccngaaggttcctatcattcggcntggtnacnattcgaaagaagtaattaananatatttcntanaagnaagttcttattaccnccaaaanccagctcgggaagaanttccctnatgntttttttaaaaatgncnannaacttctnttattnaaatataatcccnntantctcccctctttaatttttnctacccttggccaaaaaattaaaanggggntggccaacnggggggaacccannntnntnanacaaaanatcnnnttnattcctccaccccttttaaaaa

SEQ ID NO: 8353 - DNA, 757 bp, Homo sapiens
  misc_feature 4, 5, 7, 8, 9, 10, 13, 14, 18, 31, 37, 39, 40, 42, 46, 47,48, 49, 50, 51, 52, 53, 54, 623, 680, 693, 719, 734, 755,757: n = A,T,C or G
ttanncnnnnctnngctngctgcctgcaggncgactntnnangatnnnnnnnnnccgagctcgaattcgccctatagtgagtcgtattacaattcactggcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttaatgctttacggcacctcgaccccaaaaaacttgattagggtgatggtcacgtagtgggccatcgcctgatagacggttttcgcctttgacgttggagtccacgttctttaatagtggactcttggtccaaactggaacaacactcaacctatctcggctattcttttgatttataagggattttgccganttcggctattggttaaaaatgactgattaacaaaattaacgcgaatttacaaatatnacgcttacaattnctgatgcggatttctcctaccattgncggatttacacggantgggcactctaatacaattgntn

SEQ ID NO: 8354 - DNA, 794 bp, Homo sapiens
  misc_feature 6, 31, 34, 35, 36, 37, 39, 40, 41, 42, 50, 51, 52, 713, 775,785, 791, 794: n = A,T,C or G
ctgatnctatcagctcttgttctttttgcangannnntnnnntcgccctnnnaaactgaagaaaattctaaacgaaatggcaaaaagaaaattcatttttttctctctgctctgaagaacccttgttataacgtgtttatagcatctttggtagatggagagagatcttttatgacaaagagtgtgatacaatttttttaatgcatatagggcattgttcttcctagagcatatttacataaattatctcatttggaaaacacaacaaccttatacttgtgtctgcattcgcttgtgcattttaaaggtcggaagaaattgaatcttttcaagagtctttctgagaagtcagtaactttcagaatacatgtcttacctttaaagatgatgttacggatggtaacgtgtgaggcttcattgtgaaatttaattgtgataaaccagtttaatttccttcagcatctctttcagggctacctgaaagagccatgagtaggctcttgatctgatgcagtgtacagtttttaatccaagggttatatcaataatccagcatatgtttaatgaataaatctatgttccactggtgtggacacctggctctgtgtggtcattttatttagactttaccagcccgtgagaaaattcatgtctatgtctcaggacaagatgtgtaatcaaaggtaggaacctgtgctgagaataagaatacnaggtctaaaaatgtttatttttgaatggaagagaagaatccaaatgtaatttggatgggccnaggcaccggnggctcncan

SEQ ID NO: 8355 - DNA, 1048 bp, Homo sapiens
  misc_feature 20, 21, 60, 73, 78, 79, 81, 90, 96, 98, 99, 100, 106, 107,109, 111, 114, 119, 120, 124, 128, 133, 140, 143, 149, 151,153, 157, 159, 160, 167, 169, 182, 184, 194, 201, 205, 208,209, 211, 216, 233, 235, 240, 246, 252, 255, 263, 274: n = A,T,C or G
  misc_feature 285, 297, 304, 327, 328, 330, 331, 332, 333, 334, 337, 350,351, 357, 358, 388, 412, 414, 422, 423, 451, 474, 480, 497,506, 516, 521, 549, 584, 610, 613, 616, 618, 627, 630, 635,651, 661, 668, 676, 690, 700, 705, 721, 732, 746, 750: n = A,T,C or G
  misc_feature 756, 776, 779, 794, 805, 809, 815, 831, 835, 857, 865, 881,891, 897, 913, 933, 937, 950, 957, 962, 997, 1000, 1008,1026, 1048: n = A,T,C or G
cgttgatcctttcaagctcnngttctttttgcaggatccctcgattccccctaccgaacnggaaaaaaatctnaaccnnanggggcatanaaaaancnnntttttnncncncgngctgnnaaancccntgggntaaccgngtntatccntntngggngnngggaaananacttttggccaanangggggaccanttttttnatgnctnntngggcntggtcctccctaaaccntnttccntaattnatctcnttnggaaaccncaccacccttntcctggggtcngcatcccctggnccatttnaagggccgggaagaaaattgganncnnnnnacncagcctttctggnnaagtcnngtaaccttttcaagaaatccatggtcttancctttaaaaggaatgaatgggttncnggatgggnnaaccggtggtggaagggcctttcatttnggggaaaaaatttaaaatttggnggaatnaaaaaccccgggttttnaaaattttncccctttcangccanttcttcttttttccaagggggcccttanccccttgggaaaaaagggaaagccccccttggganggtttagggggcccttcctttggggnaanccntngggaatggnccnaagtngggtaaaccccaaggntttttttttnaaaaatncccccaangggggggtttttanttatttcccnaattnaaaatttccccccagncccatttattnggttttttaaaaangggnaaaatnaaaaaattccttattggggnttnccccccctggggttngggggggggancccncccctnggggccttccttgggngggnggggggcccaattttttttaanttttaagnacccttttttaccccnagcccccggnggaagnaaaaaaaaatcccaanggggccttaattgggccctnccangggaaccaaaggnaatgggnggttnaaattcccaaaaaggttaaggggaagcccttgggnggncccttggngggaaaattaaaggaaanttcccccggggtctttaaaaan

SEQ ID NO: 8356 - DNA, 978 bp, Homo sapiens
  misc_feature 1, 3, 5, 18, 33, 50, 79, 85, 90, 110, 126, 136, 142, 146,148, 161, 165, 175, 178, 186, 189, 214, 218, 232, 256, 275,277, 338, 342, 343, 383, 388, 389, 391, 396, 397, 399, 400,401, 403, 407, 442, 444, 453, 469, 476, 511, 536, 569: n = A,T,C or G
  misc_feature 608, 618, 621, 644, 655, 666, 741, 750, 752, 776, 780, 781,784, 796, 797, 798, 826, 837, 845, 861, 868, 874, 890, 915,924, 952, 965, 978: n = A,T,C or G
ntntnatcctttgcaacnctggctctttttgcnggatcccatccgattcnaattcggcacgaggcacctgtagtcccanctactnttttngttgaggcaagaaaaataanttgaacccagaaggcnaaggttgaantgactngatntnaccccaatggcanttancagcctgggncanaaaggaancgnaaattttgctaaaaaaaaaaaaatnaatngggctttctttcantcctcttggattcacattctcttnggtaaaaaaagctttaaancntctttttccgggggttcccggggtttggggcccgttccccggtgggaaatttcttggggtngggnncttggccttgggggggtcttcttgggaaaaatggttggcnttgcnngnccagnngnnncnctanaaaacccctggaacaattgccaagttttttccccntngccttgaanggggggcccccttaangggggangttcaacaacccaaaagggggtccccccaacgaangaaaaaagttttgttgggccaattnccccccggggggggccccgggaaaaaaaaaaancccccccggtggtcttttcttggaagggaagtttccgtncccttttgtngtncccccttgccaaaaacatttttnttctttgccgnaacctttttgncccttccaaaccaattggtaattggtaacctttttcccttggcaagccctggtaaaaaaacgccctctttaaccnggtttaaantnattgttggtttccgcttttgcttnaaannaantattaaaccatnnngcccaggcccgaaggttgggggcaaccnccttgttaatnccaaacantttttgggaaggcttnaaaggtngggaangaatcaactttggggncccaagggggttgcaaagaaacaanccttgggcnaacaattaaccgaagaacccccattgtnttaaaaaaaattntttttaaatttan

SEQ ID NO: 8357 - DNA, 906 bp, Homo sapiens
  misc_feature 1, 3, 13, 18, 20, 23, 38, 39, 40, 41, 43, 44, 45, 46, 47,49, 53, 57, 58, 59, 60, 89, 111, 119, 120, 126, 234, 245,250, 282, 311, 363, 398, 411, 430, 437, 459, 472, 485, 498,510, 513, 519, 520, 523, 549, 557, 562, 563, 594, 599: n = A,T,C or G
  misc_feature 601, 610, 636, 640, 644, 660, 664, 679, 696, 703, 717, 722,723, 735, 738, 740, 753, 756, 760, 806, 810, 838, 849, 860,862, 874, 890, 893, 894, 895: n = A,T,C or G
ncnaaacctttgnaactncntgntctttttgcaggatnnnntnnnnnangaantcgnnnncgaggctgctcaaggattgcagggatttntgcaagtggaacagccctcggnaacctccnnttttgngcacgctccaggtcccagtttctatggcaaccataccggcaaattgggctccgcaatggttcctcctggaaaaaccgcgattttggttcccgcggacgtctctatggnttcgacagccnaaaangaacaaaacggcatttccgggaagatggcggngcacaagtcaggtccggcacatgtttccncggagcggacccagcaatgacggtaaggggctcccttcccccgaacggtggnagtcggagcccgggcttattagcaaaccgtgagangagcagagtattnttacccaaccggcactggngtagganggctggaatttagccctcaaanagcaaggaacccnaggaaagggcaancccggctctttanggactcgctgtnaanacgaanntgnacctggggccaccttctgaaaaacancagattgnactgnncaagggggaccagtgccccgaaactgtgaantcacnanggtttcaanaaaagacctgggggccgccacaagcntttntttnccccaagtttatcccncccngaaaaaattccccgntaaaaaggcccatttcncttaaanctatatgccccaanttcannctttaaaacaanaananaaccaaattgganatnggtntttcctggaactttctgggccccccgccttaccgtgccttcgggantggngcgggaaataaaaaacccgggcctcttnaaactttcaangggcaatggtnanatttccaaattnaatgccaaaaaagggnttnnngcccgcctttc

SEQ ID NO: 8358 - DNA, 808 bp, Homo sapiens
  misc_feature 7, 8, 9, 10, 11, 14, 15, 18, 19, 20, 21, 22, 23, 24, 36,38, 87, 91, 95, 96, 142, 154, 174, 281, 353, 362, 382, 451,517, 555, 567, 574, 576, 637, 640, 645, 687, 692, 714, 724,735, 756, 761, 772, 774, 778, 780, 793, 798, 799, 801: n = A,T,C or G
  misc_feature 803, 807, 808: n = A,T,C or G
acccatnnnnncgnnaannnnnnnaccaaaggaaancnctaagccattttctctgccctctagaagcttataatgtactttcctatnacanagcnnaataaaaacatgaaacctataaatgggaatgccataaagtattttnatctctacaggnccatccatgcagagggcatntattgggtgactgcagtactgcaaaaggttgcaaaggaaatggaagatctggtccctgtaggttgggagtttacaatctaattagaaatacaaggcatatataccgngaaaaaactagaatccccagctgtaagcaaaaggatggagtaggtgggagcatttttttcataaagagagcnttgtcctgnatgattggtgaggacagganaagcaagttcagtaccaatcaaggcaagagcacctatatgtatccctgctctatagaatgatgtaacanggccctcattgtcacttggctgaaagtgtcagctctgccaccttacaaacctggttttgaacctgnggcacatttttaacctaagaaagggaatacaggtttgnctccgtgaaggnggttggncnagttccaaatgaaaattaccaaaccgtgaaaacctcggtgaaagcttcaaatgaatgtccnatnccatnggagtccctcaattgtaccaaactggcccctttctgggtaanccttnaaagttcccttccccaagcctntaaacctggnaaaaagggcanggacccaaggccccgattggnatccntcaatgtttcncnaacngnttaaccaaaaggngttcnntntngggnn

SEQ ID NO: 8359 - DNA, 976 bp, Homo sapiens
  misc_feature 2, 4, 5, 15, 19, 25, 27, 39, 49, 52, 56, 61, 62, 65, 66,80, 81, 92, 101, 109, 111, 117, 134, 135, 136, 141, 142,144, 149, 167, 169, 174, 183, 205, 209, 212, 214, 223, 238,250, 263, 297, 323, 346, 360, 362, 367, 369, 371, 375, 398: n = A,T,C or G
  misc_feature 402, 411, 412, 415, 416, 417, 418, 419, 420, 421, 423, 429,447, 452, 455, 458, 493, 497, 515, 530, 532, 548, 598, 601,640, 738, 739, 743, 748, 773, 780, 799, 823, 831, 836, 837,848, 853, 866, 868, 877, 882, 890, 904, 905, 919, 923: n = A,T,C or G
  misc_feature 930, 953, 954, 961, 971: n = A,T,C or G
gncnntttgaaaccntttncaactncntgctcttttgcnggatcccccnatncctnttcgnntanngggggggaacctanntggctcccccnccggctttnttttcccntnatggancaattggaaggaaaccnnntaccnntnttccnaagggcccagcaacctgnanccctntcatgcctnaatggtctggggttttgccccnaccnganangtttttccngcagaaaagaacccnttggggagccancattagccccaangatggaccaaaaccacctggggcctgcccttggntccttgccccctcccttgctttactncattattgccaaaaaaccccaantgggcccatttgtngnccccntnanattnccaaacctaccccagggggagcnttgncctggccanngcnnnnnnngnttttantaaaaaaccccaaagtgnccttnccnccngggaaaaaaaatcttgtgggcctttgggcccccanagangaaacccaagtggggaanaaatggtgggggttntnccttgtgggggggatntcggagcactcccaagtcccccaattgcccccagtcccccttcttctttncangtggggaagctcacttgtctttccccagcagccacctgnccttcttccttcttctaaccattccctctttctttgcttctttccgccccggttccttcacttaagcccgttttatttggggggtccattcaagcttnnccanccccntgggccttcccaagtccattcgttncccacantagggggattccaaccccnaaccgggtttcccattgcccggcnttcgcccnccaannttttcaaggtnccccnaggcccggattcnanggaccccanccaangcccactngggcccttaccagnngcccctttccattncccnggggganttttaattcccccccccccttcnntaagganccacctcttngcccg

SEQ ID NO: 8360 - DNA, 755 bp, Homo sapiens
  misc_feature 1, 9, 10, 11, 12, 447, 724, 740, 755: n = A,T,C or G
ncgagatannnnaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgctnctcctctctaacatcctctccttgctcttcgccggtactcactaagcgtttattggggtcatcaagctagcagccctggctccagtcatcgtaccaagtagggatcaaccaacggttccatgcagctcgccacaaatttcagtcccaagcagatcaggaccacaagccagtggcctcagagccctccttccagggatttattcccccacccttataaacaacttctgccgccaagcagcttggcccgaaacacaagtcacttaaggggctctccaanattcactaacccaacnagggcccattcaagn

SEQ ID NO: 8361 - DNA, 1147 bp, Homo sapiens
  misc_feature 2, 8, 25, 26, 34, 35, 36, 37, 38, 39, 44, 45, 49, 50, 55,56, 57, 58, 59, 60, 61, 62, 63, 64, 65, 66, 67, 68, 71,76, 77, 84, 85, 96, 97, 102, 103, 108, 111, 119, 130, 143,146, 147, 158, 160, 161, 177, 179, 181, 187, 211, 223, 228: n = A,T,C or G
  misc_feature 231, 241, 244, 246, 248, 249, 255, 258, 262, 269, 271, 273,274, 276, 278, 279, 283, 284, 292, 293, 297, 301, 302, 306,308, 309, 328, 331, 334, 335, 337, 339, 340, 342, 351, 354,355, 357, 365, 366, 367, 373, 374, 377, 378, 394, 396: n = A,T,C or G
  misc_feature 397, 399, 408, 409, 412, 421, 425, 427, 431, 433, 441, 448,451, 454, 459, 460, 461, 462, 468, 471, 473, 479, 485, 488,489, 491, 501, 502, 519, 521, 527, 528, 547, 549, 554, 555,557, 559, 560, 564, 567, 572, 573, 574, 576, 581, 582: n = A,T,C or G
  misc_feature 585, 588, 590, 593, 601, 603, 606, 608, 613, 623, 624, 626,627, 630, 634, 640, 646, 648, 660, 664, 665, 669, 671, 677,682, 686, 687, 689, 693, 700, 720, 722, 723, 725, 726, 728,731, 736, 745, 748, 752, 753, 754, 762, 763, 771, 773: n = A,T,C or G
  misc_feature 777, 779, 788, 789, 790, 793, 802, 804, 805, 807, 814, 815,816, 828, 842, 843, 844, 846, 852, 858, 864, 865, 866, 867,869, 870, 875, 877, 887, 890, 892, 895, 900, 901, 905, 916,925, 926, 931, 945, 947, 949, 955, 963, 964, 965, 968: n = A,T,C or G
  misc_feature 969, 975, 978, 980, 983, 989, 992, 993, 995, 999, 1009, 1014,1015, 1016, 1018, 1022, 1029, 1035, 1036, 1052, 1055, 1060,1063, 1064, 1065, 1067, 1069, 1071, 1072, 1075, 1078, 1082,1083, 1084, 1090, 1096, 1097, 1108, 1127, 1129, 1137: n = A,T,C or G
gnagccangaaccctttgggaaaanncccccggnnnnnntttannaaannaaaannnnnnnnnnnnnnganagagnnaaagggnnaggagggcgcnnaaagnnggccnacnaagaccanaattttttttntcacccaaacgcnganncaaaaagagcncnnccagggggggattcgnantnagcaanacacgcaaggggtggacccttttntataaaaaaccncgaancanaacgccacgnggngncnngaaaanganacgngcccacncncnnananngagnngcccacgnncccnaatnncagncnncgggaccgacccagccaanganccnncncnngnaaccccccnganncnccccgaannncgaaannacnnggccacaacaagaccnanngnagcagcganncangccccaagnggcncnaacncnccaaaccnccccacnacnccngaccnnnnaacccncancnaaaaanagcccnacnngnggaccccaannacccacacccagacaancncacaanncacggccccacgtccccgncncaagnncngnncccnccnagccnnngnccccnnaancancnaanagaccccnanccncnccacnaaggaaacgnncnngancccnaaagcncaaacngnaacacacacccnaccnngcgncncgggtnagcanaccnncncccncgcaccncacaagagtaccgcaagcgnanngnnanacngacanccagcaaanccnaacnnngccccccnnagaaaagncngacncncacccaagnnncanccgacaacngnnanacccccnnncgacaacgacanccgcccacagcaannncnagcganccaccnaaagcnnnngnnacggngncaaaaaacancgngngcnacacnngatntagcaaacaancccaaaggnncaccnccgacgagaccacnangnacagangcagcgannnccnnccccgnagngnccnaaagcnacnnangccngaaacgcggnagggnnngngcanggcacgncccganncaacacacgaccccanagnacgcnagnnngncncnngcngancacnnnacccanccacannggggcgagcgncgagccagcgacgagtagncnacaaacgnccnnccggcn

SEQ ID NO: 8362 - DNA, 992 bp, Homo sapiens
  misc_feature 17, 23, 25, 26, 32, 40, 42, 43, 44, 45, 46, 47, 48, 49, 50,51, 52, 54, 56, 59, 60, 63, 64, 65, 81, 83, 84, 93, 94,115, 118, 120, 128, 129, 143, 180, 184, 239, 247, 251, 257,262, 264, 273, 280, 283, 285, 291, 293, 304, 327, 347: n = A,T,C or G
  misc_feature 352, 354, 356, 384, 403, 405, 413, 423, 424, 427, 430, 431,434, 435, 439, 448, 458, 466, 468, 469, 474, 476, 479, 484,496, 507, 523, 524, 525, 528, 542, 549, 553, 562, 566, 571,575, 578, 580, 586, 595, 598, 599, 609, 614, 622, 623: n = A,T,C or G
  misc_feature 626, 628, 632, 638, 646, 651, 658, 667, 675, 677, 681, 684,687, 691, 693, 697, 710, 711, 716, 724, 726, 732, 740, 748,754, 758, 762, 767, 769, 775, 780, 783, 792, 798, 802, 804,806, 810, 816, 820, 826, 837, 840, 843, 844, 846, 853: n = A,T,C or G
  misc_feature 857, 860, 865, 866, 872, 874, 876, 880, 894, 899, 904, 909,911, 914, 928, 957, 967, 968, 975, 981, 984, 986: n = A,T,C or G
tcgtgaccctttgcaanctcctngnncttttngcaggaancnnnnnnnnnnngnangtnnggnnnagaggaaaaaaaccantnnaatagaaannttataggctcccgcctcaggnaancngggctggnntttaattaaggaanaaagccgattctactgactgacgtatccccctgctgntaanaatcccaaccacacactttcacacactattccaggttctggccctgaatgacccncagctgangatnatttgncatcncnccacttctntttttancancnccaaanancatttccaaanaaaacgtttttagctttttaacngcgattcaccactaagaaantggcncngngaacagtccacagagcttattcaaattncacccattctacatgcacncntttggtgncgcctgtgannatntannctnnatcncatttttancaccctgcgnagaacggnannaaaancnggnaaacntacagccaaganaccagtagccnggctccggccatcacnnnagnctttgcccataccnatccctnttanaggaccatntttntaccntctngcncnccccanttccttaanccnntgggaaaccnaactnaaactggnnccntncaanaaatcnttttttantttcnaaagaantctttaccnttaaaatncnggantcncgnaaangntttnaacccttcctggnnaaaangggccctncntccacntcccaatnttccaccnttgcangaanaacnaaccnanaggctnatacnctnccaattggntatatntaantntnagcnataaancccncccccnttttatactcnggntannancacaagntacnctnttccnntaaggntnangccnaaacattaccctanagggncacanctaangnacntattcttcccgccnaatgcgccataaaaacccctctccccccnttgggaaacnnatacttnggggcnggntnttcccg

SEQ ID NO: 8363 - DNA, 976 bp, Homo sapiens
  misc_feature 2, 11, 26, 27, 28, 29, 34, 46, 47, 49, 50, 51, 52, 59, 60,62, 63, 64, 71, 73, 76, 77, 78, 81, 85, 87, 94, 95, 96,98, 101, 102, 109, 115, 117, 120, 125, 131, 132, 136, 137,141, 149, 167, 170, 172, 173, 177, 194, 195, 200, 204, 209: n = A,T,C or G
  misc_feature 219, 224, 225, 227, 228, 231, 235, 238, 243, 252, 253, 254,255, 263, 280, 285, 290, 292, 295, 300, 319, 330, 339, 345,354, 355, 358, 362, 364, 370, 395, 396, 400, 409, 413, 418,425, 428, 430, 437, 444, 450, 456, 469, 477, 484, 497: n = A,T,C or G
  misc_feature 508, 516, 519, 533, 548, 557, 567, 568, 572, 581, 583, 586,587, 588, 593, 616, 626, 628, 629, 633, 642, 643, 648, 654,656, 660, 669, 670, 678, 688, 691, 699, 701, 702, 712, 729,732, 736, 741, 765, 768, 773, 775, 778, 781, 782, 787: n = A,T,C or G
  misc_feature 795, 797, 806, 807, 809, 814, 821, 834, 840, 845, 846, 849,850, 860, 861, 867, 869, 872, 873, 874, 877, 894, 905, 908,910, 917, 922, 928, 935, 936, 956, 960, 974, 975: n = A,T,C or G
gnttgaaaacntatacaactacttgnnnnttttngcaggatcccanngnnnngggaganngnnnagccacngnccnnnggncccngnatttttnnncngcnnaaggccnctcccngnggntttanttcganngggnngganaacatttncacccaaaggcccaggangcntnntagncatttgggcccaaaacnnacacnttcngattntacagcgctnattannannaangatnaanatgancaaaagcannnngtcaaacnaattagtaccggcccgnccgcngtggntnacncccgnaaccccaacagttcgggangcccaggcggncgaatcacnaggtcntgagttccnnaanccgncncgaccnatatgggtgaaacccccccgccccnnctanaaaaaacangaanataancccgggnagngnctggccncccgccncgtagnacctangctaactcctggnaggctaanggtcagngagaaatccgctncgaatcccggngagggagngancgcccgcaagtgangtcccaagcacccgncccaactgncaacatctcnncccntgggggagnancannnacccncagcaatttcctcccccccccancaaaaaaaanannaaancggaaatcnntgcanaaacanantccncgaaggccnntaaacccnctcccccganacnccaatttnannacacacgcanccccccatatcccctanaancttntctcnttacccctcaacaagaaaaaaacnccnctctntnaancannccccnccacgggnancccaacaanntnttccnaaatttncgcggggcaaccngcaagnaatannganngaaccctacnnttggangnatnnnccntgggaccttcggggganctatcgctccncanancacacgncaccntaatanaaaaaannaaaactccgcctacaccatncggnggagaacaccactnng

SEQ ID NO: 8364 - DNA, 803 bp, Homo sapiens
  misc_feature 1, 3, 5, 6, 7, 8, 9, 10, 12, 13, 15, 16, 18, 19, 20, 21,29, 488, 492, 508, 512, 517, 524, 530, 536, 541, 548, 549,553, 555, 603, 611, 637, 638, 656, 661, 675, 685, 692, 697,733, 774, 781, 801: n = A,T,C or G
ngngnnnnnncnncnncnnnnctccctgnttaccaaagacactcacatctttaattttggtgtttcgatggaagcacaggatataattctctgcctccttaaattgttgaacgtgctgcaaagtttgacatttagaaatagaactagggctgtggggctttgttccgtctttagggctttgttctctgcccttgcgtacacactcgtgtgcatgtgtgagtgcatattacacaggtgcatgggataaccctactcttttaaggcagtatggaagtagcaaagctgctgtctttgtcttttcgggtgttgctggtctcctctgtcagcaccatcaaggctttgctgctcattgcactcatccagcagggtgctatcaggaagaaggagaatgagttccaaaaataaggtaacttattcaggcttcacatttgtctctatgttgggaatgatgctactctccctgcctgccttgtggaatggttataaanatanaatgagaggaagctcngaangtgtnatccaangtgttncacccntcatnaaacatnntcangnattgcaaacaaatggacttacgagtcaacctgactgaagggcagaaanttccaacncctattttaataagggttcgccctgnngttaatttggatcccacntttcntcattataaataanaaggtggggnttgaatnacaancattaaggggctggcgaataaacaatttaaaattcntggtcaacctttatgttaaaagaaatcttaattggaaaatnttattgnttgccaccattaacaagggncc

SEQ ID NO: 8365 - DNA, 935 bp, Homo sapiens
  misc_feature 13, 17, 18, 20, 21, 25, 35, 37, 43, 46, 48, 52, 57, 81, 89,108, 116, 127, 138, 139, 142, 144, 168, 169, 172, 178, 179,184, 185, 204, 222, 231, 234, 242, 248, 258, 263, 279, 287,291, 304, 310, 317, 319, 328, 335, 337, 350, 357, 362: n = A,T,C or G
  misc_feature 363, 365, 375, 387, 390, 391, 401, 433, 434, 436, 455, 460,468, 476, 479, 489, 495, 500, 502, 506, 515, 529, 530, 534,543, 553, 563, 564, 565, 566, 592, 627, 628, 631, 642, 645,650, 653, 662, 668, 670, 680, 681, 682, 684, 685, 691: n = A,T,C or G
  misc_feature 696, 703, 707, 741, 745, 752, 756, 763, 767, 770, 771, 779,795, 823, 824, 829, 830, 846, 850, 854, 855, 873, 874, 878,887, 890, 894, 907, 910, 920, 922, 929, 935: n = A,T,C or G
agaaccttgaaancccnncnntgcngacccacgancnaatcgnccnanggtnaaagnaaaccaaccaggggtttttttganaaaccaanaaggaaagggaaggcgggnggagggcnaaacggccaanccgcttgtacnnaanancccgggggagggaaaaaaaccggnnaanccagtnnaaagnnccccgggggccgaaaaggnatgccgggaagaaacccnacccaacanaanaacccatnggaaangcccgccccnaaaangggacctggaaaccancaagcaancggncctggaaaaaaanggcccnggaccangnaaaatgggnaccaacngnccaaaaaaggggnccccggnaaaanntnaaaagcccanaaaggtaagganggnnaagggaggcnaagaaaaccaaacccacggggggggaaaaagnntncccaagccaaaccaagaanggaanggcctttnggagcccnccntggcccccanaccaanccctngnaagnggggaatgncagggcccccacanngggngggggaaanaaggccccanccgaagcccnnnncctcccaactgggcctggcccctccnctgggggggaaccaaaacaacccgaaaaagaaacnncanccacccccggncanggggncanaaggggggncacccngnacaaaaaccnnncnngggtcncaagnggggcanggantcccccaaagggaaaccccaggacccctataaancagnaaacaancccnaagtttngaantgnngggggacncaaaaaagggaaaaanaaaaaaaaaaaaaaaaaaaaacccccannccccnnaaaaaccaaaaggggnggcngcannaccgggggaaccccgacnngganaaggaaccnccnggangaagaatggggcnaancccccacccncnaaggccnggggan

SEQ ID NO: 8366 - DNA, 656 bp, Homo sapiens
  misc_feature 5, 8, 15, 19, 25, 35, 40, 41, 50, 55, 61, 71, 140, 186, 270,445, 531, 566, 592, 593, 600, 603, 631, 635, 643, 651, 652,653, 654: n = A,T,C or G
ccccnctngccttgnccgnttatcnaggatctttngcatnncatctgtcnctttngctgtnttgtaaatcngttaccgttatagtacctggtctgaaaggttgctggatgatcctaccaacagagaccattgaatgccgntcaaaatggactgaagcatcagcaatgtctgaaaaaaggcctgacngtaatgtacatgtcaaatggcccgtaatttaagccagagtagaagtaagtagaagaataaacatggggaaagttccagcaacanaggaggctttgagcttttgctcttcatcttgagtggatgttgttctcaggtggtaataggccatcgagctttctccactggctgcctctctggggaacaaataacccgaaaagatctcagcaccctggttggtacataggtggtcagttgatttatacttcctgggtttcagtgntgcttgaattttctaaatggaaacacagtacctttataatcagaaaacaatcccgagtttttgatttgaggggtgttgtaaaaagntaaaaaaaaaaaaaaaaaaaaaactccgccctttnaaacttttggggggtcgttttccgtnnatccccnccntgttaggaatcctttggtgagtttgggnccancccccccnccttaacnnnntt

SEQ ID NO: 8367 - DNA, 671 bp, Homo sapiens
  misc_feature 1, 7, 13, 15, 17, 26, 31, 38, 40, 58, 71, 76, 156, 422, 458,504, 577, 616, 636, 656, 659, 666: n = A,T,C or G
ntactcnaatagntnantaaaacctnaactngaatatntnaaatattgagcaagcctngctgttgtagagnagcancctggtctaacccgtccaaaaacaatgttagagacattaggaatcaggttttgaaaatctttttttccgatttatttgtnatttacataccaaaaaaccacattaaaatagtcctcccttcaacatggctatcttttttcaagttttatatgcatagctctctcagcacttgaatggaaaaactgttacagcatttgggagttgtttttcttttagacatttgcagatcttatctcaaggtgactaggaacccagagctaagtatctgtgaggcaatctctgcgaacgctgaacttacctagttggtttctatgaaatatgtagaatgcactgcagtagccattgnaagaaggtactataccggttttttggggcttggtgntgttgtttggtctgagaatgtactgccaacccctcttttataaganagaactgattttgatacatattttaaaatatgatagtacagagttaatggatgttaaaaatttatttctttgntttggtaagtagattaaatcgagaatcatataatcagtncatttgagaattatataccnggatataataatactggacnaancatttgncatct

SEQ ID NO: 8368 - DNA, 758 bp, Homo sapiens
  misc_feature 29, 36, 40, 43, 47, 49, 51, 71, 72, 73, 718, 729: n = A,T,C or G
gttattcgttactcagcttgctgcctgcnggtcgantctnatngatncnanttccgcacgaggtgaaagcnnngcctcacgatccttctgaccttttgggttttaagcaggaggtgtcagaaaagttaccacaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgtctttatccctctttgctaatgacgatcaatgatgactctgccacgtgcaaaaagatggcatccatgacaatcaaagtccctacttggtaaaatcacctcgagaaaaaagaatggctgtttgatatnggtaccacttnggttgggagcaaaaaacccttaaatagat

SEQ ID NO: 8369 - DNA, 731 bp, Homo sapiens
  misc_feature 11, 36, 44, 45, 46, 51, 58, 59, 61, 80, 85, 91, 93, 108,124, 129, 133, 144, 147, 152, 157, 168, 169, 172, 178, 182,185, 192, 195, 204, 207, 217, 219, 222, 225, 227, 239, 247,248, 249, 258, 259, 279, 289, 299, 353, 383, 391, 415: n = A,T,C or G
  misc_feature 454, 479, 546, 552, 593, 652, 695, 709, 719: n = A,T,C or G
cttttgacccntttaacaaccacactctatggtgantggaattnnnaaatnaaaaagnnantaaatggatttggccaccntaaancaccanantttgaaatggttgantgagggccggaggccntgatnaaangggccctttgnaangggtnggggnggaagggaaannttnccgggngggngtnacctgtnggncttccaggncantttttggccntncanccntncctgcaggatgntcaaaagnnncggcccctnntgggaaggttaaaactggancaaacctttnccaaggggancattttcaccgtttacctggaagtctttttttcccacctggcttaatcaggttncaattttcaagggtaaacaactaccacttncaggatangggaagtggtgggtggaataaganaaccatgataccctggaggaaggggaagaaaccacaaancatttttccttactggaaaaaatangggtggacatgtcagtcaaaattcttgatcaacttggaaccttgagttttccagttaaattccattncactanggagggagttttctatcaaaatcctgccagatttgaagaanctggtttattagaaccacctgtcgcttttcaaagctgcttaaaaataagatctgcctcnccctagagatgatcatgggcctggtggggccaaaaatcccggngttttttaaccctntgcgattctnattgcagtaaaa

SEQ ID NO: 8370 - DNA, 867 bp, Homo sapiens
  misc_feature 9, 204, 205, 210, 211, 213, 214, 217, 241, 244, 249, 253,255, 261, 262, 263, 264, 277, 279, 280, 281, 283, 284, 285,292, 294, 295, 296, 299, 300, 301, 302, 303, 304, 305, 306,307, 308, 309, 310, 311, 312, 313, 314, 315, 316, 317: n = A,T,C or G
  misc_feature 318, 319, 320, 321, 322, 323, 324, 325, 326, 327, 328, 329,330, 331, 332, 333, 334, 335, 336, 337, 338, 339, 340, 341,342, 343, 344, 345, 346, 347, 348, 349, 350, 351, 352, 353,354, 355, 356, 357, 358, 359, 360, 361, 362, 363, 364: n = A,T,C or G
  misc_feature 365, 366, 367, 368, 369, 372, 374, 378, 379, 380, 381, 382,383, 385, 389, 390, 393, 394, 395, 396, 397, 398, 399, 401,402, 403, 404, 405, 407, 408, 409, 410, 411, 412, 413, 415,416, 421, 422, 425, 426, 427, 428, 431, 432, 434, 435: n = A,T,C or G
  misc_feature 436, 437, 438, 439, 441, 442, 443, 444, 445, 447, 448, 450,453, 456, 457, 458, 460, 462, 463, 464, 465, 466, 467, 468,470, 471, 472, 473, 474, 475, 476, 477, 478, 479, 481, 482,483, 484, 487, 488, 489, 490, 492, 493, 494, 495, 498: n = A,T,C or G
  misc_feature 499, 500, 501, 502, 506, 509, 510, 512, 513, 514, 515, 517,518, 519, 520, 521, 522, 523, 524, 525, 526, 527, 528, 529,531, 532, 534, 536, 537, 538, 540, 541, 542, 543, 545, 546,547, 548, 549, 551, 552, 553, 555, 556, 558, 559, 560: n = A,T,C or G
  misc_feature 561, 562, 563, 565, 566, 567, 568, 569, 570, 572, 574, 575,576, 577, 578, 581, 584, 585, 587, 588, 590, 591, 594, 595,596, 597, 598, 599, 600, 601, 603, 604, 605, 606, 609, 610,612, 613, 614, 617, 618, 620, 621, 623, 624, 626, 627: n = A,T,C or G
tttacacgntcgctgcactgtgaacctgggcctccgcgccgatgccaccggcctgtgggtctctgaagggaccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaannccccnngnnccntaaaaaatttgggggggttttttnccnaaaancccncnctgttnnnnttttttggggggngnnncnnnccccccntnnnaannnnnnnnnnnnnnnnnnnnnnnnnnnnnnnnnnnnnnnnnnnnnnnnnnnnnnnnnnnnnnnnnnnnnnnatntnccannnnnnantttnnatnnnnnnntnnnnntnnnnnnncnnaatannttnnnnatnnannnnnntnnnnntnntntanttnnntnannnnnnncnnnnnnnnnntnnnnttnnnnannnnttnnnnnatcnatnnannnntnnnnnnnnnnnnntnnanannntnnnntnnnnntnnntnntnnnnnntnnnnnntntnnnnntanttnncnntnnatnnnnnnnnannnnacnnannnatnntnntnntnnnnnnnnanannnntattcnnnttcnnnnnntaanatnttnnnnatacnnnnnncanntannttnnntntntnnttnnnnttntnnaantaantnttnnnttagcannntctnttcnnnnncnttattntntnttntnnatnnatntnctttgtntnatntttntnatttnntannnancnntnnannncnnatnnantnttnnnnnnnannnnncattanctattcncngtncnanancc

SEQ ID NO: 8371 - DNA, 759 bp, Homo sapiens
  misc_feature 2, 7, 10, 545, 622, 670, 746, 753: n = A,T,C or G
tnttatncgntcagctacttgttctttttgcaggatcccatcgattcgaattcggcacgagatttgaggatctcgaccttgtccttccagcaggtgctcccaagccacctctgggcctgagaataggcatcacatgactctgtttaatcctccgacacagcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcangaggaggtgatggaggccatggggatcaaggagacccggaaatacaagaaggtctattggtatttgacctggggcanaacaacttccttcccaacttctgtcccaccttgaagctgaggcacttnttttcagatgcccaataaagagcactttatgagtcaaaaaaaaaaaaaaaaaaaaaaaaaaactcgagccttttanaactatngtgggg

SEQ ID NO: 8372 - DNA, 758 bp, Homo sapiens
  misc_feature 15, 81, 82, 158, 185, 202, 214, 220, 235, 253, 279, 285,297, 303, 320, 326, 346, 348, 366, 393, 413, 428, 430, 432,446, 451, 482, 526, 532, 543, 546, 554, 562, 563, 568, 570,574, 580, 583, 590, 591, 598, 599, 603, 630, 631, 639: n = A,T,C or G
  misc_feature 649, 652, 653, 654, 663, 664, 668, 674, 679, 683, 684, 688,690, 693, 696, 702, 704, 711, 714, 727, 730, 732, 733, 734,736, 737, 738, 739, 741, 743, 744, 755: n = A,T,C or G
gggccgggtctgccntcatagacatgaccaactgtccttctcctcgatcacagaccaggcagctggcatgaaagaggaccnnaagcaaaatgagccttttgtggccacccagtcatctgcctgcgtggatggccctgcaaaccattgagcgtaggatntgttgcattatgctagagcaccagggncagggtgcacggaagangctcaagtatgnttattncttatcacaatgcanaagccgaaaattatgtcnctttaagaaatacctacctgtttgcnatgtcntattaaaaaacnacaaanaaagacaaatggaacanagaaanctgtgaccccagcaggatgncnaatatgtgaggaaatganatgcccacctaaaatcatatgtgcaanattatctcgaccttccatangaggagaatacttgnancngtatgctgcctgtngttanaagcaaattttatacttttaactggaaactntggggttttgcatttaatcatttaactgacggctaaatagccancatttnttttttagaanctnaaaaaaangccctagnnctgtngntttntaaatnggnttatgcnnactcggnnctgncatgttcccccccccaaaatgaatttnntttttgtncgaaacctanggnnnacctcactnntttntaatcncctangtanncctncnctnttncctccntnttaaagnccnaaataattccttnttncnnngnnnncncnngctttacggcncca

SEQ ID NO: 8373 - DNA, 1212 bp, Homo sapiens
  misc_feature 1, 3, 5, 10, 17, 20, 23, 26, 27, 29, 42, 46, 53, 54, 58,63, 65, 66, 68, 71, 79, 82, 92, 101, 104, 107, 108, 113,124, 126, 127, 131, 132, 140, 144, 146, 147, 148, 151, 155,156, 159, 163, 183, 184, 185, 191, 203, 205, 207, 209, 211: n = A,T,C or G
  misc_feature 220, 221, 222, 223, 225, 227, 229, 230, 232, 238, 239, 247,248, 254, 256, 261, 267, 270, 271, 275, 278, 282, 286, 288,293, 301, 302, 305, 309, 311, 312, 316, 320, 325, 326, 327,330, 337, 338, 341, 343, 344, 345, 348, 349, 352, 355: n = A,T,C or G
  misc_feature 356, 362, 364, 368, 371, 374, 375, 378, 382, 385, 387, 389,390, 393, 394, 399, 400, 405, 406, 411, 412, 413, 417, 418,419, 421, 423, 424, 431, 433, 439, 441, 442, 447, 459, 460,461, 462, 463, 466, 472, 475, 476, 478, 480, 483, 486: n = A,T,C or G
  misc_feature 487, 492, 497, 499, 501, 503, 508, 509, 516, 519, 521, 524,526, 527, 532, 534, 542, 545, 547, 563, 566, 572, 574, 577,586, 594, 597, 602, 604, 606, 607, 610, 613, 614, 622, 628,629, 632, 642, 645, 647, 648, 651, 652, 655, 657, 661: n = A,T,C or G
  misc_feature 662, 669, 676, 678, 682, 687, 688, 689, 697, 700, 701, 703,706, 715, 720, 722, 726, 730, 734, 739, 744, 752, 755, 767,768, 772, 774, 779, 781, 788, 791, 792, 801, 806, 807, 808,811, 813, 828, 829, 836, 843, 869, 877, 883, 884, 886: n = A,T,C or G
  misc_feature 887, 894, 896, 901, 914, 917, 931, 933, 936, 938, 939, 942,950, 952, 954, 958, 967, 972, 974, 977, 997, 1001, 1003,1017, 1020, 1022, 1025, 1028, 1036, 1042, 1044, 1047, 1051,1060, 1061, 1062, 1065, 1069, 1072, 1078, 1085, 1087: n = A,T,C or G
ngncntgatngaacgtnacngantgnngntacgtatatgttngatntgtgatnntgangtatntnnanagngtatgtgntgnttatgcgatnttattatanccnccnntatgntagtagtaacnannatanntagagtanttgngnnnatngggnnggngagngtatatttgagtcatatgtnnnatgaancagaaacatctncnanantntacgcatgnnnntngngnncngagccnntatgatanntgatgntnacgantcgtanttnngatntantccncgtntnggttnctgtcgannccnagtnannttanatgncccgnnngcnattaacnntantnnnggnntangtnngtgcgngnagtntancgnnaantacnagnanannatnnaggcnntattnnctaannnacgnnntngnntttattnantgtgtnannatggnaggaggagtacnnnnnatnattgcngtnngntngangtnntaganatgtntntncnccacnntattgcntangntgnanncgttnantagagtanacntncgcagaaggtacgcanctnatttantncangacaatgtngggcgtcncgntaatntngnntanganntccgagtnttgtanngancgtcataccnatngnngtnngcntntaanntgatgcngatgacncncgtncagtnnntaatatangannantcngtagggtcnctatntngttnatantgtnagacncacantatagagngantatactgaaatnntggntngagananatatatnagnntgtgttatntggcnnnatngncatatatatgatagnntgcgatnactacgnagtgtgggaacgctacacgcgtaggnttgcgtcnatatgnntnnctcgcgnangtgtnttttctcgctagnatngtgagtgaatgttncncanannaanggataatntntngtancccagcatntgacnangangatagataccgcacagtatntatncntgtatgtgtgtgtnctngngcntantgatcgcnagtatntngcntctnactactaannnatnactncgncgtacncagggananntncgaaagngcgcacnntatngaacgntanaacgtgcngantagatgtntcgacnnncncataggncntgatgtacaagtgatcanntgaannngtgganncnccatgntnnatnagnntnggt

SEQ ID NO: 8374 - DNA, 771 bp, Homo sapiens
  misc_feature 5, 8, 13, 440, 563, 579, 629, 632, 633, 649, 663, 668, 682,687, 695, 719, 729, 730, 731, 738, 749, 756, 760, 763, 769,770: n = A,T,C or G
caccncgntcgantcggcacgagatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttaagataatgtatccagatttaaacctaccagtttgcctaccccttangcgtttaaaataaaatatgcaacaaaatggatgacttaattggagatgggaagcccattaattgggttccccattaaatcggttacatacaaagaacacagtttttatactaaaggattttgnggttaaaggccttgtnaaaggttcatgtcttttcacccagaatttttcaaaatggttagaagaacnagnnggggactttctttaanaataaccggtttangtggnattttaagaaaagngggtnaaatttgnggccttttgaacctgggagttttnaataaaatgnnnaaaaatnccattcataancaatttnggtngancctaanng

SEQ ID NO: 8375 - DNA, 733 bp, Homo sapiens
  misc_feature 4, 7, 12, 412, 472, 499, 517, 556, 560, 565, 567, 580, 586,631, 632, 643, 651, 657, 661, 666, 670, 674, 675, 677, 679,683, 685, 687, 690, 696, 716, 718, 723: n = A,T,C or G
accncgntcganttcggcacgaggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagagctgncagggacctggtgagcaaagagggcttccggcgggcccggcacgttggtgggggagaatncggcgcacggcccaagcaagcggccgnccttgagacgtggcgacnacagagcctttggccgcctcattggtggagaaccaccgntcanctcananacgactatgaagngaactngccaaaacttgaccaacttgtggaaggttgcccttgcttgtgccnngggtttatggnaagccccnttaacnggcngtggnttcngtgnntnancggnananttnttggangcctccctttttccaacccntnggganaatcaagaat

SEQ ID NO: 8376 - DNA, 734 bp, Homo sapiens
  misc_feature 3, 7, 13, 601, 631, 666, 702, 717, 719, 731, 733: n = A,T,C or G
ccntcgnatcgancggcacgagaaagtgaatatcgagttggtaacgccaagaataccagaaattctggaaatccatgaagcagcagcataagtggtttgcctctttctccagcagcaacatagtgaaatcttaaccctgaatccttgtattcttggcgttaccaactgagagaatttaaaagtgaatatcgagttgtagcactggatttgagaggttatggagaaacagatgctcccattcatcgacagaattataaattggattgtctaattacagatataaaggatattttagattctttagggtatagcaaatgtgttcttattggccatgactgggggggcatgattgcttggctaattgccatctgttatcctgaaatggtgatgaagcttattgttattaacttccctcatccaaatgtatttacagaatatattttacgacaccctgctcagctgttgaaatccagttattattacttcttccaaataccatggttcccagaatttatgttctcaataaatggatttcaagggtttgaaacatctgtttaccagtcacagcactggcattggaagaaaaggatgcccattaacnacagaaggatcttgaagcttatatttatgnctttttctcacctggagcattaagtggcccaattnaccattacccgaaatatcttcagcttggctggcctntcaaacattaaaatngnggcccacttccncnt

SEQ ID NO: 8377 - DNA, 766 bp, Homo sapiens
  misc_feature 4, 38, 49, 75, 81, 473, 474, 590, 603, 620, 647, 652, 657,715, 718, 731, 741, 756, 765: n = A,T,C or G
accncgatcgaatcggcacgaggtggaagaagaaaagnttcctacacanctgagcaggcatattaagtttggtcngaaatncatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcnnggcccttcctcctttgttaacgaagccacatttacacaagatggacattaccttattaagtgcatcctctgatggcactgtaaagatcttggaatatgaaaacccccagaatggtncaaaatacctttnaaatccctgggccagcncccgcaagggacaagatatttacccgnccaancaggnggggaatctaactttccttaaaaacccttggaccacttttgtgggtggtgcaaccaanaancaaaaaccccggnggggtcattncatgaaccatgccangggggccana

SEQ ID NO: 8378 - DNA, 1226 bp, Homo sapiens
  misc_feature 9, 10, 14, 17, 19, 20, 22, 26, 28, 31, 33, 37, 39, 46, 58,65, 73, 77, 79, 81, 84, 98, 103, 114, 123, 127, 130, 132,141, 149, 150, 153, 154, 156, 161, 164, 170, 174, 177, 185,199, 203, 204, 220, 229, 232, 234, 240, 242, 246, 247: n = A,T,C or G
  misc_feature 254, 264, 271, 274, 285, 286, 289, 291, 294, 298, 303, 308,311, 313, 323, 324, 326, 333, 339, 344, 345, 346, 349, 352,357, 359, 362, 364, 367, 372, 375, 378, 379, 381, 383, 384,385, 386, 388, 392, 393, 395, 409, 416, 418, 419, 420: n = A,T,C or G
  misc_feature 421, 424, 425, 428, 429, 431, 434, 435, 436, 438, 439, 441,447, 451, 453, 454, 461, 466, 469, 473, 474, 477, 479, 481,485, 489, 491, 495, 497, 499, 503, 509, 510, 511, 513, 520,525, 529, 531, 532, 534, 536, 538, 539, 543, 545, 547: n = A,T,C or G
  misc_feature 553, 554, 556, 559, 560, 561, 562, 563, 564, 566, 569, 570,573, 578, 582, 586, 587, 605, 606, 609, 613, 614, 615, 617,619, 621, 624, 625, 628, 630, 632, 633, 634, 636, 637, 638,643, 647, 651, 658, 659, 660, 663, 664, 665, 666, 667: n = A,T,C or G
  misc_feature 670, 671, 672, 679, 685, 687, 691, 698, 700, 701, 706, 708,713, 726, 727, 732, 743, 745, 751, 753, 757, 766, 769, 775,787, 789, 793, 797, 799, 802, 804, 805, 811, 812, 816, 819,820, 822, 823, 833, 836, 839, 841, 853, 854, 855, 857: n = A,T,C or G
  misc_feature 858, 861, 862, 863, 864, 867, 869, 870, 871, 875, 877, 880,884, 900, 907, 911, 917, 920, 921, 924, 925, 931, 941, 954,960, 965, 980, 988, 994, 1017, 1019, 1024, 1027, 1030, 1038,1051, 1053, 1054, 1057, 1059, 1070, 1072, 1075, 1079: n = A,T,C or G
aagaacggnntttnaangnntntttntnttnangganantgtagtntaaattcatttnttaattngaacgacnccgntncnacngtatcttgaattangggtnggtggaaggcncccatgtcnacanatntnacatatatnttatattnncanntngacanatntaattntttncangctgaacnatcggggggggggngagnngatcctatctcgttantggtatganttnantcgcgncnatcnntctccgnatatttaatntttatanttngatcgttgganngangnatntacnatatnatatngantntgtaccattnntnacgatcnaatgtncttannnctnaantttcncncgncnggncatanggntcnntnannnncntgtnnantccgcaatgatagntatatgntnnnnaanntgnngncannntnngnaccatncttncnnggtttgngcgcntanttanncanancncatnggantntatnanancccnctgggnnntntaaaagntatangccnanntntncnngctnantnggttgnncnatnnnnnnanttnnaantaacngggnatanntcgctgcactcgatttannccnccgnnnantnantgnnccncntnnntnnngcaangatnacanatgagtnnnagnnnnngtnnntatttgnacaatntncgtncgacgcngnngatcntntattntgacatatgaggnngcaanttatgcgcagntnttccancnatangatattcgnatnaacatngtggtgtatgcnanatcncccnangananntcgttnntatntanntnngctacacggncanttntnacatacccatcnnnannatnnnnccncnnnacgntngcnagtntcgaacacatctgcgnggttaancgtngagacnctnncgnnatagantaattaggantgctcaatcatcngcactntatgngcgtacgaacgtatntgtatatntgagtnatatgtgcgatatgcgattgttntnatatnccnacntgatcatntgtatgagtatcnanngtngncccgatatgangnggngttngnnaganatatcgaaatataangtgtntgccgtgacngaggtcgtcgaantncgagctcgcgtgntnggacangtgtatagntnngcgtaaagganttgacggngntcgcatgatgtannctacgatntntgagtgcnanacagagt

SEQ ID NO: 8379 - DNA, 1327 bp, Homo sapiens
  misc_feature 16, 19, 28, 29, 32, 36, 41, 43, 54, 63, 84, 85, 89, 93, 96,97, 101, 102, 106, 114, 120, 122, 126, 132, 134, 137, 142,146, 149, 156, 167, 168, 178, 192, 193, 200, 207, 209, 221,225, 227, 231, 258, 260, 267, 270, 277, 278, 288, 294: n = A,T,C or G
  misc_feature 300, 309, 312, 319, 332, 334, 340, 357, 358, 367, 368, 372,376, 378, 390, 391, 392, 406, 409, 414, 418, 419, 425, 428,449, 452, 458, 459, 480, 482, 485, 486, 487, 489, 491, 494,495, 498, 499, 504, 518, 520, 522, 523, 531, 535, 539: n = A,T,C or G
  misc_feature 543, 551, 552, 555, 557, 558, 561, 562, 564, 566, 569, 570,578, 586, 592, 593, 601, 602, 610, 613, 615, 618, 621, 628,634, 635, 642, 646, 657, 658, 665, 666, 667, 668, 669, 674,675, 676, 679, 682, 685, 687, 689, 690, 693, 694, 696: n = A,T,C or G
  misc_feature 698, 701, 703, 709, 710, 711, 713, 714, 715, 716, 722, 723,724, 725, 728, 730, 732, 733, 736, 737, 741, 742, 751, 754,761, 765, 769, 771, 772, 774, 775, 776, 778, 783, 784, 789,790, 791, 794, 798, 799, 802, 807, 812, 813, 814, 816: n = A,T,C or G
  misc_feature 821, 827, 830, 832, 833, 835, 836, 843, 846, 847, 852, 857,859, 861, 863, 864, 869, 870, 875, 878, 882, 886, 892, 897,906, 912, 913, 914, 918, 921, 927, 928, 929, 935, 939, 941,947, 948, 951, 957, 963, 972, 992, 1005, 1009, 1010: n = A,T,C or G
  misc_feature 1013, 1014, 1017, 1019, 1020, 1028, 1031, 1032, 1037, 1042,1046, 1047, 1057, 1058, 1059, 1067, 1072, 1081, 1088, 1090,1095, 1097, 1099, 1103, 1107, 1111, 1116, 1124, 1126, 1131,1133, 1134, 1140, 1158, 1160, 1163, 1165, 1168, 1173: n = A,T,C or G
ttggggggggggggcnaanacccggccnnttntaangtttncnagaaaaaaagngaaatgggntagactcccttttccggagtnnaatncacngannagtnnggcngaacgggntttgtntnaaantttatnanacncgccncacnccnatcagtnaatatcggccnnccccccattntatgtaaagcagtnntatattngtggatntnaccccccccccngccncntagntgtgttatgcgcatgcacgataagtgngnggggggnggnggtctanntatctatttncacacncggggnatgataaancgncgtaagnggttctcactcantntgagtngggtatataatatatannattatccanncgtncatnanaatggatacgcnnncgtattgattttgnatncaccncgtnncatatnctncggcgcaccactaggtcgtgnganctaacnnacctcacatcgcttctggtgngnctnnntnanganncgnncgaanacttcggatataantnannatgacagntatncttnattngtgcccannaananntanncngncanntatctctngtaaatantggtannagactcgnnttgatatntancntcngtnatgttcngatctnnccattcnaacnaggctacttannaaacccnnnnngtgannntgngtngcntntnnaannangntcncntatgtnnngnnnntcccannnnacnancnnatnntccnnattatgtgngangggtcgnaaangttntnnannnantctannagctnnncantganncgngcatngtacnnnangaacntatcgnctncnntnntgtgaanttnncgcgntgacnantncnntggtnnagcgngcnaccncttngaactngtctnctcctaatnccctgnnngatnggntatatnnnttgttntcgncntggganngtntattgntgtgcntatctatanatgtgcccctcgctgagacnacgaggttgtatnctgnnaannagntnnattgtggngtnnaatangcctnagcnnaaaaatgtgnnnaacacacnatttntgtaacacnactcgtntnttgtntntnaccncaanagangccgnggggagtntntaaantnncatgtnggggtctatactcacacngnggnanacngttantcangatgacgaganatncactnggcacgtgngngaaggncacagnttactatgttgnnaagananagnaagcgatatctctcctcgncgatgtctnataccnnngcnnccgtanatataagngantgtaggacntnactaacgnnccacncnt

SEQ ID NO: 8380 - DNA, 734 bp, Homo sapiens
  misc_feature 4, 5, 7, 177, 466, 507, 544, 592, 594, 642, 659, 676, 684: n = A,T,C or G
accnngntcgaatcggcacgacctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgntgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaattntttttttcaaatttcatacaatcatatttcccagtactttncacaatcattttttacccatctaactctatgttttgnggcttcccggtctcttagaactttgaaaacatgatataccaataatgntnatttattatccatccggattctgaaataattttcctactggatggttnagctcacacttatctgnaccttttttaagaaganaaaaagantcttgaattggatatatttatttcgctttacagaaaaaaatgggttccca

SEQ ID NO: 8381 - DNA, 719 bp, Homo sapiens
  misc_feature 7, 264, 626, 647, 671, 677, 701, 702, 706, 714: n = A,T,C or G
acctcgntcgattcgcacgagcccagagcaccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgngacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaaccttccattagccaagtgggaaatgtagacactgcttcagaacttgagaagggggtgtctgaggcttgcagtcctaaagccttctgaagagttacctgctgagctcctcatccgttgaacccgaaaaggattctggcttaacagcagaagctccttcgttaganactggaatttgtgaaaatgtnacagtgacctttctggaatgtaancttgangtgtcaaatgctgtattttatccnntccnttgtctgnagccc

SEQ ID NO: 8382 - DNA, 764 bp, Homo sapiens
  misc_feature 1, 2, 5, 12, 15, 23, 26, 29, 32, 33, 35, 47, 62, 70, 74,75, 84, 94, 96, 97, 98, 105, 106, 110, 111, 133, 143, 179,193, 198, 207, 236, 250, 258, 266, 268, 281, 293, 344, 351,369, 389, 425, 465, 470, 483, 486, 496, 502, 509, 520: n = A,T,C or G
  misc_feature 538, 554, 562, 563, 569, 576, 587, 595, 597, 598, 604, 608,609, 620, 637, 642, 659, 660, 663, 671, 674, 675, 676, 677,692, 693, 699, 703, 704, 712, 717, 721, 724, 726, 737, 742,746, 751, 759, 760, 762, 763, 764: n = A,T,C or G
nntcnttctgtntcntcaaggtnttnttntcnngnatattgcagtcngcacaattgagaganccaatggnctgnncaatcgccncatagagganannnacatggnnctgnnaggaatggtggttgtggatganttacatatgntgggagactctcaccgagggtatctgctggaacttntgctgaccaagatncgctntattactcngaaatcagcatctcgtcaggcagatctanccagttctctgtcnaatgctgngcaaatcncngggatgagtgctncccttcctaatntggagctcgtggcttcctggctgaatgctgaactctaccataccgactttngccctgnaccgcttttggagtcagnaaaagttggaaatcccatanatgactctttcaatgaaacttgtgagggaatttganccccatgctacaagtgaagggagacgaggaccatgttgcncagtnatgttatgagacnatntgtgataacnatttcnctattantttttttgccnatcaaagaaacggtgtgngaaagcctggcatatntcattgcnngagaantttaatnaccttacattnatcaaacngnnggggantggnngaaaccccttntgaatgcccaccccgtnatttnttggaaaaaaaaaagannttntttggaanctnnnnggggaacaaatatannaaaccnttcnnccttttangaacngggnacncntgtcttaaaanaaaanttgncaccnatgggggnncnnn

SEQ ID NO: 8383 - DNA, 995 bp, Homo sapiens
  misc_feature 2, 3, 6, 7, 8, 9, 10, 11, 12, 14, 20, 21, 22, 23, 24, 25,26, 27, 28, 29, 30, 34, 39, 40, 41, 43, 46, 48, 49, 50,51, 52, 54, 56, 57, 61, 62, 64, 66, 67, 68, 69, 74, 75,78, 79, 80, 81, 82, 83, 84, 85, 87, 89, 90, 92, 93, 95,99, 100: n = A,T,C or G
  misc_feature 101, 102, 104, 105, 106, 107, 108, 110, 111, 112, 115, 117,118, 120, 123, 124, 125, 129, 138, 140, 142, 143, 144, 145,147, 149, 150, 151, 160, 161, 163, 166, 170, 171, 172, 177,180, 187, 188, 190, 191, 193, 194, 199, 202, 207, 209: n = A,T,C or G
  misc_feature 213, 217, 219, 220, 221, 226, 229, 234, 237, 241, 253, 254,255, 260, 277, 279, 290, 315, 337, 343, 525, 533, 633, 641,707, 708, 723, 734, 779, 786, 795, 797, 809, 816, 822, 839,857, 867, 893, 897, 904, 908, 932, 939, 942, 948, 953: n = A,T,C or G
  misc_feature 954, 961, 980, 992, 995: n = A,T,C or G
cnncannnnnnncnactgcnnnnnnnnnnnatancgaannncntanannnnnantnntctnncntnnnntcacnnaannnnnnnncntnncnnancttnnnntnnnnntnnntangnnanttnnnttantttaatgcntntnnnntnannntcgcgcccnncntcncatnnntcccntcnctccccnnanntnncaagngtnctttngnaaantcangnnngattntancttcngtncccnccccccctctannnttcgnacctgcaggcatgcaancnttgagtttttntataggggtacctaaatagcttggngggggcattttcatagctggantcctgngtgaaaattgttatccgctcacaattccacacaacatacgagccggaagcataaaggtgtaaagccttggggtgcctaatgagtgagcctaactcacattaattgcgttgcgctcactgcccgctttccaagcgggaaacctgtcgtgccagctgcattaatgaatcggccaaccgcgcggngagaggcngtttgcgtattgggcgctcttccgcttcctcgctcacttgactcgcttgcgctcggtcgttcggctgcggcgagcggtatcaagctcactcaaaggcggnaaataacngttattccacagaatcacgggggataaccgcaaggaaagaacattgtggagcaaaaaggccaaccnnaaggccagggaaccntaaaaaagggncgcgttgcttggcggttttccattaggctcccgcccccctggacngagcatnaacaaaaantncgacgcttcaantcaaganggtggncgaaaacccgacaggantaataaaagataacccanggcggtttcncccctggaaagcctccctccatgccncctntccttgntccnaacccttgccgcttaacccggaancttgccngcntttttnccttnngggaaancgtgggcgccctttctcantagctcaccctntan

SEQ ID NO: 8384 - DNA, 758 bp, Homo sapiens
  misc_feature 1, 577: n = A,T,C or G
natattcgatcaagctacttgttctttttgcaggatcccatcgattcgaattcggcacgagtggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgctttaggagtcctcacccctcagactgctgcaggacattgccaggcctctctccacttccttcctcagcatacagacttcatgctatcttccaattccggggagtcttagctattagggcagtttctgcttctccattttggggacaaaggccttgcccagtacaaatctagccccttgtcccacagacttctggatggtataaacctagtggcaatgtancaaccataggctagaaccaaacccaagatttgggtcagtgccctgttaaagggttttaggattggtaaggacaccacagctaaatctgacatgtaaaaggatacccttcccttgtccactacgggtggaggctaaggacctcctcaaatcccacaaaatggctggtgacattggcacaagg

SEQ ID NO: 8385 - DNA, 728 bp, Homo sapiens
  misc_feature 5, 8, 11, 39, 631, 664, 700, 713: n = A,T,C or G
tttantcnttngcacatgtctacccagaaattttgttcntgacctgacgcccaccttctatggtgccatcaagaaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggacttcctaatccttgcaacaacattgggcccattttctttccttcacaccgatggaaganaccattaggacatatatttagcctagcgttttncttgttctagaaatagaagcttccaaagtagggaangcacttggggganggttcaaggcacaat

SEQ ID NO: 8386 - DNA, 1460 bp, Homo sapiens
  misc_feature 6, 7, 10, 11, 12, 13, 14, 23, 24, 25, 26, 28, 29, 30, 33,34, 37, 39, 41, 42, 43, 44, 46, 48, 50, 52, 54, 55, 56,58, 60, 62, 65, 69, 70, 71, 72, 73, 74, 79, 81, 83, 84,85, 87, 89, 90, 91, 92, 98, 100, 101, 106, 107, 113, 118,121: n = A,T,C or G
  misc_feature 128, 131, 132, 137, 139, 142, 144, 146, 150, 153, 154, 158,159, 160, 165, 166, 168, 173, 185, 189, 190, 191, 201, 202,204, 206, 208, 209, 211, 215, 216, 217, 218, 232, 233, 234,247, 248, 255, 268, 271, 275, 279, 282, 284, 287, 291: n = A,T,C or G
  misc_feature 293, 296, 298, 299, 302, 304, 308, 309, 310, 318, 334, 338,342, 347, 348, 349, 351, 352, 355, 366, 369, 373, 376, 380,381, 384, 385, 391, 392, 395, 396, 401, 406, 409, 414, 416,417, 418, 419, 425, 427, 431, 435, 438, 440, 442, 443: n = A,T,C or G
  misc_feature 445, 452, 454, 455, 461, 462, 464, 465, 466, 469, 472, 473,475, 476, 483, 491, 495, 496, 498, 501, 502, 503, 506, 512,519, 529, 545, 549, 558, 571, 572, 573, 574, 575, 576, 577,581, 585, 596, 602, 603, 607, 611, 614, 615, 616, 620: n = A,T,C or G
  misc_feature 622, 625, 629, 633, 635, 637, 638, 645, 647, 648, 649, 651,655, 658, 659, 664, 669, 670, 672, 677, 680, 685, 687, 689,696, 698, 704, 706, 710, 711, 717, 718, 719, 728, 738, 740,747, 757, 761, 766, 770, 774, 775, 778, 805, 808, 809: n = A,T,C or G
  misc_feature 817, 842, 844, 851, 852, 853, 866, 877, 878, 888, 890, 892,897, 909, 929, 931, 932, 942, 952, 954, 958, 960, 962, 965,969, 975, 976, 977, 978, 984, 988, 992, 994, 1013, 1016,1017, 1023, 1025, 1027, 1034, 1052, 1059, 1061, 1062: n = A,T,C or G
agcggnncgnnnnncggggaagnnnnannnagnnaangngnnnnangngnanannnanangnggnaaannnnnngagcncncnnngngnnnnacaagngnnaaggnncagaangggancangcaacgnagnncgagngngcngnanaagnaannaagnnnggganngnagaanagagagcagagnagannnaacggcggcnncncncnnangttnnnngaaaccccgtttgnnnaaaaccacccagnncaggaanaagaagtagagcnacnaaanagcnagncngcngagncnggnannaanangaannngggggggngggggggggggggaanggcnaacnctttnnngnnacnagggcaagggnaanccgnagngcannggnngggggnnggnnacacnaagcnagnaaacnannnnataaangnggangagnagngngnnancgggggnannaagggnnannnggnaanngnncgagaanagaagggngganngncgnnncanaagggnggcaganagggaaggcnggaaaaagggaagganaccnatgggggangagaagggagagnnnnnnnaggngcanaggagcagaancgcaanncganaagnggnnngggncngancganaaantngnngggaganannngngganccnnggggngaganngnaaacncangggancnanaggcaangngtgcgngncgcnnggaagnnncggaagagncgcgatcggngngaacgcngagcgcagancagntcggnaagngagnncgnaggcaacgggaagaagagcggaggagnacnngaatcgcngagaacgcggaggagcgcgcaggangngcgggannngagaacagaacgnatggaagggannggagaggganangngagantcaaagcatgangacagaaacacacgagagangnncggagaaaangacgaggagngngganananagngaangagacnnnnaggaanagangggnangaaagggaatggagaaagnganngaggananangacgcgngcgagagcggataacgcngaacgcnanngaantngagnaacacacgcgngcncacgcncgcacngaccacnganngagacgnagcatngngagaggcggnnaacngcngacgagacacantcaaganngncgnanccnacggcgancgnggngaacangnntngacganangcacgaacgggagcgaaagntncngaaangnnanngantagaagcagaancgnaacngnaagggnccaggcgnaaaggntnggcccngcaagagnngagcnnagagganangnggaaagangcgcgggnntganncncaaccgaccgnggcgannaganntnncgcnagggnaggnnanggatgaggnanaacnnnaggggagnnngnatagngaagccagagaagcaggcngcnagangnagnnngangggacn

SEQ ID NO: 8387 - DNA, 1412 bp, Homo sapiens
  misc_feature 3, 4, 9, 13, 17, 24, 26, 28, 32, 35, 36, 37, 39, 40, 43,44, 45, 46, 47, 51, 55, 56, 62, 65, 68, 72, 73, 77, 78,80, 81, 82, 84, 89, 97, 100, 105, 109, 110, 111, 113, 115,124, 131, 132, 133, 134, 135, 141, 143, 145, 148, 150, 151: n = A,T,C or G
  misc_feature 153, 154, 155, 160, 164, 179, 181, 182, 190, 191, 196, 199,201, 202, 207, 212, 213, 216, 218, 219, 220, 222, 223, 229,231, 236, 274, 283, 290, 292, 294, 306, 320, 333, 338, 339,344, 349, 351, 358, 361, 366, 372, 379, 382, 392, 393: n = A,T,C or G
  misc_feature 400, 401, 404, 413, 414, 416, 418, 424, 426, 430, 432, 437,439, 457, 459, 472, 480, 481, 482, 485, 486, 492, 494, 500,502, 504, 510, 518, 522, 523, 525, 532, 534, 541, 543, 547,548, 549, 551, 552, 554, 555, 556, 558, 565, 567, 569: n = A,T,C or G
  misc_feature 570, 576, 580, 582, 588, 591, 595, 599, 602, 603, 605, 607,612, 613, 615, 616, 621, 624, 625, 627, 628, 639, 640, 641,645, 651, 652, 656, 660, 662, 665, 669, 671, 673, 675, 676,678, 685, 686, 687, 689, 691, 694, 695, 701, 702, 705: n = A,T,C or G
  misc_feature 708, 711, 715, 720, 727, 730, 733, 741, 742, 744, 746, 748,751, 758, 765, 766, 771, 776, 781, 782, 784, 785, 787, 792,794, 795, 797, 799, 800, 807, 808, 810, 813, 818, 826, 827,829, 832, 836, 848, 849, 851, 852, 853, 854, 861, 875: n = A,T,C or G
  misc_feature 879, 880, 883, 886, 890, 891, 892, 893, 901, 906, 913, 916,917, 918, 919, 922, 924, 928, 932, 937, 941, 946, 948, 955,957, 958, 960, 966, 969, 971, 974, 976, 980, 982, 983, 984,1001, 1004, 1006, 1010, 1012, 1013, 1014, 1020, 1026: n = A,T,C or G
acnnccggntcgnaggncaatggngncngtanaannnannggnnnnnaaanaaanngtgaangcntantacnngcgnnannngngttanctacgtangangaaanggtnnncncngctgcgagnagctaannnnncgggancnanagnannannnggatncganatagggacgaaggananngaatcgcnnagacngangnngaaantgcgnngtncnnncnncccacncnggttntgaaaacccccgttatacggccccttcttcttcccganggacacagngcagccncntnaccccccgtcgncactggagaaaatngtcagaggagccncgggnnggggnggggngnggggcgnctnatgtnttaaanttttggngangaacgcagtnntggaggnnacnagcatgcgnnangnccatanantgcnangggancnggcagggatggcatctgntnacccccaaccgancgacgccnnnaannccgggngnaccacngngnccacgnccccggangcannanaagccangnaggccgncnaggnnnannannntngggcacnananncaggangacngnaggagncgngccngcanaannangngtacnngnnacganaannanngccggaagagnnncgcngatacnnccgnagancnganaaangngnannanaatagcnnnanangannagacgnnggnccntcnatgnagaangagaaancanacntggacganncntngnagngatgggnttgcatnnccacngggtnccacnncnnantcatngnnangnncgaaagnngngangaaanagcagggnntntgnaggncaaatgcggacnncnnnnggggtangcgagaatcggaanatcnnctngangggnnnnacgcctcnagtcntcgcgcncannnnagnangggngganagacntatntagangncgaccantnnangacacngangngcntntgantnnnagagacatagatcagtnganangtancnnnaatgcntctcanagagnnncaanaaacggattnggactntatcatgtgnngcagnggnnaanaaanaaactcntncgcgagnatgtnntgcgnttnaanncgncgatactnangtaagaaananacnccccgtanangngantnatcnacgcnngggnnngcaagaaaaanacctngaaanaagangggaaagnnangaatnnggacccgatgcaagnganacngtctaacgnacaaggtgacacaacncacgagncgatcgaagtcacngtcaccggcaaaacggnggnnnttctcaaaangggngngatantacgtgctcacgcganngggacanatananngactgantgtnaagagcanaacgaccatgcttcanacgngggnganacccgcgc

SEQ ID NO: 8388 - DNA, 775 bp, Homo sapiens
  misc_feature 25, 34, 39, 42, 43, 51, 61, 62, 67, 83, 88, 104, 116, 134,135, 144, 153, 173, 175, 211, 216, 262, 273, 280, 287, 300,312, 353, 359, 391, 418, 421, 436, 457, 467, 474, 481, 484,496, 509, 516, 517, 522, 523, 527, 541, 549, 551, 552: n = A,T,C or G
  misc_feature 554, 561, 570, 575, 605, 617, 618, 637, 651, 652, 670, 671,682, 698, 701, 732, 741, 757, 769: n = A,T,C or G
tgttattcgttcaactcttgttctntttgcgcgngctcncanngatccccnattcggcacnnggtgncttctgtggaaaaaanattanttctttaccattgcancgttctgccctnggtccaaatgttaccaanntcactctanaatcttttnttgcctggaagaaaaggaananacaagaaaagattgataaacttgaacaagatatggnaaganggaaagctgacttcaaagcagggaaagcactagtgatcagtggtcntgaagtgtttnaatttcntcctganctggtcaatgatnatgatgaggaancagatgattcccgctacacccagggaacaggtggtgatgangtttangattcatttgagtgtaaatgacatagatttanccctgtacatcccaagagatgtatatnaancaggtattactgtanccagtcttgaaagattcaacncatatacttnagataangatgaanacnaattaagtgaancttctggaggtanggctgannatggnnaatnaagtgacttggacngaggacancnnanagggagngaacggaanatggngccactagatgctgttcctgtttgatgaanatcttttcactnnaataaggatttggattganctttagaacaattnnattacacttggttttgannaaatgacaccnttcacttcgcttgtanaanattatgtcaactcatcccgagttgaaattgnctacattantttctttccaccttgnatcaactgatgntttttc

SEQ ID NO: 8389 - DNA, 1186 bp, Homo sapiens
  misc_feature 3, 6, 9, 10, 12, 14, 18, 21, 26, 29, 32, 33, 35, 36, 39,41, 42, 44, 46, 47, 50, 53, 54, 55, 56, 59, 61, 62, 65,66, 70, 71, 73, 79, 80, 81, 84, 88, 89, 92, 97, 100, 101,102, 104, 106, 112, 113, 115, 116, 117, 119, 122, 127, 128: n = A,T,C or G
  misc_feature 136, 137, 139, 141, 142, 146, 147, 149, 150, 152, 157, 159,160, 161, 162, 168, 169, 171, 172, 173, 175, 178, 180, 181,182, 185, 186, 187, 188, 191, 194, 195, 203, 204, 206, 208,209, 213, 216, 217, 224, 228, 238, 242, 245, 246, 247: n = A,T,C or G
  misc_feature 250, 251, 252, 253, 258, 264, 266, 268, 270, 275, 277, 278,280, 295, 307, 314, 315, 324, 328, 338, 339, 340, 341, 342,349, 353, 355, 356, 358, 359, 361, 363, 372, 373, 375, 381,382, 392, 394, 395, 398, 399, 404, 406, 411, 413, 416: n = A,T,C or G
  misc_feature 419, 423, 451, 454, 459, 467, 470, 472, 475, 480, 482, 495,502, 505, 507, 510, 517, 523, 525, 530, 548, 550, 551, 555,562, 581, 585, 594, 603, 607, 610, 611, 612, 613, 618, 622,628, 630, 633, 634, 638, 640, 650, 652, 653, 654, 656: n = A,T,C or G
  misc_feature 659, 667, 668, 672, 673, 697, 698, 699, 703, 705, 706, 708,710, 721, 726, 735, 738, 748, 749, 750, 754, 756, 758, 764,766, 777, 778, 779, 788, 795, 799, 801, 808, 812, 824, 835,837, 840, 841, 848, 849, 850, 851, 855, 862, 863, 877: n = A,T,C or G
  misc_feature 883, 885, 888, 890, 893, 907, 910, 917, 922, 935, 936, 938,947, 950, 955, 959, 963, 970, 975, 979, 985, 992, 997, 998,1001, 1003, 1013, 1016, 1018, 1020, 1021, 1031, 1038, 1040,1041, 1046, 1060, 1063, 1065, 1071, 1075, 1078, 1087: n = A,T,C or G
cgncgnganngnangggnggngggcngcnggnngnngangnngngnngangannnngcnanngcnngcgnncnagcgcnnngangcgnngcncgcgngcnnncngncgcgcnncnnngncgncgggnngcgggggnnangnngagnncnngngcggncnnnngcgggnngnnncngcngnnngannnncangcnncacccccnnancnngagngannccttcgnaacnacccggccgnggancgnnnagnnnnccccncccccngncncngcggncnngngcgggggggggggancacctttttgcngcccagnnggccacggncgcnccggggggcnnnnngaacgancgcngnngnncnangggccgacnngnaaaccnncccgggggancnnggnncggcngngacgnanccnccncacngaggaccggcggtgcgccggggcaaganggnccggnagccgcancangnggncgagnangggccggccgcgngggcacnagncnagnggcccgncacggncnccganccgaagcagggggaggancnnacgncgggganaaggggcccgccagcacgngganggcaggtgnggcctcatngganccnnnnacccnggangagggnanggnnggcncncaaggggggngnnnangangagcccgnnccgnngccaagctgcagcccgcgcggggnnnggcncnncncncggggggggangaccnaacagcgcnccncgcggagacnnnggangncnacaggncncccccgcgggnnntggggcgancaacgcncggngnggggccncagngaccgcgaggangcagacacccncnccnncgggggnnnngccngccgggnncggcgccgggagancggcgncncangnagngggaaacgccgccnggnaccccgncgcanaggcgcggcgcgnnanagacccggnganccccngggngaanggcgganacacngggngggggngggtctngcgcnnaancnggggcgctgncancncnngccacgcacncggcgcngnnggccngcggcgcccccgcngancngagcangggnggnagccgcccnnaccngnnncgcggccacgccagcggncgcacgnagngncctcgggggcgcgnnaggcgncnangcnncccgnccgcgngggggncgcggcncgngccg

SEQ ID NO: 8390 - DNA, 1338 bp, Homo sapiens
  misc_feature 2, 7, 8, 10, 12, 18, 23, 24, 25, 26, 27, 28, 30, 38, 39,41, 42, 44, 45, 48, 49, 50, 56, 67, 74, 75, 76, 79, 81,87, 88, 89, 92, 94, 100, 102, 103, 105, 108, 111, 116, 127,129, 131, 132, 137, 139, 142, 143, 144, 146, 149, 150, 151: n = A,T,C or G
  misc_feature 152, 153, 159, 165, 176, 177, 178, 179, 184, 186, 192, 193,196, 199, 204, 208, 213, 219, 223, 232, 236, 237, 240, 243,245, 246, 247, 251, 254, 255, 258, 270, 279, 291, 292, 294,296, 299, 301, 307, 312, 313, 316, 322, 324, 326, 329: n = A,T,C or G
  misc_feature 337, 339, 347, 349, 352, 353, 362, 364, 368, 369, 373, 377,378, 383, 384, 390, 391, 396, 401, 408, 413, 416, 423, 426,427, 428, 433, 436, 442, 443, 445, 451, 460, 461, 462, 468,469, 477, 479, 480, 481, 485, 486, 489, 490, 491, 493: n = A,T,C or G
  misc_feature 496, 505, 506, 508, 509, 510, 514, 515, 521, 523, 525, 531,537, 538, 542, 547, 549, 553, 555, 556, 570, 571, 575, 576,578, 579, 581, 585, 587, 588, 589, 594, 606, 607, 612, 615,617, 618, 619, 623, 627, 638, 639, 641, 642, 644, 648: n = A,T,C or G
  misc_feature 650, 651, 662, 664, 665, 668, 672, 677, 678, 682, 698, 703,706, 711, 713, 714, 717, 732, 738, 741, 747, 750, 753, 754,756, 757, 758, 760, 761, 762, 763, 764, 779, 784, 787, 790,791, 797, 800, 804, 808, 810, 816, 822, 841, 842, 850: n = A,T,C or G
  misc_feature 852, 854, 856, 861, 877, 878, 879, 883, 885, 887, 888, 898,906, 921, 928, 936, 937, 944, 946, 947, 950, 957, 962, 964,966, 969, 979, 980, 982, 985, 986, 988, 990, 993, 997, 1003,1004, 1008, 1011, 1017, 1019, 1020, 1024, 1037, 1043: n = A,T,C or G
anaaccnncngngccggngacgnnnnnnangaaaaacnngnnanngannngggaangaggaaaaaangaacaannnaanangaacannngananggaaangnngngangangaaangcgcaggaaanangnncaaananggnnngngannnnnacgagngagggnacgcagagaannnnaacgnanacgcgnnggngancgaangaanatcgnagaganaggnacagaaagnagcnnacnacncnnncccnccnnggntgggaaaacccncgtttgggnaaaaaccccccnngngnagnanggaaanaacanngcngagagnangnaancggaaagngnaaacaaangnagnnggggggggngnaagnntttntttnnaatannagagannggacnggganaaaaggnggagnaanggaaaancannnaaacncanaagcgnntntatcanagcgcacgnnngagaannacgaacangnnnacgnnaannngnaantaggaaganngnnnaaanngaaganananggaagnagccgnnaaancgaangngaanannacgggagacacgannaaannanncncacnannnatagnaaatgaagaggnnagggnggngnnntganaacnggacggaaggnncnngngaancnnaagccacaagntnngcnaaangcggnnaacnagacgaacgagacgcngacancgnaacancnncgnaacacaaaagccaanaggganacnagaagnggncgnntnnnannnnngcaaagggacacagnctggnaanganngaaagnggngctngccnanacggancaaggnaacgggaaaagggggccgnngaaaaaancnancncacanggggaaaccaaaacgnnnaacngntnnagaaatacgnaggggacnaaaggggggaaagcnaacaagnagcgagcnnggggagnannaanggggggnagacncngncgnaaggagggtnngnggnncnangancccnagcacnngcgngcnggaaancnncacnaaggggcgagaanagaggnanaaggnganncgaacagaanannaacaacnacagggagggcnagaaagcgagggnacnangnactnaaggcggaacncgaangganaaggnnnncacangcacgggaaagnnncaccncnnncnanngngngaaaaanggcnaantcgctaaagagaanagnaanangaaccaangggangaanngagggaaaaanncncngcnnagnagantcgncgnangagaaaaaagagaaaacagaanggganagcggnggcnancncngaanggggagagaggcgcaaggcnnatccg

SEQ ID NO: 8391 - DNA, 1013 bp, Homo sapiens
  misc_feature 3, 4, 16, 18, 49, 51, 52, 55, 58, 59, 74, 79, 100, 105, 111,156, 180, 184, 208, 213, 220, 222, 227, 228, 264, 277, 292,297, 326, 335, 444, 654, 826, 827, 839, 922, 934, 962, 1005,1012, 1013: n = A,T,C or G
gannactgaaaaattntncccttaattaaccttccaagggccctattgncnnggnggnncttgttttttttggncccangggccaattcccccccaattnccggnaatttnccccggtggggaaccaattttttgggggtttttttgggttgggtncctgggcctttaaaaaaaaatccnaccnttaaaaatttaaaagggccctttngggtngggggtntnggccnncccaaccaattgggaaccgaaaaaaaaagggggggnaaaaatggcccantttttggccaatggnaacancaagccattttccaataaggggttccccngggccaccnttttttggttttctgggaaccaagttattttttaaccaagcttttaattggaatggaaatatattggtactttgggaattggccctgggttttctctttctttgatttngatccgctactgtgtcagtgtttgcaatcagattgcgtctcacctgcacatacatgtctttcagaatcaaggtctctacagctcattctaatcatcattaatgatgtaattggtatataggaacatcatgttttctgcaggaaagaaagtaacatattaagggagaatgggggtggataaagaacaaatataatttataataatcaatgntggtataacttttattctttattattggtaacacgccctaactatcctgtgtgagaatgggaaatttcaagtcccatcttgtaaattgtatatgttggtcatgcagggtttgggccaagaaagcattgcacaaaaaaaatgccatgtgattgtaaattatcctgggattcannaataaatactgnggatgggggagcccccatccgcagtgggtgggaagaagttcctaatggttggactggtttgccaggcccaaaaagaatgaatngcttttaataantttaaacaaaatcattgggcctttttantaaaccatccccttggttttaggggggccttcttcaagccctntcctttnn

SEQ ID NO: 8392 - DNA, 1694 bp, Homo sapiens
  misc_feature 5, 8, 10, 15, 22, 23, 24, 25, 26, 29, 32, 40, 41, 47, 49,51, 52, 53, 59, 61, 62, 64, 66, 68, 70, 72, 74, 76, 81,82, 91, 93, 95, 113, 115, 118, 126, 130, 133, 134, 138,139, 142, 143, 150, 152, 157, 163, 164, 166, 177, 185, 188,191: n = A,T,C or G
  misc_feature 194, 195, 196, 197, 198, 200, 206, 211, 217, 223, 236, 240,241, 254, 259, 260, 265, 267, 270, 271, 274, 275, 292, 298,305, 306, 307, 310, 314, 320, 326, 330, 332, 336, 346, 348,354, 361, 363, 366, 369, 371, 375, 385, 386, 395, 399: n = A,T,C or G
  misc_feature 400, 405, 409, 410, 411, 414, 415, 421, 442, 443, 451, 458,464, 468, 469, 472, 476, 480, 485, 489, 494, 496, 498, 501,505, 507, 517, 520, 521, 522, 523, 529, 532, 539, 540, 541,543, 544, 545, 553, 555, 557, 560, 564, 570, 571, 572: n = A,T,C or G
  misc_feature 575, 581, 583, 585, 586, 588, 592, 593, 595, 602, 607, 611,616, 617, 622, 623, 624, 628, 629, 631, 632, 638, 640, 644,647, 655, 657, 658, 660, 663, 667, 676, 677, 678, 679, 682,683, 684, 685, 687, 692, 693, 694, 695, 706, 708, 709: n = A,T,C or G
  misc_feature 710, 723, 724, 725, 727, 729, 732, 735, 743, 745, 746, 751,752, 753, 760, 761, 764, 770, 778, 783, 787, 790, 793, 794,795, 796, 797, 799, 800, 802, 803, 808, 813, 814, 816, 821,822, 824, 825, 826, 827, 830, 836, 837, 843, 846, 872: n = A,T,C or G
  misc_feature 878, 882, 889, 892, 893, 895, 897, 903, 913, 918, 920, 925,926, 931, 933, 934, 938, 942, 944, 948, 954, 955, 959, 961,966, 974, 978, 985, 986, 988, 993, 995, 1000, 1002, 1013,1016, 1023, 1025, 1026, 1027, 1032, 1039, 1041, 1044: n = A,T,C or G
cgacnttncngtgtntatgagnnnnntancgngataaagnncgtgtngntnnntatatntnntntnantnantntnacgannctgtggatncngntgtgcatgtgaggtgatngnctnattcgctntctngtnntcgnncgnntgtatgntnatgantatgtnncngagatgtgtgnatgaatgntantanacnnnnnanattgtngaaanaccccncttcgnaaaagaacccccnggtnngttatatgtgtantactnncgctntnatnngtnnccgacgccagagtgttnagattngatgagnnntanatgngtgggngggggngggngntgantgtatatgtntnataatntaggtangntangtntngagngtatgtggtnngtagacagncggnngtgantgtnnngtnnctttanaagtatggtcgtctatcgcgnnattgattntttattncatagngttnntantgtnggangtttnatgntacanantngtngagnanggtcgattanttnnnngggcgnggngagatgnnngnnnatgacagntngngcngtcntgagannnagnggtgtngngnncnttcnnangtgtagntttancttntcgtnntgacnnngggnntnnaatggncngggngtnaggatgtnanntnggntatnagtatgagnnnnggnnnnantcgannnncataaatgtangnnntgtgctgatgtgnnncnanggngantggggaantnngtggnnnttatagnnatnatcgancgtgttcnaatgnttgntgncgnnnnncnngnnatgtnatgcnngngtgcnntnnnntcngtgtgnnttaaanctntgttgggttgggtgtgtggtatgatngcaggncatngtatctngtnncnanatggangagcggatgntggtnanatatnngatangnngatngagngntcgnatgagnnatgngncgcgngtatgagntcgnatggtgnntntatanangggtntncacgcgtggtngcncgtgtgntnnnctttntagcgcntnggntgcgtactanntgnnaggggnnnaananntnntnnnaacntaanngnncncgtgcnangntcgcggncatctggtnncgntngaagaatagtcntagtgacgagcnggacgttcnctgcnntatnaccnnacncgtgnngatactannagatgaggtnncgactgganatnnttnnatnatcatnnaatnttnangangggaagganncgtccntnggnnggagattntntgngnanngcgnagtgnnntcgngancgtgatngnatangggnantaggcgnntagnanttgtgatgatgaaggggtctataagcgtggtnagnttggtgntgaggtatgagacnnanatgtntagatatnctatatgaggatganntangggtcgatgtcgatgtctngggtntntntnggataatngcatacgtcgntntntnnngancntntnacagtttanancgaaatatatnntanncgtgcgacncaaatatgaattgatacaatacggtgtangnggttttatgtatntgangntganangtgtgtnancnttatgatgacnggtatnatcgtatntgccggtancntcgnatntgtanatgtgaacgatntcgcanngnnactantntgcntatgtntnnnantgatccgt

SEQ ID NO: 8393 - DNA, 768 bp, Homo sapiens
  misc_feature 5, 50, 51, 61, 67, 74, 76, 100, 124, 131, 148, 160, 161,167, 176, 206, 266, 286, 306, 308, 340, 360, 361, 370, 378,390, 395, 418, 454, 492, 613, 664, 665, 669, 678, 694, 718,730, 756, 760: n = A,T,C or G
taatncgatactcacgcttgcatgcctgcaggtcgactctagaggatccnnattccgcacnagacanaacctcntnattaaagacaaatttatcagaaanatgggtgcacaaagagggctttantggcttnaagaggtatgtgaccgntgccgatgacanngagctngaagccaanatcgcagttgttgaaaagtataacatcagngattccagagctggtgcaaagggatagaaaaatgccatatatgaagatttggactttgcntagtacattctgggcactgngcacaaagccaaaggcctgnantttgacactgtgcatgttttggatgatttagngaaagtgccttgtgcccggnntaacctgtnccagcttncgcacttcaganttgantcattttctgaggatgaatggantttactgtatgttgcagtaactcgagccaagaagcntctcatcatgaccaaatcattggaaaacattttgactntggctggggagtacttcttgcaagcagagctgacaagcacgtcttaaaaacaggcgtggtgcgctgctgcgtgggacagtgcaacaatgccatccctgttgacaccgtccttaccttgaanaactgcccatcacctatagcaacaggaaaggaaaacaagggggggctaccnnttgncctccttgnccggagcaacgcatcnggccccttggcgtttcttgaaagncttcccggacangtgcgcccccatggaaccgcactggngganaaaaatcc

SEQ ID NO: 8394 - DNA, 1407 bp, Homo sapiens
  misc_feature 1, 8, 14, 22, 28, 31, 32, 37, 40, 45, 48, 51, 53, 55, 56,57, 59, 63, 68, 70, 72, 74, 75, 77, 79, 81, 87, 88, 91,105, 109, 110, 116, 124, 126, 129, 151, 159, 168, 171, 176,179, 180, 182, 183, 185, 189, 192, 195, 198, 206, 208, 212: n = A,T,C or G
  misc_feature 214, 220, 221, 222, 224, 227, 228, 238, 241, 246, 248, 250,251, 253, 258, 278, 280, 293, 295, 297, 300, 302, 304, 307,309, 320, 321, 322, 329, 335, 338, 341, 342, 344, 346, 347,348, 352, 353, 355, 356, 357, 359, 365, 368, 370, 371: n = A,T,C or G
  misc_feature 372, 377, 378, 381, 397, 399, 402, 408, 416, 418, 419, 425,426, 429, 432, 443, 444, 445, 449, 455, 458, 460, 461, 467,472, 479, 484, 490, 491, 493, 502, 503, 505, 511, 517, 518,519, 523, 527, 528, 530, 531, 533, 534, 539, 540, 544: n = A,T,C or G
  misc_feature 545, 550, 551, 554, 558, 562, 563, 565, 566, 568, 574, 575,577, 578, 579, 581, 583, 585, 587, 590, 592, 595, 598, 603,604, 607, 610, 611, 612, 614, 616, 618, 624, 628, 629, 630,632, 634, 635, 639, 641, 643, 647, 655, 656, 657, 661: n = A,T,C or G
  misc_feature 663, 670, 673, 674, 687, 690, 691, 693, 694, 695, 697, 704,708, 709, 710, 719, 721, 722, 724, 727, 730, 736, 740, 741,742, 745, 746, 750, 754, 756, 760, 761, 763, 769, 770, 776,777, 782, 784, 794, 796, 803, 809, 812, 815, 821, 824: n = A,T,C or G
  misc_feature 825, 831, 832, 833, 835, 838, 841, 843, 844, 845, 857, 859,861, 866, 867, 868, 872, 877, 878, 881, 885, 890, 896, 903,908, 911, 912, 916, 919, 921, 926, 929, 930, 939, 940, 942,944, 945, 951, 955, 961, 962, 963, 967, 969, 970, 978: n = A,T,C or G
nccacaancaatanaggaaggngttgtnganngggantanaaagnaanaantngnnntncacngacanangntnngnancnaagatnnaancgaagacgattgantacnngtcaanaaagggtnantantcgagacaagacaagcacatangagggcgngaaacgatnttngactnggnnannangtanatnctnacngacatgtntncacngngcaggnnnanatnngagatacgancantcacnanannanactgnggaaaaccccccttctgcananatccataccgtanantnacngncncgntnaatactgcgtnnnacaacancgcacnccncannanannncagnngnnntnacgcgncgnannntaggnnggnggagggggtgggagananatntctacnacatacgnannacgctnntanacnaactgatgaannnaccnggaccngtngnngtctanaaaanacgaganctccngagcanntncataatcannanatgctnaacgcnnncatnaganngnntnnctcanngatnnaggtnngtncggntatnntnngntggatnntnnngngnangngangngtntgnctganntcnacnnntngnangtgatncgtnnngnannaacnancnaaantggcaggnnncgantntaattancgnnaactgtagatagnccnncnnnanaggaatncgcnnnttgggaaancnnantanccngaaganggannncgnngcgnggancncgcnncnagaccnngtgatnnggaancntgtcaagatntntactggngcagcnatnagngggacnaanncaggtnnngnccncgngnnngcacatatcaangncnaggcnnngggncatgnntcnccgncacancagatncaccaanattcnaannagtnagncnaaacntannggcggaganngngnntaacangagngtgggnnncacngnnaaaaatanngancaacanagttannccnnacactgncncgcgagngangnganngcgncacanaacnnnnngaangcancatnnnnggncngagannacgaanngngnatngngcncnaaaantaattngngggggacaaaangatagggtnnnnnaaaannggngggggaatggggatcctgaanacnaaatccanantggnaggnnagcntggcgttaccnggngcgcnaatnggaancacncggntnnttnatagggnataaangnncannganggngcgggnaggaanatananncacgcaanaactcnnggtgttaaagagaaatnctnnnaaagaagnntanccgagcggtcactatgaangccgngnagangggctgtnnntnccnanttgnannncncacatntcnncangnaggaacnngactggnng

SEQ ID NO: 8395 - DNA, 717 bp, Homo sapiens
  misc_feature 1, 3, 5, 8, 9, 20, 27, 31, 35, 36, 43, 48, 54, 59, 64, 74,80, 96, 666, 667, 675, 676, 677, 678, 679, 680, 681, 682,683, 684, 685, 686, 687, 688, 689, 690, 691, 692, 693, 694,695, 696, 697, 698, 699, 700, 708, 709, 716: n = A,T,C or G
ntnantcnntcgattccgcngagaacncacntttnncagcccncctgnaggccnagganacatnaaatatggcntatatnctgtagagaatgagcntatgaatcggctacagtctcaaagggcaatgcttctgcagggcactgaaagcctgaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtataccaggctgtgggaggagggaggaaagatgaaaaaccacttaaatgtgaaggaacaacagcacaagaccagtatgatataccaaggtaataaatgctgtttatgacttcttttannaaaaaaannnnnnnnnnnnnnnnnnnnnnnnnnaaaaaccnnttctttnt

SEQ ID NO: 8396 - DNA, 765 bp, Homo sapiens
  misc_feature 7, 10, 17, 89, 119, 163, 176, 239, 242, 270, 303, 305, 316,322, 340, 396, 416, 417, 437, 450, 452, 474, 487, 493, 495,513, 522, 588, 628, 654, 679, 728, 762: n = A,T,C or G
tattatncgntcagctnctggtcctttttgcgagatccctcgattcgaattcggcacgagcaggaataatgctgacatacatacatatntatatatatatgaagagagagagagagtcncacacagacagacagacacacggagtctcgctgtgtcgcccaangctggagtgcagncggctcaatctcagctcactgcaagccctgcctcctgggttcacactattctcctgcctcagnctnccaagaagctgggactgtaggcgcccgncaccatgcccggctaattctttgtatgtttagnanagacggggttncaccgngttagacaggatggtctngatctcctgacctcatgatctgcctgcctgggcctcccaaagtgctgggattatangcgtgagccaccacacctgnncataatgctgatattttagntcagggtcatgcnancaacattacagatgttgtgaangactacatgttcntttgtncnaattgtccctttaaaatnaggagattncaaacaaatatttgaagctctttgaggaggggcttttcagatttaaagtgataaaccttattagtntctctttaggcagagaactgaagatacatgtatatctcanctttgtgagtggaaattctctttcanactttaacattgaaaagttaattcnaaattcttttctcatatattcatgggccttggtaaatgatgggccgaanatgtcctgttaacttgagaaaaggagaaaaattnttt

SEQ ID NO: 8397 - DNA, 755 bp, Homo sapiens
  misc_feature 2, 6, 8, 496: n = A,T,C or G
gntatncnttcaagctcttgttctttttgcaggatcccatcgattcgtgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttctcactgaagaagaagaaataccaagtgagtctagcactgaatgggacttaggtggattcagtgagccagactctgagtcaggaagttcaagttctctttctgatgatgatttttgggtgcgtgtaccgcctcagtgaaatgcacaggatcaacagggtttgntgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattttctgtgctaagggtccagtattatttggattatttagtatggttatgtttcatgacactaatttagtctttgat

SEQ ID NO: 8398 - DNA, 729 bp, Homo sapiens
  misc_feature 11, 631, 647, 722, 729: n = A,T,C or G
tttaaaccttngaatcgcacgagaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaacttgaaaaanggatgtccgctttatncaaaattacagctattggcaaataaaacgagatggataaaaaaaaaaaaaaaaaaacccctttaaaaaatttagnggagtcn

SEQ ID NO: 8399 - DNA, 778 bp, Homo sapiens
  misc_feature 18, 86, 90, 187, 260, 414, 482, 673, 680, 681, 695, 725,740, 774: n = A,T,C or G
gactatctctttcaactncttgtcctttttgcaggatcccatcgattcgaattcggcacgaggagagtggctaccttaaaaatgcntttnttgaagaactgtaacctcagaggagcaactctggcaggaactgatttagagaattgtgatctgctggggtgtgatcttcaagaaccaacctgagagnggtccaacgtgaaggggagctatatttgaagagatgctgacaccactgcacatgtcacaaagtgtcagatganaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcatangggaaaaaactgacttttttttccatattctgatttttaacagaaaagcactcatttaatagatgtanggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagccccaccatatgcaattatatttattggaattcctangatgcanntattggattatttnaaattggttaaaactttatgaaaactttgnaaaaaggttgttcangtttataaatagctttaagtgatgccctcccttntttt

SEQ ID NO: 8400 - DNA, 1609 bp, Homo sapiens
  misc_feature 1, 3, 4, 5, 8, 9, 10, 11, 12, 18, 21, 23, 24, 25, 27, 28,29, 32, 39, 41, 45, 49, 53, 54, 60, 61, 65, 67, 71, 75,77, 79, 80, 83, 89, 90, 95, 96, 97, 98, 99, 100, 114, 118,133, 134, 135, 136, 137, 138, 139, 147, 156, 188, 194, 197: n = A,T,C or G
  misc_feature 201, 205, 217, 221, 223, 228, 229, 231, 232, 243, 244, 256,258, 260, 263, 265, 269, 270, 278, 279, 280, 282, 295, 296,302, 305, 310, 312, 318, 322, 331, 332, 333, 334, 339, 348,350, 352, 353, 354, 357, 359, 360, 365, 366, 369, 372: n = A,T,C or G
  misc_feature 374, 375, 377, 380, 386, 387, 393, 394, 395, 396, 403, 408,409, 413, 418, 434, 435, 436, 437, 441, 454, 459, 465, 471,473, 476, 481, 484, 494, 502, 503, 505, 506, 507, 508, 510,518, 519, 524, 525, 527, 529, 531, 535, 537, 540, 547: n = A,T,C or G
  misc_feature 551, 554, 557, 558, 559, 560, 566, 568, 571, 580, 581, 590,603, 605, 606, 607, 610, 614, 619, 622, 628, 630, 635, 640,641, 650, 651, 652, 653, 657, 660, 662, 668, 671, 680, 681,689, 692, 695, 702, 704, 706, 712, 715, 716, 732, 733: n = A,T,C or G
  misc_feature 739, 740, 742, 743, 744, 756, 757, 761, 762, 765, 769, 772,773, 779, 780, 781, 783, 792, 803, 806, 808, 812, 814, 819,828, 830, 834, 836, 838, 839, 842, 843, 844, 852, 863, 865,866, 875, 882, 884, 891, 900, 905, 906, 926, 928, 929: n = A,T,C or G
  misc_feature 931, 933, 938, 944, 946, 948, 953, 954, 957, 963, 968, 975,980, 982, 989, 995, 996, 1009, 1015, 1019, 1026, 1042, 1046,1067, 1068, 1079, 1080, 1081, 1085, 1087, 1090, 1092, 1093,1095, 1096, 1099, 1102, 1106, 1107, 1108, 1110, 1113: n = A,T,C or G
ncnnncgnnnnntggggntgncnnntnnntcnctccctncncggngggnggcnnggggtnntgtnanggantgcngntnnctntgcccnnccccnnnnnncggtgctgctcgangagncgccgaggatatctnnnnnnncccccccnttgcggcgnctcgggggggggggggggcgctttttttttanacggcnccnccgncacnggggggggggcntttncntgccnncnncgctacttccnnttttggaaccgngngngcnangaanngaagggcnnnangcgcgccggtgcnngtgctngtngcggncnggcgtngcgngtggtgcgnnnnggcanacgtcgcgncngnnngcngnngcatnngcnctngnncncgnggggcnntgtgtnnnntaatgancgcgnnccgnagacngctctgggactctgcnnnngggncggcggcgcgtangtagngcgctngtcggntngcngtctntangctcggagcnggagcacnngnnnncngatgacgnnttgcnngngngngctntngangccgtangcgngtnctnnnnggtagngnagngttcgactnngtcacgtgnagttgactctgtngnnngcnccgnactgnccnctgcgngntgtgngtgtnngctaacgtnnnnggantcngnaagtangangacgccggnngtgttgancgntgnggtcggngnanccggcngtnngggaagcgtggtggtnngcctcnntnnnggtgtgggagcnntcgnnagntganggnncgttgnnngnggctcggcnatcttccgggngcncncgtntncgatncgctctctngnttgntngnntgnnnacgccgcncgatgccgcgngnngcgcgacgncgctcgngngctgcgncgatatcgntacannaggggaatgggacataccgngnngntngtgcncgtctnangngaggnngangcgcgnctganatgaggngagcngngagtgtntctgannactggagcgcgcngtgcgnttcntcttccngacgtacatctcaccncgcncatcggtgcgcgcgctcggannaggtacgcgcnnntctngntgntnntnncantcnctcnnngnagnacgncnggngccggtanngagnncgntcnntcacgtngngnnnncgngacanagncncncacgatntgcnacgagcgcncntcaganngangtgctgatgtgngccacgnantagngtgcgtgatatnggcngtcatggcatgngtgcgtncagtgagcnngcnntgnntcntgcgtgcancgtacgnnacacgcgagacgntctncgngctgtgcacngcgcnncgngnntnataggcacacnggcatcnngcgnatantgctgaggggancgnctgcncgnaanngcgacgtnngntgnnnacanagacgcngtgatttcacgnggccggnggntgnntncgggctggnctgnnntgnngncgtgcgtccnagtcgcgntganacgnggcgtcnanagncgaatnggagccggncgaggngtagatggggacgggagntnatngacggtggccganacgtgtccgagcttcgcggctggtngngcaccggngcc

SEQ ID NO: 8401 - DNA, 1021 bp, Homo sapiens
  misc_feature 2, 5, 7, 8, 11, 12, 13, 15, 16, 18, 20, 23, 25, 26, 31, 32,34, 37, 38, 40, 41, 42, 43, 44, 45, 46, 48, 51, 53, 55,56, 57, 58, 59, 60, 64, 65, 66, 67, 68, 69, 70, 71, 72,73, 74, 75, 76, 77, 78, 79, 102, 104, 106, 107, 118, 122,126: n = A,T,C or G
  misc_feature 129, 133, 161, 167, 168, 189, 190, 202, 203, 214, 219, 220,228, 233, 234, 235, 240, 245, 254, 256, 260, 261, 266, 267,268, 276, 281, 286, 289, 299, 301, 304, 308, 315, 318, 320,325, 336, 345, 349, 358, 361, 368, 376, 379, 381, 391: n = A,T,C or G
  misc_feature 394, 395, 399, 400, 405, 413, 429, 432, 438, 442, 450, 453,455, 458, 461, 464, 466, 469, 471, 472, 476, 479, 480, 484,485, 490, 494, 495, 501, 505, 506, 507, 510, 511, 515, 521,523, 527, 528, 535, 536, 547, 552, 554, 556, 557, 561: n = A,T,C or G
  misc_feature 562, 571, 572, 575, 587, 589, 592, 599, 600, 606, 608, 614,620, 622, 623, 627, 628, 629, 653, 655, 656, 657, 660, 661,671, 680, 681, 684, 687, 694, 697, 698, 704, 706, 712, 713,716, 719, 721, 729, 736, 744, 745, 746, 750, 753, 754: n = A,T,C or G
  misc_feature 769, 770, 771, 775, 776, 777, 780, 784, 791, 792, 795, 797,798, 812, 815, 818, 822, 824, 825, 826, 827, 828, 829, 837,845, 846, 849, 858, 864, 869, 873, 876, 902, 904, 906, 907,919, 922, 925, 938, 940, 946, 963, 967, 972, 977, 984: n = A,T,C or G
  misc_feature 986, 988, 995, 1002, 1007, 1012, 1013, 1016, 1019, 1020,1021: n = A,T,C or G
gnggnanngannngnnangnaangnnagagnngnggnngnnnnnnnanggngnannnnnncggnnnnnnnnnnnnnnnngaaagaaccttgaaaaaccggcntntnngcagcacccangcgncganagngggnacgagggtcagaaaagaaaagcaaaaancatttnntgcggcggacacacgacaganngggggggggtgnnggagagacagngccgnnacgagttnctcgnnnccatnggggncaaaggagnangggnnagcgnnntcgctcanacgcngccgngcnggggtgacancngcnaggnggaaagnagnantaacnaagggtcgggnagtggaggntcancctggaganggnggctacnaaggggangcngngcacggaagngannaganngtccnggacaaanggaccgtgaccggcanacnggagangaanccggcaantancnganganctncngancnnagangcnntgtnncgcancggnngacgcngagnnnagnngtgnccgggntngaannaggaagnnggaaaaaggcnacgangngnngggnngggagcggnngcngaggctcgaagnantgnggcccgnngagcgnancgcatngggggnanngcannnagaacgaagagaatggtagggacncnnnaannggcgagggtntgtaaaagnnacncgnggaacgnggnnggaaangncgaganncgnggnanaccggggnggtgganaaatggtnnnaaanaanngccatgaggggcccnnnacannnccncccncaacacnnagncnngggcgcgaaagcantanggnatangnnnnnnagcacgtntagagtgnnaangagggggtnacaganaaggngccnganctcaaacaatagaaaaagggggcatngnannatacaggggggnctntanagattcaacgtcngnacggangcacacggtggggcgangcgnacacnggggngggtgancnanagtaccnagcgagngccgntgtgnnacnatnnn

SEQ ID NO: 8402 - DNA, 757 bp, Homo sapiens
  misc_feature 1, 22, 23, 29, 102, 108, 110, 121, 122, 123, 129, 133, 134,143, 146, 163, 171, 178, 193, 214, 216, 227, 252, 255, 290,332, 356, 376, 404, 454, 459, 471, 500, 637, 663, 733, 734,736, 747, 749, 751, 754, 755, 756: n = A,T,C or G
nttttaaacccctttgcgaaannagggancagtgtgtaaagtacaaaaaccagctggggcgtggtcgcgctcatggtgtggaccactgttgtttagactganctgggnanggatggcttgnnnccttgnaagnncaaaggctnttngtgatctttttgtttcncctcctgnactctancctgggttgacagancaagaccccatatcaaaaaanancggccgggcgntgggggctcacgcctgtcattccancantttgggaggctgaggcgggtggatcacaaggtcangagatcgagaccatcctggctaacatgatgaaaccccgtctntactaaaagtacaaaaaaaattanctgggttgtggtggcgggcncctgtagtcccagctactcaggaggttnaaggcaggagaatggcgtgaacgcgggaggcggacttgcagtgagccaanatcgngccactgcactncagcctgggcgacagagcatgaccccatntcaaaacaaacaaaactgtgatgataaaaagcgccataaacactaatttcaaaccatgctactctgtcttaaattttcaaatagctttgcacctgaaatacaaaattaagttttgggaaaaacaagtttttaactgngttgctcacaagctaattaaactggntaagttctgccatgtgaaagggtaaaaaaaataaagttcattttttggaaaaaaatacaaatctttctanntnttatatctttntncnttnnnt

SEQ ID NO: 8403 - DNA, 1175 bp, Homo sapiens
  misc_feature 9, 10, 11, 12, 13, 14, 15, 16, 17, 18, 20, 21, 23, 24, 31,38, 48, 51, 52, 66, 72, 104, 107, 110, 120, 122, 128, 129,130, 131, 135, 149, 151, 153, 154, 161, 163, 165, 168, 172,178, 181, 187, 194, 198, 203, 206, 207, 210, 212, 213: n = A,T,C or G
  misc_feature 215, 218, 219, 224, 229, 231, 233, 240, 241, 246, 259, 261,264, 265, 269, 270, 276, 280, 283, 285, 292, 296, 308, 310,311, 313, 315, 316, 319, 331, 346, 349, 351, 353, 355, 357,359, 364, 368, 370, 372, 375, 383, 384, 385, 386, 388: n = A,T,C or G
  misc_feature 391, 397, 400, 403, 405, 406, 410, 411, 413, 415, 416, 417,418, 421, 423, 428, 431, 435, 437, 445, 446, 447, 456, 459,463, 465, 466, 469, 480, 482, 483, 487, 488, 500, 501, 503,504, 508, 510, 513, 521, 522, 528, 532, 535, 537, 539: n = A,T,C or G
  misc_feature 542, 545, 548, 549, 555, 558, 561, 567, 569, 571, 576, 587,590, 594, 602, 603, 604, 608, 612, 614, 615, 621, 622, 626,627, 629, 631, 633, 635, 636, 637, 649, 650, 651, 654, 658,661, 663, 665, 666, 668, 670, 671, 672, 677, 687, 689: n = A,T,C or G
  misc_feature 696, 697, 699, 701, 705, 706, 714, 726, 734, 735, 744, 745,748, 750, 761, 768, 771, 774, 776, 781, 788, 789, 797, 798,808, 809, 819, 827, 829, 835, 843, 847, 852, 856, 875, 880,904, 915, 922, 941, 942, 955, 961, 967, 971, 973, 978: n = A,T,C or G
  misc_feature 983, 986, 995, 1006, 1007, 1012, 1014, 1018, 1041, 1042,1044, 1049, 1056, 1057, 1058, 1063, 1076, 1077, 1084, 1087,1092, 1094, 1096, 1099, 1109, 1111, 1113, 1115, 1116, 1119,1122, 1136, 1138, 1139, 1142, 1143, 1149, 1151, 1159: n = A,T,C or G
atgggggannnnnnnnnntnntnntttttancccgatnaattcccttnaannaatttccaagaaancccttngggccattggggccccttggggccaaaggggnaanacnaaaaacattncntaacannnngggntaaaagcaacaccncnannggtatancncntanaggnctctcnccnatatantgaagangganacatnatnnatnanngnaannaaatnttttntntnacaaaanntttcnacatggcggctcncntanntatnntaaaanagcnggngntatcatntatncgtgaaacaaananncntnncgntgatttaccccnaaaatataaaatctnaantncncnangnagaanactntnanttncaacaaannnntngtnattaancanaanannaacnntnannnnacngnttctnttncaanantatctcannnctaaaatangtnaaancnnaangcacctctgtnanngganncattaagcacanntnngttnantangagttacnntatatnacanaantngnatnaanttnntaaacnccntanccgacnantnaattnaacctaatatntcnatanattttcannncaanaatnannagatcnnatcnngnanancnnntaaaataagtgnnnctnacanatntnanntnannntgaanaattaacagngntttaaanngnanaccnnttgacccnctaaaaaaaaanctatttanntaaatagtnnatngngatttaaccanataatantgnaancnccatncacactnntagaatannacacacgggnnctataatacnctaacccntnttttanacaccatntctnctaanatantcacactattaaccaatanaaacnaagatcgggggaatatcatttgcncaaatcaaaanaaaatcngggataaccaaactactcnntaaaacaccttantgcggngggggnacananataanatttnganatctaaatnaaagcggaaanncatgnancccntttcccgcccctcttatttaacnntntaaangaaaagnnnaggcnttttctctctatnnataccancanctccnanantangtaaaaaatnantnanntgnagnaagagtttgggggntnnatnncccacnanacttttgnaagaangcngtttncg

SEQ ID NO: 8404 - DNA, 861 bp, Homo sapiens
  misc_feature 1, 5, 10, 18, 28, 60, 71, 72, 82, 95, 99, 105, 130, 135,141, 150, 157, 167, 182, 193, 195, 210, 213, 223, 232, 233,237, 241, 246, 264, 277, 285, 286, 297, 300, 302, 304, 311,325, 347, 376, 389, 391, 397, 399, 408, 410, 414, 416: n = A,T,C or G
  misc_feature 435, 437, 443, 444, 446, 464, 470, 479, 489, 490, 495, 502,506, 514, 516, 524, 541, 545, 547, 548, 557, 561, 564, 566,568, 583, 592, 596, 618, 637, 642, 643, 645, 656, 664, 678,685, 690, 710, 717, 731, 749, 752, 757, 765, 776, 777: n = A,T,C or G
  misc_feature 784, 798, 826, 840, 845, 860, 861: n = A,T,C or G
ncagncccantcaaagcncgctgcctgnaaaagacccatcgattcgaattcggcacgagnggaggaagcannagggaaatcntgacgctgcaaantgcncaggcncgaatacggatggtcctcgcctatntggtngctcantagaacctntggactnggggtgtccncggtgggctcctcgngctgggatccncnacgtggatgagagtntantgggctcctnccaaggccnntgtnccanttgcngacatcaacccttatgcngtatcacaagacngacctatnnggccttcttcnagntnangcatccncccgcttccagctntctgccctgcagagcatactgntggtgcctgacaccgcaaatctggagccnttggctgatgganangtgatncnataccgacnangaananatggggatgacatatgcananctctcnnantatgggaaactcaagatngtggcnaaagatggngccctacaanntggtntgcaaanttcntcaggatntngaaacacntctgccccccctgacangtcncnntcaaagagnaacnggngntntctttcaagttcttnccttgaacncganacaaagaaggactgacgctttncacaactgagtggcctacngcctnnanacatagcaatnccttgaangaacacaaaagggnttttgancgtgncgaaaccaatttcccttggnaccgaanccacaaattcttgngccccttagggaaaaagnttnttcangggggccnttaaaaaaaannaaaccanggggggccacaacnagccattggggaggccccttaataaaanaaacctcatataanccctnaaggtaacgtggaann

SEQ ID NO: 8405 - DNA, 777 bp, Homo sapiens
  misc_feature 1, 3, 10, 18, 21, 24, 100, 135, 196, 235, 236, 250, 318,332, 333, 338, 375, 412, 415, 417, 422, 431, 445, 451, 506,532, 537, 543, 546, 566, 589, 598, 599, 601, 606, 632, 636,640, 643, 662, 688, 697, 699, 718, 720, 738, 760, 764: n = A,T,C or G
  misc_feature 767, 771: n = A,T,C or G
nantattcgntcaacctnctngtnctttttgcaggatcccatcgattcgctgtaaatgacaaaagaaaaagaaaaattgagccttgggacgtgcccattnttactgtaaattatgattccgtaactgacttgtangtaagcagtgtttctggcccctaagtattgctcgccttgtgtattttatttagtgtacagnactacaggtgcatactctggtcatttttcaagccatgtnntattgtatctggtntctactttatgtgagcaaggtttgctgtccaaggtgtaaatattcaacgggaataaaactggcatggnaattatttttttgnntgttntttgttttttggctctttcaaaggtaatggcccatcnatgagcatttttaacatactccatagtcttttcctgnggngntaggnctttattgntatttttttcctgngggctngggtgggggtttgtcatgggggaactgccctttaaatatttaagtgacactaccnaaaaacacaaaacggtgatgggttgngttangcttgnatngaatgctgacttgacatctnttgccttgacctccggtatgttntaaagctgnntntgaanatctggatcttgcccatcctttgggntagngccnggnctaattaaatttggctttnttccaatttttttttacttccctttnctccctttncnggaaggcattaaaatgctngntgcctggggtcttttaanaaatgttttaaaccattttccntggnagnaaanaaattt

SEQ ID NO: 8406 - DNA, 1391 bp, Homo sapiens
  misc_feature 3, 4, 5, 6, 7, 10, 11, 14, 15, 17, 18, 20, 21, 22, 24, 25,26, 27, 29, 31, 32, 33, 34, 35, 36, 37, 38, 39, 40, 43,44, 45, 46, 48, 49, 50, 51, 52, 53, 54, 55, 57, 58, 59,60, 62, 63, 64, 67, 68, 69, 71, 72, 73, 74, 76, 77, 79,80: n = A,T,C or G
  misc_feature 81, 82, 83, 89, 90, 91, 93, 95, 97, 98, 99, 100, 101, 102,103, 104, 106, 109, 114, 115, 117, 118, 119, 121, 123, 124,129, 130, 131, 133, 134, 135, 136, 137, 138, 139, 140, 142,147, 148, 150, 151, 152, 154, 155, 157, 162, 163, 165: n = A,T,C or G
  misc_feature 166, 167, 169, 175, 178, 179, 180, 182, 184, 185, 189, 191,196, 199, 200, 201, 202, 204, 205, 208, 209, 210, 211, 213,214, 217, 219, 220, 223, 224, 225, 227, 228, 229, 230, 234,237, 240, 241, 243, 246, 255, 257, 267, 268, 270, 271: n = A,T,C or G
  misc_feature 277, 279, 281, 282, 284, 289, 291, 293, 294, 295, 297, 299,304, 306, 312, 313, 316, 318, 319, 320, 321, 322, 327, 328,329, 333, 335, 336, 338, 340, 342, 346, 349, 357, 359, 361,362, 363, 366, 375, 376, 380, 385, 387, 388, 395, 397: n = A,T,C or G
  misc_feature 400, 418, 423, 424, 426, 429, 433, 443, 444, 446, 447, 454,457, 458, 461, 466, 473, 477, 486, 489, 491, 494, 496, 497,500, 502, 504, 508, 509, 511, 513, 516, 523, 529, 537, 538,541, 549, 555, 556, 557, 570, 574, 575, 579, 591, 593: n = A,T,C or G
  misc_feature 594, 595, 599, 609, 612, 614, 615, 621, 623, 625, 627, 629,630, 634, 637, 642, 644, 655, 658, 659, 661, 662, 668, 670,676, 683, 689, 696, 700, 701, 705, 709, 716, 717, 719, 720,722, 725, 727, 731, 735, 737, 740, 743, 744, 745, 746: n = A,T,C or G
gcnnnnngcnnacnngnngnnngnnnncnannnnnnnnnnggnnnngnnnnnnnncnnnncnnnccnnnannnngnngnnnnngcgcgnnncnanannnnnnnngngcncgcgnncnnncncnnggcgnnngnnnnnnnncncgcgnncnnncnngngcgcnngnnnantcgcgngannngngnncgcncncacgngcnnnnanncgnnnncnngcncnngcnnncnnnncccnccnagnntngancaccttccntntaaaaccaanncnncccccncntnngngggtngnannngnancgcangnccccannccncnnnnngcggnnngggncnngngngngggnggngggcgagncnannngtnttttttttnngcgntgccnannccggggncngangacgacgggggggggtgncgaanngncgnggcnccgcggggtnngnngcgttangcnnccnacaanggcggcncgancgggaccgngcncngtnannggngncntganncngnaanacgcagngtgcgngacacggnnacnacgtcgangagtgnnnaccataaggagangggnngggncacaggcgacgngnnnaggnagggaagganccngnnggcggngncngncnngacnacncaccngncgcggcgcggnacnncnncgacancnccgganacgcggngcggcnacggcgngcgnngggngacngcacggnnanngncgncncacnaggngncancgnnnngcctgggncgncncngnnntgncncnanggganggtnncncaannnggncgagcanggaagnngacgacanataantcgggaacngggcnannannggngnggggggnnggcgcgnggccaggnagcggncatnncgncnanannngnacaangggcnnnangcnnccatgnnangggggaggggccncacgggaggggcgcgggaagacnacccngggngggnngacngggangnntatgggnggaccnngnccntgggcnccaagcaangggnggngnaccccnnggngctcncncgcctcagnaaaantnccngnanangntnangccccacgggcggncgngtgggngngggggacgccccnggtananccccnnggntancnctctaggaagggcnggacgggccnggggaggaaaancnctngggcaaccccggggganggccgggannggcnggcacgnagnggcccgnngaatganacacccagcgcggnncgncncangaccnnggggcnancnngngnccaagganctnctggncgccaggcggggcaaggtgaggggngtnccacncgnanaaagacgagggggcgcggcgccgcgcgcangncnggggggngggggccgatgggccggnnnng

SEQ ID NO: 8407 - DNA, 736 bp, Homo sapiens
  misc_feature 1, 2, 11, 14, 21, 524, 600, 609, 620, 632, 649, 658, 667,677, 679, 698, 712: n = A,T,C or G
nntttaaaccncgnatcgcanacagccaaacagaccttctgtttcatgaacaggcgtgttatatctgctaacccatatctagggggcacctccaacggctatgcccaccccagcgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctctcgggctcaactcgcaggtacggcatcttcttctgtaagattctagaaccaccttcaagtcacattgctccaacagagttttgcaacttgtagtaaatgggactcatcaaaggcaaagcataatgtgttnttttttctcaactagaatataatttgcagcctgactaccaaggaactgatgaaatatttcttaacgagctcatggnttatctgancactgtgtttntttgcccacatntggctctttttctgttnttggaaaanttcccccantgaaattttngngaattatgtcaacttaaanggcagagaagtttnaaaagaaaccgggttataaaactt

SEQ ID NO: 8408 - DNA, 774 bp, Homo sapiens
  misc_feature 3, 6, 9, 478, 611, 664, 711, 756, 768: n = A,T,C or G
tcnatncgntcagctcttgttctttttgcaggatccctcgattcgaattcggcacgagaaaaatatgggctgggattacaggcgtgagccaccacacccagcctttcttttagtgctttaaatatattggccctctgccttctggcctccaagtttctgatgaaaaatctgcttgtcattttattgaggatcccttgtatgtgacaagtttcttccctcttgctactttcaggattctaactttgcatttcaaaagttagactataatgtgtctcagtgtgggtctctttgagttcattttacttggagttacttgagctgcttggatgtttatatgcatgtctttcatcaaatttgggaagttttcagccattatttcttcaaacatagtcataagctgcataatgacattttggtcatcaatgaactgcatatatgatggtggtcctcaaagattataatactgtatttttactgnactttttatgtttatatgtacttagatacacaaatcttaccattgtgttataattgcctaagtattaaatacagtaacatgctgtcatatttgtagccttggagcaataaagttatataccatataagtttangtataccagtagcctataccattgtaggcttggtataagtactctctacgatngttcacaccaatggttggaaaatcacatgaaggatgtatttcctcanaaacatattttttggttggttaaagtggatgccatgaactggtanttcttctcttgncccttt

SEQ ID NO: 8409 - DNA, 729 bp, Homo sapiens
  misc_feature 1, 11, 34, 35, 36, 37, 40, 44, 46, 52, 56, 57, 60, 62, 64,68, 69, 74, 77, 88, 91, 97, 98, 105, 122, 124, 125, 129,135, 136, 139, 145, 146, 153, 154, 174, 179, 180, 196, 197,202, 205, 207, 211, 236, 237, 244, 246, 250, 253, 258: n = A,T,C or G
  misc_feature 265, 268, 282, 283, 286, 289, 294, 307, 310, 312, 317, 323,325, 330, 343, 359, 362, 365, 366, 367, 369, 370, 371, 376,377, 379, 381, 383, 385, 388, 390, 393, 398, 399, 408, 409,412, 413, 420, 421, 422, 423, 424, 425, 428, 431, 436: n = A,T,C or G
  misc_feature 445, 447, 449, 450, 452, 453, 455, 460, 462, 464, 467, 468,470, 472, 477, 479, 482, 484, 485, 490, 494, 495, 498, 504,506, 509, 510, 514, 516, 528, 532, 535, 537, 543, 545, 550,552, 560, 566, 568, 572, 586, 587, 589, 591, 597, 604: n = A,T,C or G
  misc_feature 611, 616, 622, 632, 650, 653, 656, 671, 673, 684, 686, 694,704, 718: n = A,T,C or G
nttaaaccccnttcgattcggcacgaggcgatgnnnnatnctgntnaatgtncctnncantntnaccnnacggntgnacttcaatgtnctngtgaannactcacncagggatcgcctcgccntnnaggncgtgannatnaggtgnncaatagnntgtgacgcaccgtgcaaggnaatgnncggcaagcatctgggnnaaaanaancntacnctttggctgctcttgaagaatgaannacgacgncncctngcngaacnagaagcnttngaaaacagactgannggnccncggangaagaactggacntgngntgatntggcangngagcnatcactatggggnaaacatgactattatntcnttnnngnnngtgcnntngngncngtngngtnagccnngctcatcanncannatggcannnnnnaantgntgggntctttcacngncnntnncnttggntntntannantngttcnanccngnntattncaanntgncttttntngannatgntntatattgacatncatntgngnattctntnaggtntntgtgaganggacantntgtnaaactctatcttanntntngtcctntgaccgncacctanagtantgtgtncaagtggacncctgactgaaactaaaanttntgntaccgcttagcttantngctgacttacntncttttggncattgggctnccctgactttcctntcatttaatca

SEQ ID NO: 8410 - DNA, 760 bp, Homo sapiens
  misc_feature 7, 10, 14, 651, 753: n = A,T,C or G
tattatncgntcanctacttgttctttttgcaggatcccatcgattcgaattcggcacgagataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctacggagggtgagagcagaaactcttaagaaatcctttcttctccctaaggggatgaggggatgatcttttgtggtgtcttgatcaaactttattttcctagagttgtggaatgacaacagcccatgccattgatgctgatcagagaaaaactattcaattctgccattagagacacatccaatgctcccatcccaaaggttcaaaagttttcaaataactgtggcagctcaccaaaggtgggggaaagcatgattagtttgcaggttatggtaggagagggtgagatataagacatacatactttaagattttaaattattaaagtcaaaaatncatagaaaagtatcccttttttttttggagacgggttctcactatgttgcccagggctggtcttgaactcctatgctcaagtgaatcctccccctcggcctnccaaagt

SEQ ID NO: 8411 - DNA, 737 bp, Homo sapiens
  misc_feature 1, 3, 4, 18, 28, 29, 33, 46, 62, 63, 75, 82, 84, 88, 95,98, 106, 118, 120, 128, 131, 132, 140, 141, 143, 153, 154,159, 177, 188, 189, 192, 193, 194, 205, 210, 211, 212, 218,224, 233, 240, 251, 255, 260, 267, 277, 278, 283, 287: n = A,T,C or G
  misc_feature 288, 292, 295, 298, 300, 301, 305, 309, 310, 318, 321, 324,328, 370, 374, 385, 401, 403, 407, 417, 418, 423, 429, 433,435, 443, 444, 448, 453, 454, 455, 459, 460, 461, 462, 469,472, 483, 485, 490, 491, 496, 497, 499, 507, 514, 524: n = A,T,C or G
  misc_feature 525, 527, 528, 531, 535, 541, 542, 557, 558, 568, 585, 590,599, 607, 617, 631, 637, 652, 657, 662, 663, 664, 680, 685,689, 699, 703, 704, 706, 709, 714, 718, 720, 723, 725, 726,728, 729, 735, 737: n = A,T,C or G
nannatccgttctccgcntgctgcctgnngcangatcccatcgatnccgaattccgcgcgcnngcaatgtatccntatgccnantgtngttgcantancactggancgagggtttacnangcggtgcntgnnaaaacccnntngttacccagnnaaatngacttgcaatacattcanctagcgcgcgnntgnnntcataattcantgggnnntatccnatcgcncttatcaangagatgnctctctggctntctnttgcnctctcantggaaccggnnattgnatannaaantcntgntnncaanctcnntctccctnatnggngacngcaactacctaatcttgaacagatatgctaatttcgctaacnctcnggtctgccctncccgatcccctggctncncagnacacattccnntgaantaaggnttcnanatacatgnncatnctatnnntatnnnnggcaacntgnattagggtgantntatanntatanntncatatgcntgatganagctgataanntnnacnttgntattcnncgttctatatgagannactctcgtgnaaactggacaacctcancctanatctggctntttttaantttaaaaggntatcacgaattcancgagcnctgaaaatccgctanttgcnggaannnactcgacattcgcatntgctncgcncacatttccngatnngncgntcacntcantntancnngnntacacncn

SEQ ID NO: 8412 - DNA, 728 bp, Homo sapiens
  misc_feature 1, 4, 12, 17: n = A,T,C or G
nttnaacccctntcgantcggcacgacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcaaagactggtgtgacattgctctatgggcttcagaccacagacaacagattattgcacttcgtggcacccaaagcacacagctaaaatgctctttagcggat

SEQ ID NO: 8413 - DNA, 750 bp, Homo sapiens
  misc_feature 2, 18, 546, 576, 618, 621, 622, 664, 696, 715, 731, 736: n = A,T,C or G
antttgacccctttcgantcggcacgagacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagntaatgtcccacggcagcccacagtcaccancgtgtgttcccgagacttcttcaggagctagcagagggacangannaagaggatccccagggtgacagtaaaacaagcaaaaatgggnccaccaagaaaacacaattgtggagccgcttntacagaagttttattcatnttacccccttcacagnggatnccagccaagaaaat

SEQ ID NO: 8414 - DNA, 756 bp, Homo sapiens
  misc_feature 1, 10, 148, 295, 498, 544, 556, 608, 616, 658, 678, 680,697, 712, 720, 728, 738, 744, 750: n = A,T,C or G
nttatccttncaactcttgttctttttgcaggatcccatcgattcgaattcggcacgagaccacgtcatatacagcctacaaagagctcttgactgtgagctcgcagaggcccagttgcataccactgccattgacaaagagggtcgncgggctgttaaagcgggagcttatgctgcttgccaggaagcaaaggaagatataaagagtcattcagaaaatgtctctcaacatccacttcatgtagaagtattacactcagagattatggctcatcagaaatttgctttgcgtctnggttcctggatgaacaaaattatgagctattcaagtgactttaggcatatcttttgccaagcatgccttagagaagaacctgactcggagaatccctgtctcataagcaggttaatgctttgggatgcaaagctttataaaggtgcccgtaagatccttcatgaattgatcttcagcagtttttttatggagatggaatacanaaaactctttgctatggaatttgtgaagtattataaacaactgcanaaagaatatatnagtgatgatcatgacagaagtatctctataactgcacttcagttcagatgtntactgggnctactctggctcgacatcttattgaaaacagaatgttatctntgtcattactgaaactctgntntaagttttacctgagtncttggacaggaacantaaattcnacttccanggttatgccnggacanattggnaagatt

SEQ ID NO: 8415 - DNA, 760 bp, Homo sapiens
  misc_feature 669, 674, 675, 676, 677, 678, 679, 680, 681, 682, 683, 684,685, 686, 687, 688, 689, 690, 691, 692, 693, 694, 695, 696,697, 698, 699, 700, 701, 702, 703, 704, 705, 706, 707, 708,709, 710, 711, 712, 713, 714, 715, 716, 717, 718, 719: n = A,T,C or G
  misc_feature 720, 721, 722, 727, 743, 749, 751, 752, 755, 757, 760: n = A,T,C or G
atatccgttcaactacttgttctttttgcaggatcccatcgattcgaattcggcacgaggagttctacaggtggagtgtggggcccagaaggggctcaggtcttaggggtgtcatctgaaaaaacagagatggtgatgggacaccagttctaggagccctctgcatggccactttctgcctcagctcttctaaagcatttcttctgttcccttccattggggtaaccactgatctgtcttcccaaaaactgagtcagaagttggactttgttacttggctcatctacatttaagatatagtcagaaaaaaaatgcagtctttacatcttaagaaagcttacatgggccaggcgcagtggctcacacctgtaatcccagcactttgggaggccaaggtgggcggatcacctgaggtcaggagttcgagaccagcctcaacatggagaaaccccatctctaccaaaaatataaaacttagccaggcatggtggcttgctcctgtactcccagctacttggggggctgaagtgggaggattgcatgagcccagaagtgggaggttgcagtgagctgagacgagatcgcaccactgcactctacctgggtgacagtgagaacttgtctcaaaaaataaataaataaataaaatccattaaattgccaaaaaanaaaannnnnnnnnnnnnnnnnnnnnnnnnnnnnnnnnnnnnnnnnnnnnnnnnaactnggcctttaaaactttngggagncnnttncntan

SEQ ID NO: 8416 - DNA, 732 bp, Homo sapiens
  misc_feature 2, 10, 18, 514, 522, 572, 585, 683: n = A,T,C or G
tntttgacanctttcgantcggcacgaggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccacccggaggccagagctgagcactcaacccgggaggcaggctccagcctcancaggtgcngagcccgtcacttgcaccaagtctcactggctgcagtatgacatttcacnggagatttcttgntgctcaaaaaatgagctcgcttttgtcaattgacaggttcttttttcttactaaacctgtactttttgtaaatacacatagcatgtaatggtatcttnaaagtgtgtttctatgtgacaattttgtacaaatttgttattttccatt

SEQ ID NO: 8417 - DNA, 1025 bp, Homo sapiens
  misc_feature 4, 11, 17, 26, 59, 71, 79, 83, 84, 88, 94, 95, 98, 102, 104,129, 134, 141, 157, 172, 181, 183, 198, 202, 210, 218, 224,230, 232, 244, 245, 249, 265, 268, 274, 292, 301, 310, 315,331, 334, 335, 337, 345, 346, 347, 349, 350, 352: n = A,T,C or G
  misc_feature 354, 357, 364, 365, 375, 377, 399, 412, 416, 432, 440, 443,455, 466, 467, 469, 481, 482, 494, 497, 502, 505, 506, 508,509, 522, 529, 539, 547, 553, 566, 578, 582, 584, 593, 608,612, 613, 615, 623, 661, 664, 666, 681, 690, 691, 710: n = A,T,C or G
  misc_feature 715, 726, 732, 739, 746, 753, 758, 760, 770, 786, 789, 791,795, 799, 809, 822, 826, 832, 833, 834, 851, 852, 856, 857,868, 875, 896, 899, 906, 922, 924, 925, 956, 960, 996, 1017,1022, 1025: n = A,T,C or G
aacnacctttnaactcntgtcttttngcaggatcccatcgattcgaattcggcacgagnggaggaagcacnagggaaantttnncgcngcaaanngcncagncncgaatacggatggtcctcgcctatntggtnggctgantagaaccaatggactngggggtgcccacggngggctcctngngctggggaatccaanaacnagggattnaataaganctaccntgggcntncccttaccaaanngccnacttgcttccatttgncgngaaccntcaacccccttgtatggnccggatatncaaactaangaacnggaaccctaaaagggnccnntncgtcccannntnntngnaantccccanncggctttccnanccttttccttggccccctcgcnggaaggcaattanctgntttgggcccccctganccaacccnttnaaaaatccttgngcaggcccctnncnggccattgaatnnggaccaccggtnggnttccncannanncccgaaccgaaangggaaanaaacatgggngggtaaangaaccnttaattgccaggnatccttcttttnggananttaatgggngaaaaacctcaaagnaaanngntgggcccnaaataattgggggggccccttaccaaaatgatggtttnttncnaaaactatcctacantgattgctnnaagaacacaatacctggcnccccncgcaggacaangtcaanttgctcnaaaagangaaaacnggttntntctttcaagntacttcctttggaacncgncncaanggangaactcgaancttctacaacaanttcngtggcnnncagcccttaagaacttnncganngccttgaaagnaacaaanaaagggttttgaaccgtgctnaancaatttncctggaaacgatccananntcttggcccttggcaatgttttcaggtgccntaanaaaaaacagggtggcaccaagcattggagccttaanaaaaactaataacctaagtangttancan

SEQ ID NO: 8418 - DNA, 717 bp, Homo sapiens
  misc_feature 382, 528, 561, 565, 570, 587, 589, 591, 594, 596, 606, 617,620, 622, 626, 628, 632, 641, 643, 649, 650, 651, 659, 666,671, 677, 681, 683, 689, 691, 698, 700, 708, 710, 713: n = A,T,C or G
cggagatatgattaggagagggaatgctttttgagggcagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgnctctctggggaacaaataacccgaaaagatactcagcaccctggttggtacataggtggtcagttgatttatacttcctggttttcagtgttgcttgaattttctaaatggaaacacagtacctttataatcagaaaacaatcccnagttttgatttgagggtgttgtaaaaaaggttnatanttttntattataataagctccncngnccntnttaaaaaacnttttggggggncgntnttangntganaatccccanancttgannnagatatanctttgtnatgtngtttgngggnanaaaccncnctctctnanaatatatntnctnctcg

SEQ ID NO: 8419 - DNA, 773 bp, Homo sapiens
  misc_feature 13, 141, 690, 728, 730, 737, 740, 761: n = A,T,C or G
gtttatccttcanctcttgttctttttgcaggatcccatcgattcgaattcggcacgagggatagcccacctcatgttcctgttcctgaactctcaacagacactgttataaatgtgatcactaatatgacaaccaccatncagagtctctttccaaatctccaggttttccctgcgcttgggtaatcatgactattggccacaggatcaactgcctgtagtccaccaagtaaagtgtacaatgcagtagcaaacctctggaaccatggctagatgaagaaagctattagtactttaagggaaaggtggtttttatttcacagaaagttacaactaatccaaaccttaggatcatcagtctaaaacacaaacttgtactacggcccaaatataatgacactgaacaagacttgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaatttatggacacactcacagagacagcattatggttctttcagataaaaaaaggaagtccagtaaattcttttggttgtggctnctgctgttacacccagtgaagagtgttttagaaaaacngnaccaccnatnctggtatcagactgtttcaantatgaacctcgg

SEQ ID NO: 8420 - DNA, 733 bp, Homo sapiens
  misc_feature 5, 11, 13, 17: n = A,T,C or G
ctttnaccttntncgantcggcacgagggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttcagataaaaaagggaagtccagtaaattctttgtttgtggctcctgctgttacacccagtgaagaagtggtttagaaaaacagaccaaccaatcctggtatcagactggttcagtatgatcctcg

SEQ ID NO: 8421 - DNA, 897 bp, Homo sapiens
  misc_feature 4, 8, 56, 61, 65, 81, 93, 97, 106, 108, 112, 116, 130, 131,133, 134, 141, 145, 157, 165, 173, 185, 186, 189, 203, 226,243, 251, 254, 258, 261, 263, 268, 292, 295, 297, 303, 304,309, 315, 316, 317, 320, 325, 330, 334, 337, 342, 346: n = A,T,C or G
  misc_feature 350, 352, 353, 356, 372, 376, 385, 402, 417, 418, 428, 430,443, 445, 455, 460, 462, 463, 480, 482, 485, 487, 516, 536,541, 543, 557, 571, 574, 578, 584, 595, 609, 613, 621, 628,634, 636, 638, 645, 652, 662, 663, 678, 683, 684, 691: n = A,T,C or G
  misc_feature 698, 700, 701, 708, 709, 713, 718, 724, 733, 734, 741, 742,744, 750, 751, 752, 753, 760, 761, 770, 774, 779, 783, 784,786, 796, 801, 804, 807, 810, 816, 817, 834, 835, 839, 848,875, 878, 885, 894, 897: n = A,T,C or G
atantccntctaacttctgcctgaggtcgactctagaggatccccggtaccgactngaaanaaanatatattgagccttgngacgagcccatntctnctgtaaatnangggntccntttctgactagaanncnncagtgtntctnggcccataagtnttgctgcncttgcgtnttttattttagnngtncatgaacctacaanggtggcgtcacttctgggtacanttttttcaaaccacatngttttcantcngccnttntngttgntcctaaacttgtaactgccccacnctnanggctgnnggccnttattnnnaangggcngtcanaaanttnttttngatngccngnngtnaaaattaaaaaaaaancttngggccaaanggggggtaaaaactctncattttgtcttcttnnggggttctcngntttatttcttttngncccggttttncccgngnncttcccttttttccaananagngntttatatgggtgtccccctatccccaatnggaagccagtcccgggttanaccancncctcccattaaccncctttattaccccnggngggncgtccncggttcagggnattcccaaatttanttgnttcttganggggccnttggtncngnaaaaaanctttggnggggcctgtnnctttcaacattattngggcnntcctctnaaaaaancnngtttttnngccntttgnccgtgngaagccccnntttttanncnaggggnnnnttttttnnacttggganaacnattancctnntntgggtatttnttggntanacngantttgcnntttcgctttggtaaaannactnttacaaaantaccgattacaaattacctcattctgnggnatgcacntctgggagnttn

SEQ ID NO: 8422 - DNA, 874 bp, Homo sapiens
  misc_feature 1, 6, 11, 17, 25, 27, 40, 41, 43, 44, 52, 54, 56, 58, 59,60, 62, 65, 69, 70, 71, 73, 78, 79, 80, 86, 87, 91, 92,94, 96, 97, 98, 99, 100, 101, 102, 103, 104, 106, 107, 123,124, 125, 126, 132, 134, 136, 142, 150, 151, 160, 177, 195: n = A,T,C or G
  misc_feature 204, 279, 473, 474, 516, 570, 588, 591, 608, 629, 646, 710,719, 730, 732, 745, 748, 760, 785, 787, 788, 809, 815, 823,832, 840, 851, 868: n = A,T,C or G
nctctncttanataatnttatatcnantttattattttanntnnatctcttnananannntngtnttannntngttannnttactnnttannancnnnnnnnnntnntgaaccccttaaaacnnnncgagtnanantcacanatgactgnncgatatagnaaagctatgtagacatntttggagctcttactgtnctaaactgnacagctgtgcttaaaacccttatttcatataaatggccttaagttttctaattcaagcgggtttttggaaaaatntatggtctccattaaaatacatattacaactggggtagattatttgtggtccagtgtctgtgatttaactttgcgttttgctatctgatttttatttttcacaggggctaagcatgagctttcattctcactcactcttaatttgtcgagcgtcactacacatgcaccgtgttgcagtcccttgaggccctgtnntgttaatctgtgatggagtgtgaattgtgtaacgggcactgngtttacactctcaggtgtttggcggggccggtcgcagacttcaatggtcccctnacggaaaaggccaggctncgngtggacggccaaacttncctgccccgctccttcagcangtgactgtctctgccantttcttacctggctgaaggattcttgctcaagtaagctggaacaaatgctgcttgtcacacagnctttttctnttgaaactttnangaaggctcccttngtncaccaaggcaantggggagcttgtagaaccaacccgnannccactttgccccacaattcanttgctnacctggcnttcaactgngaaataangtttaaaggtncacccggggactttctncttaag

SEQ ID NO: 8423 - DNA, 730 bp, Homo sapiens
  misc_feature 6, 9, 15, 447, 663, 664, 676, 686, 687, 688, 690, 706, 719,721: n = A,T,C or G
ttgacnccnttcgantcggcacgaggagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctggatgactcacaaggtaaagcttgagagcaactttgcctccattgtgtttgccatcatggtgttggaggggcttggccgctcactggaccccaaactggacatcctggaggcagcgaggcccttctcctcacggcccagtgtgccccccgtgatggggcagtggcctctgtgggcccttgtcaagagctggaggccactcccaagagcctctcctatggcagctgggacgttttaaaattgggacaccaatttcaaatgtaaccctncagtggtggaaggcacaccatggcttctctgcttggtttgagggtctgttcaaaagctttgggccaattagggagtaaaaggagggaaggggcctatccattccattgtggaagctgggccaggtgccagggacactctccttcagggaaaatgttatgtggaggaggacgaataaatttattttgttttaaaaaaaaaaaaaaaaaaaaactcgnncctttaaaactnttaggggagnnntnttaccgtaaaatccanacttgataaaaananattgatgaa

SEQ ID NO: 8424 - DNA, 855 bp, Homo sapiens
  misc_feature 1, 2, 8, 65, 66, 67, 69, 76, 83, 85, 92, 93, 96, 101, 111,114, 118, 120, 121, 126, 130, 131, 134, 137, 140, 145, 150,154, 156, 158, 171, 195, 206, 220, 230, 237, 246, 280, 328,334, 337, 338, 339, 340, 342, 344, 352, 367, 370, 371: n = A,T,C or G
  misc_feature 383, 385, 386, 387, 388, 396, 404, 413, 419, 425, 434, 436,437, 438, 441, 443, 450, 466, 472, 492, 494, 500, 501, 522,529, 535, 538, 540, 544, 567, 571, 578, 580, 585, 588, 590,598, 600, 601, 606, 610, 612, 618, 619, 629, 632, 634: n = A,T,C or G
  misc_feature 643, 646, 652, 653, 657, 658, 669, 677, 678, 685, 688, 704,715, 726, 739, 756, 759, 761, 762, 770, 780, 786, 788, 791,797, 802, 803, 806, 810, 814, 822, 844, 853: n = A,T,C or G
nnatcctntctcagcttgctgcctgcaggtcgactctagaggatcccctgtacacgagctccaannnancctatantgagccntnttacaannccnctggncgccgtaaancangggntnngaatntgannaanaantangcaantgttnctgncncntaagtattgctgncttgcctattttactagtgtaccnatactacaagngcgtactctggtcntttttcaacncatgttntatcgctcnagttttctactttatgtgagcaagggttgctgtncaaggtgtaaatattcaacgggaataaaactggcatgggaaatttttnctacgnccnnnncncnctttttgnctctttcaaaggttnatnncccatccatgancnnnnttttcccnctccaatntttaaatcnggggcncccttnagggtatcnannntangngttctgngggctggggtgggggnttgtcntgggggaactgccctttaantnttaagnnacactaccagaaaaacacaanaaaggtnatgggnacngngtgnatgccctggatttggaaaagctngggnctccgancntcttnttngnccttgggncnnacggntatnantcttannagctggggtnttnantttcttggnaancttggnnccgnntcaatttttgngctttttnngaccccnggntttgatttaaaaaaangggtgctcttnccatttaaccnaaaatacctttanccttctaaattcctttnccntnnaaaggctntcccctttgncagatncncgngggacnccgannaanttgntccntaacccantttttgatgggggggtatatanaaccccatntt

SEQ ID NO: 8425 - DNA, 1194 bp, Homo sapiens
  misc_feature 4, 5, 6, 8, 13, 20, 24, 25, 33, 62, 63, 64, 70, 80, 90, 92,94, 96, 97, 104, 107, 109, 119, 149, 162, 176, 209, 220,223, 225, 226, 228, 232, 235, 236, 239, 243, 248, 251, 257,262, 271, 277, 278, 292, 294, 303, 304, 308, 314, 315: n = A,T,C or G
  misc_feature 316, 318, 328, 334, 338, 341, 344, 351, 353, 355, 356, 360,364, 365, 366, 376, 384, 386, 387, 391, 394, 398, 399, 406,407, 408, 411, 427, 431, 432, 435, 437, 438, 451, 459, 462,467, 476, 477, 480, 492, 493, 498, 501, 508, 511, 515: n = A,T,C or G
  misc_feature 518, 519, 520, 524, 527, 529, 535, 546, 549, 550, 551, 557,558, 561, 563, 564, 566, 572, 577, 581, 586, 589, 590, 597,602, 613, 615, 617, 618, 620, 626, 628, 629, 633, 637, 639,640, 647, 649, 659, 662, 667, 668, 670, 674, 677, 679: n = A,T,C or G
  misc_feature 680, 692, 693, 697, 705, 712, 714, 721, 723, 727, 731, 733,737, 740, 742, 745, 746, 754, 763, 767, 780, 782, 786, 787,789, 793, 796, 798, 803, 807, 808, 811, 812, 826, 827, 836,842, 843, 846, 847, 852, 869, 880, 886, 888, 901, 906: n = A,T,C or G
  misc_feature 909, 927, 928, 930, 942, 944, 946, 951, 956, 959, 966, 967,970, 975, 979, 981, 994, 999, 1000, 1003, 1023, 1032, 1058,1060, 1063, 1078, 1079, 1080, 1085, 1087, 1090, 1098, 1100,1128, 1132, 1134, 1138, 1153, 1159, 1162, 1166, 1167: n = A,T,C or G
  misc_feature 1169, 1174, 1177, 1181, 1184, 1186, 1187, 1189, 1190, 1191: n = A,T,C or G
gatnnntnaaacnccccttntttnnccaaaaanccttaccctgggtgtgctttttttttggnnnaagggnaaaccccccnatccggaatntncncnncatatcntgngnaaccggaatnccatctcaggactacacatgtatggagaanatgaccgcatatnttttttattcaaancgcctacatatatatcacctcgcaccagacagnggggggttttnttntnntnaacnaanngcnaggntaccnctnactgangaagnaaaactaanaaaatnnatccacagtaatananaaaaaaacnnatgnatcaannngnaccagaatancaagcnatancancanccaacananannaganactnnngaaaaaacanaacacccntnntacnaanaaannacacgannntanaattgattacagacgnaaanncantnnaaaaataaccatnccttatcntantaaanttcaaaaanntcntacaaaaaacannaatangantaaaacnaanttcncannnaganagnanagaaanacgaaaaatanatnnncattanncgntnnanctatancacanaacnctganaanncccaaantatgnaaataaacttntntnntncaaacngnncatncgancnntgaaatnancatactaatntanaaaanncnccanatnanncactaaaaaatnnacanaataaacnacactanancgtattnangtanacantnaacnatngnganntgatcctncacattatntacnacataacacatanantgtnntncttnganancattnacanncgnnacatatatagtatnnatactcatnaccgtnncannatatntaacactcgatctaaanagatacatatncaatanangaaatagaaactnaatanatnaatatcgagaggatctanntntaagcaaaactnanantatcncttangtncataaannatngtccnactnanctatcaacataanatagnntanacattttacctctaccgcgngcgttcatntatcaacacacaataattattcgcantnatntactaaaaaactccnnnatatntnctnccgacatnanatatctgtaaagaaatgtatactactancgcntngaanatctatatgatcacnttaacnctnacgnnangtaanatntatnttntnncnnncgt

SEQ ID NO: 8426 - DNA, 727 bp, Homo sapiens
  misc_feature 3, 5, 11, 676, 692, 696, 721: n = A,T,C or G
ttnancaccgntcgaattcggcacgagcacaggcccttttgtgatgcgttccacgtgtaggagatgtggtggcccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagcccaaggctctctgactgactccgtcccagatcttctcagcttaacggctgaagactgacactgcccgatcgcctcagaagcccccgaccatcacggatgccgagcttcgggtaactctcgcagtggaaggatgcttcttatggtcaaagacattcatcttcctgataggaatgaagtggaaagctccagcaacaacagtcaagtaatggctggctcttcacttgaaaattatacaatataaaaaccgtgtttatgaactctttataatattatctttattatttctataaaagcagaatagcatgtgtgtatgtgatttaattctaactgtgcaaataaaaccattaaaaccaaaaaaaaaaaaaaaaaactcggccntttaaaacttttgggnggcntttccgtaaatcccaacctgaaaanatcctt

SEQ ID NO: 8427 - DNA, 1120 bp, Homo sapiens
  misc_feature 1, 6, 17, 25, 35, 46, 54, 64, 76, 80, 81, 82, 94, 95, 99,110, 111, 126, 138, 147, 149, 156, 168, 173, 174, 177, 184,203, 204, 208, 226, 230, 231, 238, 240, 244, 253, 258, 272,283, 287, 312, 371, 425, 426, 469, 496, 523, 553, 568: n = A,T,C or G
  misc_feature 577, 580, 586, 621, 632, 640, 670, 674, 690, 719, 725, 731,735, 744, 749, 795, 799, 804, 810, 822, 836, 847, 851, 855,867, 868, 875, 882, 894, 936, 951, 966, 978, 984, 998, 1001,1002, 1007, 1019, 1047, 1056, 1064, 1072, 1097, 1118: n = A,T,C or G
nttatncgttacaagcncctggctntttgcgcganccctcgattcncattccgngccagggggngggaagaaattncccnnnaattgggtgccnncccntaaagggggcnncttgggcgcggcccnccttaaccgtgngatgggaananccggagnataaggaaggtncctannctnggtgggntccttataaaatttcctcnngatnccttggagaaggcggacntcanngttttanancagnttattgtcngtccncagatctctaaatncattttggganctancttttgacccctttaggtcagaaanaaaatcttgggaagcctggggctttcctggaagggtcaaagaaggtaactttcaggggntttaagccagggaattgggccattatttgcaccacccttaaaccctttccggannatccattcaagcctggcccttttcaaaaccatttttaaatttngggcccaggggtttattggaattgggncaaaaaaaattcccaggggaaattcancccttcaagccaggtttaaaattaaaaaanttaaaaattaaattnttttggggnccnaattanttggttacccccggaaaaatttttccccaaaaatnggggaaaagtnggcctttnttccttgggggagggagggcccaggaaaanccantgggaatggggacccnaaaagggggtttccggaagggaaaaaaanccaaancctttncccncccccttanttggnaaaatttttgggaattttttttttcccaaaaaaagggttcctttantttnggggnaaattnccccttccggtnccttgggtcctttnccccgggaaancccncccnggcccccggttnntttccanccaaggnaaaacctttttntttccaaaaaaccccttgggggggggaatgggttccccttantttttgggaatgggnttttttttggccttnggggggggtttngggggnccccctttttgggnccnnttttnccccggtttggncccaaaagggaaaaaaaaacctgggccncctgggttntttttggnccccaatnggaatccttccaaattcccctgggnaattccttccatttaaaaatngg

SEQ ID NO: 8428 - DNA, 720 bp, Homo sapiens
  misc_feature 1, 8, 33, 49, 63, 64, 75, 112, 114, 116, 117, 138, 147, 195,198, 217, 263, 272, 281, 283, 285, 305, 317, 329, 335, 339,343, 348, 355, 359, 364, 373, 379, 414, 415, 456, 482, 491,498, 511, 518, 521, 538, 542, 543, 563, 572, 588: n = A,T,C or G
  misc_feature 591, 595, 604, 609, 610, 625, 635, 644, 659, 663, 673, 690,694, 695, 696, 698, 703, 704, 708, 712, 718, 719: n = A,T,C or G
nctaaccnttttcgaaccggcacgagggccagncagctgctcacactgnacaccacctctatnntcctgcgcctntgacctgtcgcctcctgcccggacgcccgcctgctgncngnntgcgagggcggatgctgctgntgggacgtncggctggaccacccccaaaagaggagggtgtgtgaagtggaattcgtnttntctgagggctccgagcatntggacggagagtggatgggctggcatttgtgaatgaggacatcgtngcctccaangggagcggncngngcaccatctgcctgtggagntggatgcaaatntgggggggacgnggcaancagnacanaatgncattggnggtncttgngctgctgcnatgganagccaccgatttgcctacttatcctcagaccctgnnctgataaggggattgtgctctgaggggatgatacggcaacntgtggctctacgatgttaacgaaatnctgaagcangacaccnctgatgctggtanccatgtnggntgcacacagatactganatgnncccaaccccttggcccttgnccaagtggngaccaaaaccatggtnaanacantgggtgganaatgnntcttcacatacctgnacgacatganggactacanaatttaccatctggnggangatgtagacntacaccatcccaaaagnaccnnngncacannttantaanttattnnt

SEQ ID NO: 8429 - DNA, 789 bp, Homo sapiens
  misc_feature 19, 44, 67, 70, 89, 100, 101, 113, 114, 115, 117, 125, 130,139, 141, 146, 150, 166, 173, 191, 202, 204, 220, 222, 252,270, 553, 682, 697, 711, 773, 774, 787: n = A,T,C or G
cctaactctttcaaccccnggctttttgcaggaccctcgattcnaattccgcacgaggagagtggcnccntaaaaagctttttttgagnaccgggacccnnaaaggaccaccnnngncaggaccngattnaaagaattntngaccngccngggggggaccttcaanaacccancctgagagggtccaacgngaagggagctntntttgaagagatgctgncnccactgcacatgtcacaaagtgtcagatgnagaattttagggctgganggaagatgtaaaagatgaaaaatgttttccttatcacttttctttctccacccactcagttgtctaagaagaaataacactgtaaggaaatttaaaaaaaaaacatttagaggattatgcttgttttgagtggtgcataagggaaaaaactgacttttttttccatattctgatttttaaccagaaaagccactcatttaatagatgtaggggaaacctagatattgctgccttttggaatgggggtagggggggtttacctgggtttttatgacccaggccntaagatctattatatttgctttttaaataggcatgatgtggaaataccatcttggtttgagatgccattgaggatttttaatttattggaaagcacaccatatgccattatatttattggaattcctanatgccagtattgggntatttaaattggtnaaactttatgaaaacctgggaaaaggttgttcaaggtttataaaaagccttaagtgatgccnnccctctttaaaanct

SEQ ID NO: 8430 - DNA, 794 bp, Homo sapiens
  misc_feature 15, 28, 42, 55, 59, 60, 66, 70, 72, 76, 81, 88, 89, 96, 105,112, 113, 114, 116, 117, 120, 121, 134, 140, 146, 149, 154,158, 163, 166, 169, 173, 174, 179, 187, 191, 198, 202, 204,205, 218, 228, 422, 535, 624, 626, 633, 640, 654: n = A,T,C or G
  misc_feature 671, 678, 691, 702, 707, 712, 717, 728, 732, 739, 757, 768,775, 790, 793: n = A,T,C or G
ctttgaaccctcgantcgcccgcacganggatttcttggtgntggggacctattntcanngctttnggcntntggntaccnggggttnnagattangggcctttnatacctnnngnnccnncaaatttttttgncggatnaagatngtntgttngtanctaangtnaancttnnaaccngaccctcntccngttttantaangnntttttgcaacctnctggtaaatngcaaaatcaatggccaatggttaaccaaagaaggaaaacgttggggtgggactttgtctcttgcaccggtatttcaggaacaatctggcttgccatccccacagctctttaaaactggctatttatgtgtgcctttcattcttacatttctaatcatactgcaggaaaaacattggattcagctttagactganggaaaactctccattatgttgtaaagaaattatagatgtttgagagacacttttttgttaaaccagatattggactccagcaactattggggggtatatttttagttcattgntctcatttaatggctaaaatatccctttatatttggcttttaaataaattttcctttttttcctttttttttttttttaaaccgggagncntcccttnttgtttncccagggcttgganggggcaaggggcaacanaaacttnggggttttttggnaacccttttgnttttncccangggtnaaggccggaanaatnccggganttcagccctttcgggagnaagggggggcnctttcangggggcgtggccccnctng

SEQ ID NO: 8431 - DNA, 729 bp, Homo sapiens
  misc_feature 1, 5, 17, 18, 19, 25, 676, 694, 697, 699, 715, 722, 727: n = A,T,C or G
ntttnaaaccccctttnnnaaacangggaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgaccccatatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaaccaagccaaaatcaggctgagaaaaagccaaagaaaagccaaaaaaaaaaaaaaaaactcggncctttaaaactattgggngcntnttcctaaatccccacntgataanatccntg

SEQ ID NO: 8432 - DNA, 825 bp, Homo sapiens
  misc_feature 13, 18, 19, 41, 50, 65, 78, 83, 91, 106, 108, 118, 121, 123,137, 149, 161, 164, 172, 194, 211, 215, 231, 247, 259, 377,432, 452, 472, 487, 492, 529, 535, 542, 544, 614, 633, 684,717, 726, 745, 748, 759, 802, 806, 820: n = A,T,C or G
agtgaacctttgnactcnnttttttgaggaccatcgattcnattcggacnaggttggaaatgaangcatttttttttntggcntatatccntgacatatggggggnanttttaaaacnacngngcctaaccgtgttntaaaactttggnagtaaatgaacnttngaaatccnttttgataaacctgctgtaaangttttttcccccttggngaangttttctaactttgcntgggtaatggcaattnactaggtgcggnggttctaaagttcgaaggcacgatatgcgtgtccatccttaccaaaggatggggaccgcaaaccgagccgccaccggcactaacctatgaccttctgacctctgaactcttacccatngatgacctgaccatgcctgcctgctgatcaagttaactgggtaatcgcctttgcnttgcctgtcgtcagtggcanccgaagcctgaggcacttgntccgttccgtcttanccttntaacccaaaccaaaaggacaaaagaaaattggttggnccttcnacctcancntttttttttttttttcctggtttggggtggaaaaagtgggttctaaaaaactgcacttggaataagttangtaaaagccaattaagggncccaatttcattcccacaagcacttggatcaatctttttaaataatcccancccttaagccgaaccgggtaagaaagggccctntttttaaanaaagggggaaaaaaagatnggnccttaaactanctcaatggacagaagggcagtttacctgggggaaaaaaacttnttanggaaatcttttttnttttt

SEQ ID NO: 8433 - DNA, 778 bp, Homo sapiens
  misc_feature 5, 13, 115, 116, 378, 384, 593, 690, 694, 707, 714, 763,764, 770: n = A,T,C or G
gactnactctttnaactacttgttctttttgcaggatcccatcgattcgaattcggcacgagggatagcccacctcatgttccttttcctgaactctcaacagacactgttatanntgtgatcactaatatgacaaccaccatccagagtctctttccaaatctccaggtttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacngcccanatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatattttcaaaaatacagtgatgtcattncaggacaattttatggacacactcacagagacagcattatggttctttccagataaaaaaaggaagtccagtaaattcttttgtttggtggctcctnctgntacaacccagtgnaagagtngttttagaaaaaacagaccaccaatcctgggtattaagactggtttcannaatganccctcggg

SEQ ID NO: 8434 - DNA, 940 bp, Homo sapiens
  misc_feature 5, 6, 7, 8, 9, 10, 11, 12, 14, 16, 18, 21, 22, 25, 27, 29,48, 65, 66, 68, 77, 88, 97, 109, 113, 126, 130, 146, 152,177, 181, 196, 198, 202, 243, 249, 301, 308, 764, 772, 776,787, 796, 818, 826, 832, 847, 878, 881, 882, 903, 928: n = A,T,C or G
  misc_feature 934, 938: n = A,T,C or G
cgggnnnnnnnntnancnttnncgntncncctttttaccttccagggncctttggcccttttaannanggttttttnggaagaaaaanaatggaacntttgggaaaagnaagntccaatggttggntggntttggggcccacccgntttttnattggggccctttccttttccaagnaagngtttcaagaaccaangnaaangttattggaatggaaagccccttttaagggtggtttaccangaaaantggcacctaaaaaatgggggaataaaaggacaaatcttccaaaatctttaangggggancctttccctttactacagaattcaaatgcgagatcttggaggggttacaggggaaacgagggtatcagttacttcagcttcgactgcgcagagagcatcatggattggtatctattgttaccatttattagaagattatgaaatgcacaaagatttagaaaattaggaaccacagcatcctgcaaggtggtatgaaattaggactctcttattcagatcaagtcttcgggagcaggctctatagagaactttggacatcttgacctatgaaaagcagatttgtgataacttgctgtagaagaaaccaaagggggaacttcttgttgccaactattgtcgtttgggaaagaaatgctgcagatgtttataggaggatttgcaaagagaagaaatccttgaaaaacttggggccctattaccaaaaggctttgggaaaaaaagccacttccaagcccnagccttanattntggttttaagnaaccgggcnttaaaaaaaattttattggaangggaaagncccctngggaccttaaaattnttccccaagggggggaacttggggtggcccnaannaaaagggcctggccccgtttnaaaaaccttttttttttaattcttngggggngggngg

SEQ ID NO: 8435 - DNA, 1481 bp, Homo sapiens
  misc_feature 2, 3, 4, 5, 6, 7, 8, 10, 13, 14, 16, 18, 19, 21, 22, 24,25, 26, 27, 28, 30, 31, 33, 34, 36, 38, 39, 45, 47, 48,49, 51, 52, 53, 54, 63, 64, 66, 67, 68, 71, 75, 76, 77,79, 80, 81, 83, 84, 85, 87, 90, 91, 97, 103, 105, 106, 107,108: n = A,T,C or G
  misc_feature 109, 110, 111, 112, 113, 114, 115, 116, 117, 118, 119, 121,129, 130, 131, 132, 133, 135, 136, 137, 138, 140, 141, 142,143, 144, 145, 146, 147, 148, 149, 150, 152, 168, 171, 176,180, 182, 188, 191, 197, 202, 210, 217, 220, 222, 229: n = A,T,C or G
  misc_feature 240, 247, 248, 259, 262, 264, 270, 273, 290, 293, 298, 306,310, 314, 318, 319, 343, 348, 349, 354, 361, 365, 371, 372,380, 383, 388, 390, 393, 394, 395, 398, 400, 403, 405, 407,418, 420, 422, 423, 424, 425, 429, 435, 439, 440, 441: n = A,T,C or G
  misc_feature 457, 459, 463, 467, 468, 469, 473, 474, 483, 490, 492, 503,506, 508, 516, 518, 520, 529, 530, 531, 532, 533, 535, 538,539, 542, 544, 547, 548, 558, 562, 564, 566, 571, 573, 577,579, 585, 586, 589, 592, 594, 597, 598, 603, 605, 608: n = A,T,C or G
  misc_feature 612, 613, 619, 620, 622, 628, 630, 631, 632, 639, 640, 648,654, 657, 659, 660, 666, 674, 684, 685, 689, 695, 698, 709,710, 716, 726, 727, 731, 744, 752, 762, 767, 776, 777, 795,797, 800, 801, 813, 821, 822, 829, 835, 840, 843, 845: n = A,T,C or G
  misc_feature 850, 853, 854, 857, 858, 863, 886, 889, 892, 898, 905, 922,924, 928, 929, 938, 946, 948, 959, 963, 972, 982, 983, 986,998, 1009, 1015, 1016, 1020, 1036, 1037, 1051, 1052, 1060,1065, 1071, 1075, 1078, 1080, 1086, 1088, 1092, 1094: n = A,T,C or G
gnnnnnnnangtnnanannannannnnnanncnntnannaaggtnannntnnnngaagggggnngnnnaanacgnnngnnnannnangtnngatggnggaganannnnnnnnnnnnnnngngcgggatnnnnnannnnannnnnnnnnnngnggaagtaaaacccctnttnccaanactncnccgggnggncctttnttcanagaaaacnacaccgnggngnccccccncggtggggggnagacganncatcacatacngantntgtagnatntgaataataatatttcntgntcganatttactngctnctgnactnnatgcggggggggggggtgtctttnatatnntacgnatggcgncccncctatnnagttaacntanactangnggnnngancnggncncncgggaacattnancnnnnatgnactgantcannnaaccactgaatcgcgntngtgnaaannnctanngctttatgnacgaatnanggaaaagaatnttncnagcgcganantngcaggcaannnnnantannagntncannggaaaacgtncagnangncgtangnacancnggtatnncgntanangtnntaacntnagncggnntggtanntntagcantnnncgatgtnngcgagtangagtancancnngatgangcgatatntgcatctcgnntatngtgagnatntatgatacagnnagatcngggaagacannaagngcgcgaatgttgnaatatatngactgagtgnagcangcgcgacgnntcgcactacacacgagangngtnnctcgcatttgancttgaatnnacaccgncgacanacgantananatcgnagnntanngacanatactgggtatatctctacgacnganagngtatantgactcntcttaagggagagagtngnacannagtgacgtntacgacangntacgacgagtntgcngagaacagnagagactaanngantacatatatgtngatgtgaagcntagtannggcnatctcgggtcgtatcnnagatgtatcatagnntgacacgncgtcncgagcncacncanancgcgtncngccntnacnnncatnntgntatatnncngnntgtgttacanatagaatntcnnactannnagcgnaatatnannangcnataannncnnntgannacgacncgctncngnannntgntantatgagaagtnaatcangcnntcgntnggaannatcgntgcntntcgggcngnccngntnaanttnnatgtgngnnnnnagnnnntnnnctatnnatntannnantacaganncgacangnngnnaanagagtgtanntnnacnaggatagnaagnnagggnncnnnacgngngaggngcngnagnnaaantgatgatgtaantanacanngcaaanngtnggggantcnnaaacncgntnatancngnacgncnnaggaganagntnagcgn

SEQ ID NO: 8436 - DNA, 740 bp, Homo sapiens
  misc_feature 7, 9, 12, 18, 21, 73, 92, 94, 97, 100, 123, 133, 138, 146,692, 719: n = A,T,C or G
agtttananccnctttantcngccgagaataaataatggggacctggttaaatagcttctctacagccaaaanaaataattgtcaaaataancngancanccccccagaaccgggagaaagantaggaacttngtaanctgtgccntgtggacaaaagaacctagttttccagaaacctccaggggaactcaaatcagccaagaaaaataaataatcccaccaaaaagtgggcaaatgacatgaatagacatttctcaaaagaagatatgcaaatggtcgagaaacatatgaaaaaatgttcaacatccctaatcattagagaaatgcaaattaaaaccacagtgagattatcagcttattccgtctagaatggccattattagaaagtcaaaatacaatagatgtttgtgtggatgtggtaatgcttatacactactggtgggaatgtaaattaatacaacctttatggaaaacagtatggagattccttaaagaactaaaagtagatctaccattcaatccagcaatcccctactgggtatctatccaaaggaaaagaagtcattatatgaaaaagacacgtgcccacatatctttattgcagaccaattcacaatttcaaagatatggaaccccctaaatgcccattgccaatgagtgaataaagacaacgtgatgtatatgtatttcncccatgtaatactactcaccctaaaanggatgaagtatgtgtttgcac

SEQ ID NO: 8437 - DNA, 1704 bp, Homo sapiens
  misc_feature 1, 5, 6, 8, 11, 12, 13, 18, 19, 23, 24, 27, 28, 29, 31, 32,34, 35, 40, 44, 45, 47, 48, 49, 50, 51, 54, 56, 64, 67,68, 69, 70, 76, 78, 84, 87, 90, 92, 93, 96, 97, 103, 108,114, 115, 116, 120, 122, 123, 126, 127, 133, 134, 135, 136: n = A,T,C or G
  misc_feature 139, 140, 141, 145, 146, 151, 152, 166, 167, 168, 172, 173,174, 176, 180, 186, 187, 198, 201, 204, 207, 208, 211, 212,214, 215, 224, 225, 226, 227, 231, 246, 247, 248, 250, 251,257, 259, 268, 282, 283, 285, 290, 297, 301, 304, 308: n = A,T,C or G
  misc_feature 309, 315, 317, 368, 375, 389, 390, 401, 406, 415, 421, 441,453, 455, 464, 472, 475, 477, 481, 483, 490, 500, 502, 505,508, 509, 516, 517, 518, 520, 527, 529, 530, 532, 537, 544,551, 552, 555, 558, 562, 563, 566, 572, 575, 576, 582: n = A,T,C or G
  misc_feature 585, 586, 591, 592, 597, 598, 599, 600, 601, 607, 612, 613,615, 616, 621, 624, 625, 627, 631, 632, 635, 639, 640, 646,660, 661, 668, 669, 672, 674, 675, 711, 712, 722, 726, 731,745, 755, 763, 764, 766, 771, 774, 776, 777, 782, 788: n = A,T,C or G
  misc_feature 792, 795, 817, 819, 820, 836, 838, 854, 857, 861, 882, 895,899, 903, 907, 910, 920, 923, 925, 926, 927, 932, 935, 936,937, 938, 939, 941, 955, 966, 969, 974, 978, 979, 987, 988,994, 1000, 1011, 1013, 1018, 1026, 1031, 1037, 1038: n = A,T,C or G
  misc_feature 1044, 1047, 1048, 1049, 1055, 1056, 1063, 1067, 1082, 1091,1102, 1105, 1106, 1107, 1109, 1122, 1124, 1127, 1130, 1132,1134, 1136, 1144, 1145, 1156, 1165, 1166, 1175, 1178, 1179,1182, 1183, 1195, 1196, 1202, 1223, 1230, 1246, 1248: n = A,T,C or G
nacgnngnaannnaaganngggnnggnnncnngnnaaganaacnnannnnnaanangaacgcancannnnacacangngagagnaancangnncgnnagacgncaaangcgcannncganannaanncgacgnnnnacnnncagnnacagnncacggagacgaacnnnacannncncagnacagannaaacacagcgngcncancanngcnncnnccccccccnnnnccgnggaaacacccccttnnnanncccccncnagagaaaancggggcctcacganncnacggnaacgaangggnccnaagnngggggngnacaaaaatttaccacaggggccaggaacaaccaccggggggggcaaactgnccaaggngcgagaccatactnnggcaagaaagncaagncataccagnacaacngaaaaacagcaccaaggacngactggccaaangnctggagganggacaacnaanangaangnccgaaanaacgaagccnangcngcnnaatgggnnncnaccacgnanncncgaangaaaganggaccannaanagngganngcngagggnacnnacaagnaanncgaannaaggnnnnntgaagngaacnnannacacnaanngnagcnnacncganncacggnacgccacagcagannccagacnnaancnngcggaaggcggagcgaacgacacaaccggcccccannggggggggcncgcnccaanggaggggcacaagnaaaccaaagngggcacgnnanatatncangnncgaanaaacancaanganaaacgcgcccagagcaaaacananncaagacacacaccacncncgggaggagggcaganacngcanaaacagagcgagcgcagaggngacaccaaaaacnaacncagncacncgnggaagcaaanagngnnngacgnacnnnnncngcgacgggatacgngggagagacancancacgnacanncgaccganngcgcgnagacanagacagaccancnggcanacgagacngacgncacggnnaagatnacnnnacgacnngacgcgngacngagagcacgagaaanacggggcgnaagaaacacgnaannngncacacgcgcacananagngananangnaaacgacnnaaagacagganggagaaagnngggacacgnganncanncagaccgacacnngagtgngacacagcgggagaaacacgngactaanacacgaacacgcagcnanacacagagnagacagcgangaagacacagnnacaagcgcgnacgacgacacgnacgnaaagcnaacngacacgcgnacgangangcncngacaccacgagaacgacgancgcananacacnngngaaagacgcncncgngagacanacgcacgntgnacggaaagcgananancgagacacgangagacnacncgcacacaacacnnanangcgnggacagancacgcacaacagccgacacncgcgnnncgcggcncaccnnacncgcggacnncaancncgncaacgnncncncnngcgcngagacacnncgcacncagagacagaacgngnnnacacngacaggnganncnacacacaagcnancncgcgcgnagacggnncganagacngacgagaanncacncacaaacgcngnnaacgnnnggnaacancnngccgnancncacaanccg

SEQ ID NO: 8438 - DNA, 815 bp, Homo sapiens
  misc_feature 15, 24, 44, 47, 64, 78, 83, 103, 104, 108, 118, 121, 133,138, 141, 148, 151, 157, 160, 170, 177, 178, 185, 189, 191,222, 223, 262, 271, 281, 290, 304, 316, 317, 330, 331, 336,341, 345, 346, 347, 356, 359, 365, 379, 384, 397, 401: n = A,T,C or G
  misc_feature 403, 409, 414, 417, 422, 423, 428, 430, 437, 438, 441, 443,445, 446, 447, 462, 465, 467, 479, 485, 492, 493, 496, 498,516, 519, 523, 524, 530, 534, 535, 538, 541, 544, 549, 550,551, 562, 563, 566, 586, 592, 597, 598, 613, 615, 620: n = A,T,C or G
  misc_feature 628, 645, 646, 647, 654, 660, 679, 687, 690, 697, 700, 701,702, 704, 717, 746, 749, 750, 760, 761, 764, 769, 771, 773,775, 776, 778, 783, 784, 790, 792, 795, 797, 802, 809, 814,815: n = A,T,C or G
gatctacatctcctnttactcagntcttgggcattggccttgtnagngttgcgaacctcttagnagggaatcccccantctgngcacaccgcaagccaatctnnattnaaaagtacgntanatcccttatagngtagnganttttttntangtaaanacnaaaattttcnccctcgnncccgctnaaantnaccggggggggggggccgctttttttttttnnaactatagcaaaaaaaaaataatctctctcgcagcatgntataacccnaaaaaatttnaatatactntccttatgggctcncttaactaaatnncactttttttcgnntaaantttcngtcnnnactaatatnttnaaattnagggcctcaaaatntaatncttatatttaccnaacntngttccncaaanctnactannaaatntntatcctnnctntntnnnggcataaaacaccanacngngtgatgggttancgcagngcgaccnnttnanttgccagtcctactcccnttncttnntttatncttnntantcncanccatnnnattatactaannttnaaaggattcacttttttccntaatcncattnntaaaccttacgattntnctaanttgtttanaggcttcatcttgacannnatataanggctgngtactttttaatatagacnactgacanctnacccatncgnnntntgattatatgatnccaatctgcctttttaaaaatactattanaannttaccaattnnaanattangntnannantcgannttattntntancntttanaacattnatacnn

SEQ ID NO: 8439 - DNA, 1440 bp, Homo sapiens
  misc_feature 6, 14, 17, 25, 28, 30, 36, 37, 38, 46, 47, 57, 64, 68, 74,75, 76, 80, 81, 82, 83, 96, 102, 106, 111, 119, 120, 138,139, 142, 145, 152, 153, 159, 163, 167, 171, 172, 174, 177,180, 187, 188, 190, 191, 193, 195, 196, 198, 200, 202: n = A,T,C or G
  misc_feature 208, 239, 245, 246, 248, 249, 255, 256, 257, 260, 283, 288,292, 294, 298, 299, 326, 330, 334, 344, 347, 354, 373, 375,377, 383, 387, 388, 389, 392, 396, 405, 408, 413, 416, 423,425, 431, 435, 436, 438, 440, 442, 445, 450, 453, 456: n = A,T,C or G
  misc_feature 460, 461, 464, 465, 468, 470, 471, 472, 476, 477, 479, 482,483, 485, 486, 491, 493, 498, 506, 515, 516, 524, 525, 526,531, 533, 538, 544, 546, 547, 550, 553, 558, 560, 561, 565,567, 569, 573, 581, 582, 587, 589, 591, 592, 599, 607: n = A,T,C or G
  misc_feature 609, 612, 617, 620, 626, 628, 629, 631, 632, 633, 635, 637,639, 640, 641, 649, 651, 653, 655, 658, 661, 666, 670, 672,673, 677, 682, 688, 689, 692, 693, 694, 697, 702, 705, 707,708, 712, 714, 717, 719, 720, 721, 723, 731, 736, 737: n = A,T,C or G
  misc_feature 739, 740, 741, 742, 748, 754, 757, 758, 759, 764, 767, 772,775, 781, 783, 784, 787, 789, 790, 791, 792, 796, 800, 802,804, 806, 807, 808, 813, 816, 819, 823, 824, 825, 826, 828,829, 831, 832, 835, 836, 839, 841, 844, 845, 849, 851: n = A,T,C or G
  misc_feature 854, 858, 860, 861, 862, 866, 869, 870, 871, 873, 876, 877,878, 879, 882, 887, 893, 895, 903, 904, 906, 911, 912, 915,917, 922, 927, 932, 933, 937, 938, 942, 944, 946, 947, 950,952, 957, 961, 980, 981, 984, 987, 988, 989, 994, 998: n = A,T,C or G
aacacncacgactnttngtcaaaancgngnaaatannntggcatcnnattctcaaancccgaanatancagcgnnntctnnnnaacatcagcgcgngacacngcanattgnagatattnngagtgatactagtgaatnnagncgnaaccggnngataantganagcntaannanacnagngacatcnngnntncnncncngngtttgnaaaaccccccgttacgcggcacatacacctnctgatnngnngctatnnngtngagactcatgaagatcagccgtncaacnctananatcnnctcgactactcccacagcggggagagngggngganatctaatcanganacaattnataatctattaactaaatnancnctgganaccnnncanaggnggggggggntgngaatnctnggagacnanaaactnaacnnantntncancctgnttnatnactnngannganannnacgnnanganngnnagccnanggagnatgatatnaacgcgatnngggatacnnngaagncngtggnaagtananngancgnatagnannagancnanaatnatcggtanngaggngngnnggacatnccgatatntngancgccntcnattgantnnannnantntnnncataaatntnananttnggntgagnatananncaangttgnaatacnnacnnnaanagtgnatnanntgancngancnnntncatactancttgnncnnnnaacctncttgangcnnntcgcncgnaatcntantgcganannacntnnnnggtnatgnangntnnngaganttntanccannnntnngnnatnntancncgnnttcncnatncgantnnncagngannntnaannnnggnatcgnctatcntnacgctgcnnancaagnnaangngcgtntctanatcgnnaggnnctancncnncancntgcancacncattgttcatagcagccanntcncannntacanagtnngtcncgaagancctnancgaanctgananantangcangcangnganagcacanngnagancgacatgttnncgaggtgtcgnatncncttnagannagnngacanncncngnactcncgcgcatancgcgcntananncgagctgctcncggtgcnacntatganannnatctgntananaacaaanangcgngtgaactncctatcatcagggnncnctctannnattgatacgtancttnatagnnctaggnatnatcnggcangacggctgntgggngnnanncacgttatacacnancngcnnnagannannactangtnanncgggagnaganatgnangctcncactactncncanacganngcntctgtncanaaganantgnncanacaaanangtataactgtgngncatgcgncaannagatacaccgcc

SEQ ID NO: 8440 - DNA, 919 bp, Homo sapiens
  misc_feature 5, 6, 7, 8, 11, 20, 49, 55, 57, 63, 69, 77, 79, 82, 87, 99,104, 124, 125, 141, 144, 146, 150, 157, 160, 168, 170, 173,181, 182, 187, 190, 192, 195, 203, 214, 219, 223, 228, 234,248, 251, 255, 257, 262, 266, 270, 271, 277, 282, 286: n = A,T,C or G
  misc_feature 287, 293, 298, 305, 306, 309, 311, 315, 321, 324, 331, 332,333, 335, 340, 346, 351, 354, 355, 356, 357, 364, 367, 368,369, 379, 380, 385, 393, 396, 403, 408, 410, 411, 422, 423,427, 428, 432, 433, 439, 441, 445, 449, 452, 453, 455: n = A,T,C or G
  misc_feature 460, 472, 478, 488, 490, 496, 497, 510, 523, 531, 532, 533,534, 540, 553, 554, 556, 561, 562, 566, 576, 587, 589, 590,603, 606, 607, 610, 613, 620, 628, 633, 634, 639, 642, 644,647, 656, 658, 662, 663, 664, 673, 685, 686, 690, 693: n = A,T,C or G
  misc_feature 695, 714, 717, 718, 719, 723, 747, 761, 766, 768, 773, 778,787, 804, 807, 816, 817, 818, 823, 825, 834, 842, 845, 849,852, 854, 861, 862, 866, 868, 871, 875, 876, 877, 880, 887,893, 898, 911, 915: n = A,T,C or G
gatannnnctntctcaagcntgcatgcctgcaggtcgactctatagganccccgngngccganctcctntaatatcntncanatganttttttacaacnactgnctcgcccttctacggggggnnttttttgactaaaaanatncntccntttaacntanttaacctncntgnagataacnnccccnttnanccngctggatntaataactaantaacncccncaccngatcgnccttccaaacattntcngctncnatgantatngaanngcctcnccctncacnnaccaantcacncccgggnnggntntggntggttnacnacacaannntnatcanattcantatgncannnnatctaanctnnncgttcctttnnctttnctaccctntantttactnagacnanngtacgccctgnntctnngtcnntcaaancntttnaaantcnnanagctnctttttaagggntaccangatttaatgncntttaanngggaacccttcanacccacaaaaaanaacttttnnnntaaggntcggattggttcnnantgttnnatgnggtctattcngtccttgaaanannaatgggatttctnccnnccnctntctggancgggattntaagnnccacnttncnatntaaaattangncggnnncttctttgncccccaaaacanntganccnantaaaccccagctcctttcnggnnngagnttaatttatttattgtaataaaanaaagggaatttgcntcacnanttccnggacntaattgaantaaaaaaatcagctttntanaaaacaaannntaacncnaaatttccnacccaaantanttanctncntaaccannttcntngcnagcnnntanttcctcnttaaanaactntggggggatttgnaacncccc

SEQ ID NO: 8441 - DNA, 724 bp, Homo sapiens
  misc_feature 1, 7, 8, 11, 634, 646, 652, 661, 664, 672, 680, 683, 698,705, 707, 712, 718, 719, 720, 721, 722, 723, 724: n = A,T,C or G
ngttacnnccntcgctaattcactcttcagtagcttctaaaaaataagcatcatcaatgccattatcccagacagcatcagcagatgcacctgttgacagcctgctaggtgatgggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaaaaaaaaaaaactcgncctttaaaactnttgggnggcgttttnccntaaatccnaacttganaanaactttgttgggttnggacaancncaccntaaaannnnnnn

SEQ ID NO: 8442 - DNA, 1085 bp, Homo sapiens
  misc_feature 1, 3, 7, 11, 19, 21, 23, 24, 30, 37, 48, 49, 55, 66, 76,80, 81, 84, 94, 96, 99, 110, 111, 115, 116, 118, 125, 126,127, 146, 150, 159, 160, 162, 165, 167, 168, 172, 173, 177,178, 189, 192, 196, 198, 203, 207, 211, 214, 215, 216: n = A,T,C or G
  misc_feature 217, 219, 225, 229, 231, 232, 234, 236, 242, 247, 254, 262,263, 264, 267, 272, 275, 276, 278, 293, 294, 296, 298, 313,317, 330, 332, 339, 350, 355, 356, 370, 375, 376, 380, 392,404, 406, 409, 411, 413, 415, 420, 425, 426, 431, 432: n = A,T,C or G
  misc_feature 434, 442, 452, 459, 460, 463, 468, 473, 479, 481, 486, 492,493, 500, 502, 504, 508, 511, 528, 529, 533, 541, 543, 544,546, 554, 563, 571, 574, 579, 580, 581, 582, 583, 587, 588,594, 595, 601, 602, 603, 607, 612, 613, 617, 618, 622: n = A,T,C or G
  misc_feature 623, 634, 637, 640, 642, 644, 652, 657, 658, 662, 664, 671,673, 676, 678, 682, 683, 688, 689, 691, 694, 698, 701, 703,710, 715, 718, 720, 722, 723, 724, 728, 734, 735, 738, 739,742, 743, 751, 753, 754, 755, 756, 757, 758, 760, 762: n = A,T,C or G
  misc_feature 767, 771, 780, 782, 792, 794, 795, 796, 798, 801, 805, 812,814, 819, 821, 826, 830, 834, 841, 843, 849, 852, 854, 856,859, 865, 866, 868, 869, 870, 872, 881, 885, 889, 890, 892,893, 894, 895, 913, 916, 919, 920, 923, 924, 926, 928: n = A,T,C or G
  misc_feature 929, 930, 932, 933, 934, 935, 938, 942, 944, 951, 965, 966,970, 972, 978, 980, 982, 989, 992, 994, 995, 1009, 1010,1012, 1014, 1015, 1020, 1021, 1025, 1029, 1031, 1033, 1035,1039, 1041, 1042, 1043, 1046, 1047, 1049, 1050, 1053: n = A,T,C or G
ncngacncttncaactccngngnntttaangaacccncggggcccccnncggggnggtccctaatncttaccaacnacannttncctcgtcacncnaanccctcgacggnngggnntnttttttnnnaaacccttaaaaccctccnaatnaagacctcnnancgntnnccgnngatnnatgaatatccnatnaccncntgttnactncccntannnntnttaccnagangnncngnttcgcnacccngggcacnctccgcannnatngtccncgnngncgttcgtataataanntncntcgctacggggttgnggancatacggatctcncnacaatanacctctgatanataanncggaaggcctcggncaatnntctncgtccgtacctntcgactcttcananatncngncntactncatcnntgtgnncncgcacgcntccccatcgntgggcgnntgngcgtntactngtgaanantcatntctgcnnacgaacntncncatncantatttgagggcaacacnntccnctacaaantnncncccatccngcgcagggnggtctacncanacatnnnnntatnntccctnntcgccnnnaacncaggnnaagnnctcnngatccaccccncgnaanantnaaatactnctccnntgantnacctatnanagngngttnngcccnncnaangtcntcntntccaccntcttntangntnnnaatngtaccnnctnncanngaggcgancnnnnnncnanaaganccantaatcaatncnctgtcccatngnnntnaanttcntctaacncnaacanantgaanatcnatcncccgtcncngggtanaanananganataacnncnnncntccgcgacnatangttnngnnnntgaccccctactataacncanacnnacnncngnnngnnnngtncgcntnatggacnacgacctatcaaanncccnanatacgngncnattcccnatncnntctctgaatattgnngncnngcaanngacncccncncnangtgncnnntgnncnnganntncatccnggntccanagcaantnnnngncg

SEQ ID NO: 8443 - DNA, 749 bp, Homo sapiens
  misc_feature 3, 24, 29, 34, 35, 44, 45, 46, 47, 51, 54, 56, 57, 67, 68,69, 75, 85, 90, 100, 105, 107, 111, 114, 115, 118, 127,129, 130, 132, 133, 146, 148, 149, 151, 154, 155, 160, 166,171, 175, 184, 189, 193, 199, 201, 202, 215, 216, 222, 223: n = A,T,C or G
  misc_feature 224, 225, 229, 234, 242, 261, 275, 283, 291, 301, 302, 311,316, 320, 323, 329, 331, 333, 335, 336, 341, 344, 358, 359,381, 393, 400, 401, 406, 410, 411, 417, 419, 420, 426, 430,432, 437, 438, 439, 445, 447, 449, 450, 453, 455, 460: n = A,T,C or G
  misc_feature 462, 470, 471, 474, 475, 476, 478, 479, 483, 485, 497, 501,504, 506, 513, 514, 516, 523, 524, 528, 534, 538, 539, 541,542, 545, 547, 548, 555, 559, 564, 565, 570, 574, 577, 581,584, 586, 590, 602, 608, 610, 630, 632, 636, 638, 646: n = A,T,C or G
  misc_feature 647, 657, 660, 669, 672, 677, 679, 710, 714, 719, 721, 723,729, 732, 733, 735, 737, 738, 742, 748: n = A,T,C or G
agntttgaaccccttaccagtacnccgcnaagannatttcaacnnnngtgnttnanncctatgagannntgctgnacctactgancctangactgcaccnattcnanctcnatnnagnatgagatgncnnannggacatattctcnanngnacnngctanatcttntatanaccntggaggctngtganaaantcgcanannctcaacctgaatnngccatnnnngacnttganacattggnaacgctagaccctaagaanatactgcaatgagngctgtgcntttgaacnctatgactannagcaagccngggangttntgnctcagntnanannctctntanatattgaagagaanntcatgtttctgaagactccctncaatgtggatangataacnnaatancaanntgaagnanntgctgngcgnancggcnnncacctntnannccntnactcntngaagcccnngtnnntnnatgncnaagtcctgactncatnacnanttcggtnnanataatgnngccncatcgntgcnnannatncnncatgaanccgngcatnngggcncttnccngtantcncngctncctggtaggccnaggcangngaatcagcttaaaccccgtnangggnangttgctgnnggcctagatnacncaactgggnttncagcntngggccaccagaggggagacttaattctttgnaagngtggntncnatgaanacnntnannattnttggtnt

SEQ ID NO: 8444 - DNA, 1678 bp, Homo sapiens
  misc_feature 3, 5, 8, 9, 13, 18, 19, 20, 21, 22, 26, 27, 28, 29, 31, 35,36, 44, 46, 50, 53, 55, 57, 58, 62, 68, 76, 78, 79, 80,81, 85, 87, 90, 96, 106, 108, 109, 110, 111, 112, 113, 114,115, 116, 117, 118, 123, 124, 125, 126, 128, 130, 132: n = A,T,C or G
  misc_feature 133, 134, 136, 138, 142, 151, 155, 157, 161, 162, 175, 177,188, 189, 191, 196, 199, 204, 206, 209, 212, 232, 235, 236,256, 261, 268, 270, 274, 277, 286, 287, 297, 301, 304, 306,309, 315, 317, 320, 321, 322, 332, 333, 341, 345, 355: n = A,T,C or G
  misc_feature 356, 358, 364, 369, 373, 378, 379, 380, 383, 388, 390, 392,394, 403, 407, 410, 411, 417, 431, 435, 442, 445, 450, 455,456, 459, 468, 469, 471, 477, 479, 485, 487, 492, 496, 502,512, 516, 520, 521, 525, 526, 527, 531, 534, 539, 545: n = A,T,C or G
  misc_feature 547, 550, 556, 557, 559, 567, 568, 570, 571, 573, 574, 582,587, 596, 597, 601, 607, 608, 614, 617, 625, 626, 630, 631,635, 638, 639, 647, 658, 666, 668, 669, 682, 685, 691, 695,697, 699, 710, 711, 714, 716, 718, 725, 726, 731, 734: n = A,T,C or G
  misc_feature 735, 738, 739, 740, 741, 743, 744, 745, 757, 765, 766, 767,769, 772, 775, 781, 783, 788, 789, 791, 807, 808, 809, 817,823, 826, 832, 834, 861, 870, 877, 883, 888, 891, 900, 906,910, 911, 913, 914, 915, 942, 956, 962, 963, 972, 973: n = A,T,C or G
  misc_feature 976, 978, 979, 983, 984, 1006, 1009, 1018, 1021, 1032, 1041,1052, 1059, 1060, 1066, 1084, 1095, 1098, 1100, 1111, 1112,1113, 1115, 1116, 1117, 1125, 1128, 1136, 1140, 1146, 1151,1170, 1177, 1179, 1180, 1186, 1203, 1208, 1213, 1218: n = A,T,C or G
acntnacnnaagnatcgnnnnncaannnncncaanntcgaagcnancacncancnannaacnaggggnggatactnannnnaacncnaanacgctngacacggaangnnnnnnnnnnnacccnnnnanantnnntntncgangcagcgaanacancnatannggtctgatatacnantacacacagcnncngccanccncacananctnatntacagctacgcgcccccctntanngaattatcaatatacgcgangtgancgtacgnanacanctnacacacccnntttttttctncaancangncgnacccantnaannnacgcggcggnnggaggggngtanatattattcnnanacatanaaatncgcntaccnnntancaccnancncnataaacacncaanaannagaccnaaatgaaatgacanttanccgaaantanccacnacacnncgnatgcaactnncntcacangnagaaanancaatnatantatcancaacactccntacnaccnnctcnnngcanatncgaanccatantnaancataanntntgactacnntnnannggttaacnacgtntagacaaannagangtctcnnaacacnaanatattctnncgtnncaantanncacccctnaacatctacangatataanannccacgacaatacnctntcatancatntncncagcacacgannganancnatgactnncgatntannttnnnnannncataaagacgcntacacatnnntnaanccnacacantntcacnnanaaccgacagatcaaannnaatgcagnatccgntcnctcaancnacgaacgacaatgctactacatacgcngagcgaccnagaaacnactaangatcnaantcggacacncacggncgtnntnnntgatagacaaaccgacacaagacgacnaacgtaaccacgancatacnnccaacacanncgnannatanncgtatctaaagacactgaatcnatncgccaatanganagcgctctgtncgagatacncactaagtaanccatacnncggagnaagacagggaaagatcgncacgggaaagncgngnatactgaaagnnncnnnactacacncgnaacgtgtnaaangtaacnacgcnatcgacctcacacgaccgncagcctntnnacacanagagaaagcgcacgcancacgngaaangacgngttcgnccaacanatnccncaaacganctgtnaaacgcanggcacaagtnccggnanatntnncgncacattacatcggntaatccncacgcnactatnaaaactnncnctcncacacnnatgngagtcaanccgcnaatancgcggcgaacaaatggcctataacannctacaanatacgcagctacatnactacgcacgtcaagcgtccgatnanaccgacanatnnntgatacacnacaccacacatnnntactnncgatnccntncagnngacangacncnngtaantagnncntncctcgcnatntntcactnnancgnagnnacnacnnanaanntgcatagacncantcaaagaggatggacacntnncnnangatanncnanagctacatcnatannnatnnntngagcnctngatatncaanctncnactcacaaacacatcnagtgncgn

SEQ ID NO: 8445 - DNA, 1424 bp, Homo sapiens
  misc_feature 9, 12, 24, 50, 53, 54, 57, 73, 86, 107, 114, 116, 119, 132,134, 137, 138, 140, 145, 151, 156, 158, 161, 171, 173, 175,179, 181, 185, 189, 197, 203, 204, 205, 210, 231, 233, 235,242, 243, 274, 275, 285, 286, 289, 290, 300, 304, 307: n = A,T,C or G
  misc_feature 312, 328, 338, 341, 348, 351, 352, 354, 365, 366, 370, 373,382, 383, 387, 388, 398, 399, 408, 411, 415, 422, 423, 430,436, 440, 442, 453, 455, 459, 462, 468, 470, 471, 472, 477,481, 487, 489, 501, 503, 505, 506, 512, 514, 517, 518: n = A,T,C or G
  misc_feature 519, 524, 527, 531, 534, 535, 536, 537, 540, 542, 543, 545,549, 550, 564, 569, 579, 582, 588, 593, 598, 600, 610, 612,616, 621, 622, 623, 626, 629, 633, 636, 642, 650, 651, 652,654, 661, 663, 668, 671, 674, 675, 680, 697, 700, 711: n = A,T,C or G
  misc_feature 713, 715, 719, 722, 724, 733, 735, 740, 744, 748, 768, 772,774, 779, 785, 787, 791, 795, 815, 816, 828, 836, 851, 860,862, 868, 870, 875, 883, 885, 903, 905, 910, 914, 915, 925,931, 938, 953, 954, 964, 975, 980, 982, 984, 986, 992: n = A,T,C or G
  misc_feature 993, 1012, 1013, 1018, 1022, 1024, 1041, 1045, 1054, 1065,1073, 1074, 1079, 1084, 1109, 1119, 1124, 1132, 1135, 1140,1145, 1161, 1162, 1167, 1169, 1171, 1176, 1181, 1191, 1199,1201, 1204, 1213, 1219, 1224, 1225, 1228, 1235, 1240: n = A,T,C or G
  misc_feature 1241, 1245, 1252, 1255, 1257, 1259, 1262, 1267, 1279, 1285,1286, 1297, 1306, 1307, 1308, 1310, 1311, 1315, 1321, 1322,1324, 1332, 1336, 1338, 1351, 1352, 1355, 1360, 1361, 1364,1366, 1368, 1369, 1370, 1375, 1382, 1397, 1405, 1412: n = A,T,C or G
gtactcgtnaanaaaccccccctnttttacccaaaaaccctttacctctnggnnttncttttttttttgtccnaatggcaaatccnccccatttcggggagttcccnccccccncnatngggtggagcggananaanntnacccnaccaantcacnanaanaggcgctctnananctcncnatantacntatatatnatcaannnccacnataccttaatactatcgacanancncactatnngaggggggggggggtatttttttttatgcannacataaaaanntgnntatcactacnctanacncttantcatacacgacatctnaatataactntancataatnaanncncataaccaatnntaanatncattttcgnngatnnttttcaaacnnaaataaatntanttanctcttannattaaanaaaganaatnanttcactcactncntgantanataaantnnntactncaanaataantntcatacaattanananntacatnanttnnntatcncanacanacnnnntantnnantatnncattatacactacnaaganatattacatntanctacancatantctgntntattctcatntnatanaaatnnnatnacnaccntanataatnatgcatannntntataacntnatatnttnctnnatacntatatacattatatacntanagatataatcntntnacanacnanatcatcatnantccgnattnaatntacacgtacacaaatcatgntacncnctacnataaancntcgntatntacataaaaacacaaatgannacacactaagtnaatcaaanattcatactcgtatntctcatgtnantacacntnctacngagactgnantacacatatacactatcncntgtanaatnngtgaaatatnataaanacgaccngattgccgagtcatnngataaatcanacactgtcaantctcncnananatgcannactactatcaacataatannataanatananccctctatatcattatncctnatatatacnctaatacattnataatgannaatanctatnacaatacattatgacaataatcaanatctacactntaacnatatcatnatnatatntatanagcacttatataatannactantntnaacanatatntctagacatnacaaactntnatnacacgatanataatntattnntanaaaatanatatnncccntgctatnatnananggntaatncttaactactcntaagannatatttatcanatactaacnnnannaatntccacnngnatctatantatncngtactaaaaaatnnatntaaannacntntnnntcatnaaagtanacaattataatacanaaacctcntaaatanttntcanaaang

SEQ ID NO: 8446 - DNA, 723 bp, Homo sapiens
  misc_feature 3, 6, 7, 25, 27, 30, 32, 35, 36, 37, 40, 45, 53, 56, 58,63, 69, 74, 77, 94, 133, 141, 592, 652, 687, 715: n = A,T,C or G
tanacnntccaaatgtgggaactgncnaancnaannngancaacntcaacggngtncntaacntaatcntaatngcntcccgagacatcgcggntggggaggagctcctgtatgactatggggaccgcagcanggcttccnttgaagcccacccggggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttcccctgcacccccgacatccagggacggggtgtgaggaaaacnctgcctccaatggcctggacgggatgtttccaagctcttgttcccctaacgtctcaacangcgctcactgaagtgtatgaatattttttaaaaanggttttgcagtaagctaatctttccctntgcttttc

SEQ ID NO: 8447 - DNA, 724 bp, Homo sapiens
  misc_feature 4, 5, 7, 8, 13, 37, 38, 43, 45, 47, 49, 54, 61, 62, 67, 74,76, 77, 80, 89, 91, 96, 97, 99, 105, 109, 111, 118, 131,658, 663, 670, 701, 708: n = A,T,C or G
tganncnntcgantcggcacgagcttcatataatgannctatnangncnaaggnaaattanncaaangttaagncnntgngtccaaggncnttcanntnaaaaanggancngggattngaacctaaagtanccataaaatccttccttttctacaccaccatggtacctcctagatgaagctgaattttgcctctaagctactagtcctcacaatttagtttacaagtcatctggggcataaaaaccagacacctagaccttatgtagagattgctacagcacaggaacaggtgtcttagcaagcatgacgtacaactaagatgtgggttaccatggaacccaatttgaaagtaatagttttacattctaaggtattccaactattttttttccttaagtttcacatcttgatagaccctctacggaatctcttctcctaaagcttgtttttacagtgatcttgccattcctggtaccatacacattatcatctggtctgtggttcacttttttttttaaatcattgaaccctccttcacctggctttttaaagccaaaagcttttctggagccccaagatcaccccactatgtacttcctcatatttaggcagtttacaaaacattcacatttggtatctctgactcttaaaacatncctgngtagaangcacaacagctattattttcattttggaggngaaaaanaccagggtacactgct

SEQ ID NO: 8448 - DNA, 761 bp, Homo sapiens
  misc_feature 2, 96, 108, 454, 614, 633, 686, 705, 729, 758: n = A,T,C or G
gntattcgttcagctcttgttctttttgcaggatcccatcgattcgaattcggcacgagagatagtctctgaatttagaactgggacgaaagtgtncataataggctnttataaaatttttagaattggatttctaaacttggggtcagtgaatctagcaggcttaagcagtgttctcaggtttttctggcacagacaaggaatataagaggaggagagaaaaggagagacagtagtggggagggaatagaatgagagaagatagaaaatatggaattaatagagaaaggatacatgaagtattacaagattttcttggaaaaattggcatttcagtgatggatcaaagatgtctaatgaggcaaaatactactattacttaaatatttaatgttttaaagatttgaggataaaaggatatagatctgatggccgttcatactaattgctgtantgttgatgttggagagaggggtaatgtatcaagacagagcagacagaccctttacaatgagagcagaagatatgttgtttactgattctactttcccacaaaatgctaatgcttttataagtccctcctccttattttctagattaactccttgttcttnctctaaacagaggattatngcagacaggccaaaaaaaagcctctagaactatagtgagtccgttttccgtanatccagacatgataagatnctttgatgagtttggacaaacccncactttgaatgccgtggaaaaaatctttnttt

SEQ ID NO: 8449 - DNA, 732 bp, Homo sapiens
  misc_feature 4, 5, 7, 8, 13, 16, 30, 31, 34, 35, 44, 45, 48, 51, 61, 65,68, 101, 113, 643, 670, 671, 682, 695, 717, 730, 731: n = A,T,C or G
ttanncnntcgantcngccgaggtcttttnnacnngtaccagcnnagnatntttttttttntganatnatttttgaatgcttttgtgtggaaccacatgcntcataatagatncaaatccatgaaagtataacagttaaatactagatcttactttttcaggttttgatttctcatctaaactttccaatgctttatcagtgaagcaaactaactcacattgactagcctgctctcctttagcaaacccttcaaataaatgcctcatttgctcctcaccactatcattttagattggccagacagttgttacttaccttttaagaatgaggagacaggtagccgggtgcggtggctcacacctgtaatcccaacactttgggaggctgaggcgggtggatcacgaggtcaggagatcaagaccatcctggctaacacggtgaaaccccgtctgtactaaaaatacaaaaaattagtcaggtgtgttggtgggcacctgtagtcccagctacttgggaggctgaggcaggagaatggcatgaacccgggaggcggagctggcagtgagctgagaccacaccactgcactccacctgggtgacagagtgagattccgtctcaaaaaaaaaaaaaaaaaaaaaacntcggccctttaaaaatttttggggggnngttttcccggnaaaccccaacttntaaaaaaaaccttttgtggagnttgggcaaaaccnnt

SEQ ID NO: 8450 - DNA, 757 bp, Homo sapiens
  misc_feature 2, 6, 478, 686, 700, 721, 736, 756: n = A,T,C or G
gntatncgttcagctcttgttctttttgcaggatcccatcgattcgaattcggcacgagaaaaatatgggctgggattacaggcgtgagccaccacacccagcctttcttttagtgctttaaatatattggccctctgccttctggcctccaagtttctggatgaaaaatctgcttgtcattttattgaggatcccttgtatgtgacaagtttcttccctcttgctactttcaggattctaactttgcatttcaaaagttagactataatgtgtctcagtgtgggtctctttgagttcattttacttggagttacttgagctgcttggatgtttatatgcatgtctttcatcaaatttgggaagttttcagccattattcttcaaacatagtcataagctgcataatgacattttggtcatcaatgaactgcatatatgatggtggcctcaaagattataatactgtatttttactgnactttttatgtttatatgtacttagatcacaaatacttaccattgtgttataattgcctaagtattaaatacagtaacatgctgtacatatttgtagccttggagcaataagttatataccatatagtttaggtatacagtagctataccatgtaggcttggtataagtactctctacgatgttcacacaatgttgaaatcacatganggatgtattctcanaacataattttggttggtaangggatgcatgactgnattctctctgcccctttctnt

SEQ ID NO: 8451 - DNA, 828 bp, Homo sapiens
  misc_feature 7, 33, 47, 60, 63, 65, 68, 69, 70, 74, 82, 96, 108, 114,120, 160, 165, 176, 191, 209, 219, 221, 225, 227, 232, 238,239, 248, 254, 265, 269, 280, 290, 293, 298, 322, 346, 372,430, 457, 486, 523, 633, 636, 647, 651, 654, 671, 695: n = A,T,C or G
  misc_feature 705, 715, 755, 761, 767, 776, 809, 814, 821, 824: n = A,T,C or G
tattatncgttcaactacttgttctttttgcangatccctcgattcnaattcggcacganggncnacnnntttntacacttngaaccccacttttntccctttgcccntttgcngtgtcnctttttgccggaacccccctttgttgcccgtttgaaaggncgttnttgttgttganacgccggttgcccanccccaaaaaaggagggtntttaaattgnanttcntnttttntgaggnntccaaggcntttggncggaaagtggntggntgccttttgtnattgaggacntcntggcntccaaggggagcggcctggcaccntctgcctgtgaactggaggcaacntggggggccgggccaccagtccacantggcaatgggtggtcctggcccggctgcaatggtcgtccaccgaagttggcctacttntcgcttaagcgccttgcccttgataanggggattgtgctctttgggggatgaaganggcaacgttgttggcttttacgacgtcagccaacatnctgaagcagcccaccccttgcttgcccggcagcccttgcaggcccccacacagatcctgaagtggccccaacccctgggcccttggccaagtggtgaaccaaaaaccatngtngaacacaagtnggtnggncaatgccttcctttaancttaaccttaaccggcccttgacnggaacttccnaacattcgtnaacccatttttggggggaagggatttttaaccctttaaanacccantttggnaaaaagggnaccaagggggacccccaagctttaactttaacntttantttcaanccntttt

SEQ ID NO: 8452 - DNA, 1197 bp, Homo sapiens
  misc_feature 5, 7, 10, 13, 14, 17, 20, 22, 24, 27, 29, 30, 35, 38, 40,42, 45, 49, 53, 54, 57, 59, 60, 66, 70, 72, 80, 81, 83,88, 97, 102, 106, 107, 108, 109, 120, 121, 123, 131, 133,134, 135, 136, 137, 138, 139, 140, 141, 142, 147, 159, 165: n = A,T,C or G
  misc_feature 174, 175, 178, 181, 184, 187, 188, 192, 194, 206, 209, 213,214, 220, 227, 237, 241, 256, 257, 258, 262, 271, 274, 276,278, 287, 298, 300, 304, 305, 309, 316, 320, 322, 328, 333,334, 342, 343, 348, 349, 351, 352, 355, 356, 357, 360: n = A,T,C or G
  misc_feature 368, 369, 371, 373, 377, 378, 379, 382, 383, 385, 388, 389,391, 393, 394, 395, 396, 397, 400, 403, 404, 405, 406, 407,408, 414, 419, 431, 435, 443, 444, 465, 468, 469, 470, 474,476, 484, 486, 490, 492, 493, 501, 505, 509, 510, 513: n = A,T,C or G
  misc_feature 514, 515, 518, 522, 523, 529, 536, 548, 550, 555, 556, 557,559, 560, 564, 565, 583, 588, 596, 597, 601, 616, 617, 627,631, 633, 640, 643, 648, 658, 659, 667, 670, 678, 681, 683,688, 689, 690, 693, 698, 705, 708, 711, 713, 715, 716: n = A,T,C or G
  misc_feature 718, 719, 722, 723, 725, 726, 727, 730, 734, 735, 742, 745,748, 751, 752, 758, 762, 766, 771, 772, 776, 778, 780, 793,796, 798, 806, 810, 811, 814, 816, 817, 818, 820, 822, 827,828, 835, 838, 840, 850, 852, 855, 859, 861, 870, 871: n = A,T,C or G
  misc_feature 874, 875, 878, 879, 883, 885, 886, 887, 889, 890, 896, 902,907, 909, 911, 918, 921, 922, 923, 924, 927, 931, 933, 937,940, 944, 949, 961, 966, 969, 971, 972, 973, 979, 986, 990,992, 995, 996, 1000, 1002, 1005, 1008, 1011, 1014: n = A,T,C or G
cgtcncncanctnngtnatnantnatntnngtganttntntnttnttcnttgnnacntnntgttgnatgntntgcgtgtnncntcatnagattttcnattangtgnnnngatctttgtgnnangtgattantnnnnnnnnnntatgngaaacccccgtntcgaantcggcacgnncantgntcntanntgtngnatgctgtctccnacntgtnnggtagnatgttgngttggggggngggntcccatacatcatannnttcntaaaattgngangntntgatggagnggttttttttncnagcnntttnaaagctnagtngnttgttnctctnntgccctgnnatagnngnnttnnnggntgtgtccnncntnggtnnnagnntnttnntntnnnnntgntannnnnnatgtanctagntcataatttgtntatnggacattnncctacttatatttaatggtgnttnnngtcnantcggattntntatntnnttctattntcantttnntannnatntccnnggacgnatccatntgtatattttcncntatgnnngnncccnnatggggctttgtcacatngactnttgtactnnaccnattgcccctataaanntttttttccncatngntttgaanggngatangacaaaaaanntggatctnctntgtgcttnatntnttgannnttnatatntcgccgnatnttntntnnanntanntnnnttnaatnntgcatanctntanttnngatgantatngtgntatgnnttgntntntattatctattcncantntttacagntctnnatntnnntntnctacnnttttttnatncntgtaatgtangnatnagtntngtctgtatnnttnntcnnattncnnntnntccctntatatntatanantnactttanccnnnnttntatngntcgnttntctntcatngtcttctattcnctttntancnnntatttnttttgcntttnanatnntaancnatnttngcnaannanaanttgntgnntnctctgatntatatgtcntcnagctatcttnnatatcgnattatgataatgtcnttacttanntanattcgncntattattnnctnacgtntgantnntntagtgngattgacnttnttttttctntnnnttancnttggtanntagtgnnnttnnatcatttnttng

SEQ ID NO: 8453 - DNA, 921 bp, Homo sapiens
  misc_feature 4, 5, 9, 12, 35, 36, 78, 87, 91, 93, 110, 119, 120, 121,136, 138, 157, 161, 187, 191, 192, 197, 198, 203, 215, 216,220, 222, 223, 226, 236, 241, 242, 244, 249, 252, 253, 258,260, 263, 265, 273, 283, 287, 288, 305, 309, 312, 314: n = A,T,C or G
  misc_feature 337, 338, 343, 345, 355, 357, 365, 373, 375, 381, 382, 384,385, 397, 406, 417, 418, 426, 430, 431, 437, 442, 448, 452,463, 469, 475, 485, 486, 488, 490, 492, 521, 524, 529, 531,534, 550, 551, 556, 558, 560, 561, 568, 570, 572, 573: n = A,T,C or G
  misc_feature 576, 580, 583, 586, 589, 593, 601, 606, 607, 614, 628, 633,636, 649, 652, 654, 669, 671, 672, 673, 675, 678, 688, 694,703, 705, 719, 721, 724, 725, 728, 745, 746, 748, 759, 769,777, 784, 786, 787, 792, 795, 796, 801, 803, 808, 809: n = A,T,C or G
  misc_feature 811, 812, 813, 817, 821, 834, 841, 845, 846, 847, 849, 858,862, 864, 865, 866, 870, 875, 878, 888, 892, 893, 897, 898,902, 907, 910, 913, 916, 920: n = A,T,C or G
aagnnaacnttnaacgagcaggcctccacggccanncagctgctcacactggacaccacctctatcctcctgcgcctntgccctgtntttntnctgcccggaacgcccgnctgctggcnnngaaggcgagggcggnangccgctgaatgggactttncggnttggaaccaacccccaaaaaaaggangggnnttgtnnaaaanaggaaaattcannattntnntgnagggcctcanaaggnntnatggnaannggagnanatngnaaatgganatagcaattntggnnaaatggagggacaatgngganggncntccaaagggggaaggcgggaccnngggcncnaattctgccntntgggaagnttggaaangnaaaaanntnngggggggggggnccgggggcnaaatccaggtnnaaaaaatnggannagtggnatggnttcctngganactgggcttgngaaaanggtaangtccaatccnnangngnggcctttatttattttgcttaaaataacnctnatccngnatntaaggggtaatttggnnatacngntnnggggaantnanncanggtnganatnatntggnttaattanataannaacttanaaaaaaaattatanaaaanaangaaatcccatatnatnanattaaacaaaataanannnanacntttgaactantaaacnataatgaantncctcaactaaaatntngannaanttgaatttatgaatcannanttcaaatatanattataattnattaattntatatanannattantannatttnantatanntnnntacntaanttataatctcttnaatttanttannnanagaaaatantaanannncatnaaatnttnattaattttnaatnnattnnctgntatantanganctntatnc

SEQ ID NO: 8454 - DNA, 870 bp, Homo sapiens
  misc_feature 2, 3, 4, 24, 44, 55, 66, 80, 82, 85, 113, 117, 118, 120,125, 130, 140, 145, 161, 162, 164, 169, 171, 175, 176, 179,180, 184, 202, 223, 235, 240, 267, 296, 308, 323, 374, 389,472, 480, 493, 538, 603, 608, 645, 652, 698, 743, 744: n = A,T,C or G
  misc_feature 748, 749, 752, 754, 773, 779, 784, 791, 807, 819, 824, 836,859, 861, 870: n = A,T,C or G
annnctcttgactcctgtctttgnggatccctcgttcgaattcngcacgagggantatcctggtgnaggggccttttttncnggncttgggggccttgggatcccgggggttncagnntnagggnccttnagtccttcanacccngcaaatattttgcgcnnangaagnanggtnngtnngtanctaagttaaacttagaancagaccctcattcagttttantaatgtattttngcaanctactgtaaatagcaaatcaatgccantgttaaacaaagaggaaacgttgtgtggncttggttctctngcaccggtatttcanggaacatctgcttgccatccccacagctctttaaaacctggctattatggngtgccctttcattcntaccatttctaatcatacctggcagggaaaaaaacattgggattcagccttaagactggagggaaaaaccttctcccatttantggttggntaaggaaaattantaggatggttttggaggaagaccacctttttttggttaaaacccnagaatatttggaacctcccagccaacctatttggggggttaataattttttaaggttcaattggntcctncaattttaaatgcctaaaatattcccttttataattngcctttnaataaattttcccttttttttccttttttttttttttttaagaccngggggtcctcgcctcttggttggcccaggccttgggaggggcaannggcnnccnanccttggcttttctggcaancctttngcctncccaggntcaagccgaattcttnctggctttcaanccttnccgaggtagctngggactacaggcgccatgccccncnatgccccan

SEQ ID NO: 8455 - DNA, 722 bp, Homo sapiens
  misc_feature 1, 9, 31, 36, 38, 43, 44, 50, 56, 636, 670, 706: n = A,T,C or G
ntttgaccncgtatggcgccgagaatagccnaattncntagannaagaancaaaanggcaatctgagtagaagaaataaggagaaaggaggagaggtgtgaaaaaaagtcctttttctgagaacaagcattcaaacagataaaacacaggtttcataaagaaaagttaaatgtcccactactatgagtcaaaatggtgcatttgctttttcctgggttttgatttattgccctctgtttgtaccccacattcgcatccttggcacagactgtcatatgtcacacattcagcctcctacacttccaccccacaatctctttaccttccttcttaatgttcacctcatttatctttactcagctaaagtcatagcactagacagtgttcccacaaccgtcttcaaactcatctgtatttcataatctctcctctagttcaaaccagcacaggtcagctgaaactctgaattctacaaataaatatttagaggaagctaacttcatcagacactcccctatgctctcagttcaaacgaaagtttctgttacatttcacctacctacagccttacctcactcagctagcattagactactcagcaatgagttccaacattgccttgctaaaaagcaaggnggctcacaaacaagacttcagcaaagatgcattnaaatgtgaagtctgcatttggtcaaggctaccttanatggagtaatcatggg

SEQ ID NO: 8456 - DNA, 1335 bp, Homo sapiens
  misc_feature 1, 6, 12, 14, 61, 62, 64, 68, 90, 92, 97, 101, 104, 110,112, 116, 117, 133, 134, 135, 137, 138, 142, 153, 154, 156,157, 164, 168, 171, 175, 182, 189, 196, 198, 204, 212, 217,221, 233, 234, 236, 238, 245, 250, 263, 264, 277, 279: n = A,T,C or G
  misc_feature 283, 284, 288, 290, 292, 295, 302, 303, 307, 309, 312, 316,317, 322, 329, 332, 341, 342, 347, 349, 353, 354, 359, 368,370, 375, 387, 390, 398, 400, 404, 406, 407, 411, 419, 422,424, 425, 427, 437, 439, 449, 455, 459, 460, 461, 469: n = A,T,C or G
  misc_feature 484, 490, 493, 495, 497, 500, 501, 511, 526, 530, 533, 544,550, 555, 556, 558, 559, 578, 583, 585, 599, 605, 611, 616,617, 618, 627, 628, 629, 632, 633, 635, 639, 641, 650, 655,656, 666, 672, 677, 685, 693, 706, 713, 734, 748, 752: n = A,T,C or G
  misc_feature 754, 756, 760, 761, 772, 773, 774, 775, 779, 788, 799, 809,810, 819, 821, 822, 833, 834, 835, 841, 852, 854, 869, 871,875, 876, 881, 909, 912, 915, 925, 937, 938, 943, 953, 955,961, 966, 969, 970, 973, 979, 987, 991, 992, 996, 997: n = A,T,C or G
  misc_feature 1006, 1015, 1016, 1020, 1021, 1043, 1047, 1055, 1058, 1068,1080, 1081, 1085, 1087, 1097, 1098, 1101, 1109, 1113, 1121,1123, 1125, 1130, 1132, 1144, 1151, 1158, 1161, 1165, 1172,1174, 1177, 1182, 1192, 1193, 1194, 1197, 1217, 1218: n = A,T,C or G
  misc_feature 1221, 1223, 1228, 1230, 1239, 1249, 1252, 1253, 1258, 1264,1266, 1271, 1276, 1277, 1280, 1281, 1284, 1285, 1294, 1301,1307, 1310, 1313, 1314, 1315, 1316, 1318, 1325, 1326, 1327,1334: n = A,T,C or G
naggcnagcccncnctatgagaccccagcaccatggacaagggaaggacacgcccattttnncnggcncaacacgacaaaacgggggggntnaaaanaacngtncccacntntctnnaaacccccagcacggnnngnnaccnaacgaaaaagnncnnaaggcantaanccnggcnggggcanaacggcncgcaacncncccccnactggctnaaagnggancaccctaaaccnngngnaaacgancgggngaaatcggcgcanncaccaaacccaangngtgnnccgngngnggncgtaaanngtananaanacannccganaaacggngcnaacctaaanngacangngcgnntggcncaccccaancnacccnagcaacccacanaanacggggcnancgcngnnaggnagaccacnctncnncntcggaacacngngcaggacccncgcgcncgannngcataggnggcacacacactacnaaaggnacncnangannggagcatcanagattacgctcgganaccnacncaccccgcggnataaanaccgnnanngaaaagcaagcgcgccacnagagnanggacactagataanaccccntcgcanacccnnnatcggaccnnnacnngncacngnggagcacangtganncccctaagangtgaangaacnctgggggngcaaaaanacaccgcgacacncaatatnggggctatctacgaaacccancggatacagcagtncaanancnagcnngaaacacacgnnnnggcnctgggaaancagcacaatcngcaaggcacnnacccgaacncnncgatatgcacnnncaaccnctctaccttanangcgccaaacgagacnanctannaaagnacaccgtgaacagggaaacaacatctgnggncantgacacactnatcgcacacaannacgtncaaggcatangnagaatncacgnagnnaanacgagnataacagngggnnaatnngacgggatncaaaaaaannggcnncgagcagtacatcaaggcacanaacntgagcaantcncgcaacacanaaggacacgcgnnaagnanatccaaatanntancggggacncccncacgtaanananagtcncnagaacgaaactntcattgngagaccnaancagntcacagnangantcttncgaccaaccnnntgnaaacacgcaccggggaaaannaanangccancncaaccaaancaagcggganacnnaaagnggcgcncnacccngatgnnacnncannaaggcaagntcacagncggaanganctnnnnanccaactnnnagccgcnc

SEQ ID NO: 8457 - DNA, 1082 bp, Homo sapiens
  misc_feature 2, 3, 4, 5, 6, 7, 8, 9, 10, 11, 12, 13, 14, 15, 16, 17, 20,21, 22, 23, 24, 25, 26, 27, 28, 29, 30, 31, 32, 33, 34,35, 36, 38, 39, 40, 41, 42, 43, 44, 45, 46, 47, 48, 50,51, 52, 53, 54, 55, 56, 57, 59, 60, 61, 62, 63, 64, 65,66: n = A,T,C or G
  misc_feature 67, 68, 69, 70, 72, 73, 75, 76, 77, 78, 79, 81, 82, 83, 84,85, 86, 87, 88, 90, 91, 92, 94, 95, 96, 99, 100, 102, 103,104, 105, 106, 107, 108, 109, 112, 113, 114, 115, 116, 117,118, 120, 121, 122, 123, 124, 125, 126, 127, 128, 129: n = A,T,C or G
  misc_feature 130, 131, 133, 134, 135, 137, 139, 140, 141, 142, 143, 144,145, 146, 147, 148, 149, 150, 151, 152, 153, 154, 155, 157,158, 159, 160, 161, 162, 163, 164, 180, 181, 189, 190, 193,194, 195, 196, 197, 198, 199, 200, 203, 205, 208, 209: n = A,T,C or G
  misc_feature 211, 212, 213, 214, 216, 220, 230, 232, 233, 234, 242, 244,245, 247, 248, 249, 264, 266, 326, 355, 364, 409, 432, 444,470, 497, 523, 528, 531, 533, 545, 553, 558, 560, 577, 583,586, 594, 607, 611, 614, 615, 621, 624, 626, 628, 629: n = A,T,C or G
  misc_feature 630, 636, 651, 653, 660, 661, 668, 669, 674, 675, 676, 678,683, 685, 686, 687, 689, 691, 692, 703, 713, 714, 715, 716,718, 721, 722, 727, 729, 733, 735, 738, 740, 741, 742, 743,747, 749, 750, 753, 754, 756, 757, 758, 765, 767, 769: n = A,T,C or G
  misc_feature 772, 777, 785, 788, 789, 790, 800, 806, 807, 812, 816, 817,824, 826, 828, 830, 832, 835, 836, 851, 853, 871, 877, 893,896, 897, 901, 910, 914, 923, 928, 929, 942, 948, 952, 954,962, 963, 975, 979, 980, 983, 985, 991, 994, 1001: n = A,T,C or G
tnnnnnnnnnnnnnnnnatnnnnnnnnnnnnnnnnnannnnnnnnnnnannnnnnnnannnnnnnnnnnntnnannnnnannnnnnnntnnnannntanntnnnnnnnntcnnnnnnnannnnnnnnnnnnannnantnnnnnnnnnnnnnnnnnannnnnnnngttttgaatcctttcnnaaacaccnncannnnnnnntananatnnannnnancccnccccactgangnnnaacccatnanngnnntgggactgggctgantntacagattgatgaggacattcaactaggatggctatgatatctgggagaccataagtganggtcttcgctcaccccgagtagatatttngcattacanttgaccccatatacaccaaggcaaaaaatggctcctgggcagcangctatggggatctggaacactgnaatccaatcagncattcaagagggcagcactggaaaanttgcttacaagggaaattcttgggttnccagcgaacttggggacccccccttnaggcnttntntaagcaaacccngggataanatcgntntaatggggctccaaatncaaccnggnattgcccntttgggcctaacnctgngcnnaaaaanggngntnnntggganttttaaatacaatgnanttcctcnnccccaanncatgnnnangggcnannnancnngaccttactcngcgaagcccnnnnantcnnttcananatgnanatnannnnacantnnctnnannnatggcantntntanagaanaaagtatntannncgttcttgcnacatcnncgganattnntttatcncntntntnaannaccccccaagaaagntnacccccttagggcttaantgggangggggttctggggggnccnntggntttacaagngggnaaccccatnaaaannggaaggcccaacngcaaanattnangctcttgnngcaaaaaccaancctnnaantncctcanaanacataannnnnngctgccgggntngnnttctntnnatcctcctntnttttnnaannatcttctctttcnattnnnnnnnctcaaatcc

SEQ ID NO: 8458 - DNA, 1687 bp, Homo sapiens
  misc_feature 4, 5, 12, 13, 16, 18, 19, 24, 27, 28, 29, 30, 36, 38, 43,45, 46, 48, 50, 51, 64, 71, 74, 79, 80, 83, 84, 85, 92,95, 99, 104, 105, 106, 111, 115, 118, 123, 128, 130, 131,132, 133, 140, 145, 146, 152, 153, 157, 169, 179, 185, 187: n = A,T,C or G
  misc_feature 191, 193, 205, 208, 210, 219, 226, 237, 240, 245, 247, 252,261, 264, 265, 266, 267, 268, 269, 271, 274, 276, 277, 279,284, 295, 298, 300, 305, 307, 317, 327, 328, 330, 335, 346,348, 358, 360, 366, 368, 371, 374, 385, 389, 396, 401: n = A,T,C or G
  misc_feature 405, 406, 413, 414, 419, 421, 425, 431, 437, 438, 439, 441,443, 451, 452, 454, 455, 457, 458, 460, 464, 465, 470, 471,473, 474, 475, 480, 481, 494, 499, 503, 506, 507, 522, 524,526, 531, 537, 544, 548, 551, 553, 559, 564, 566, 568: n = A,T,C or G
  misc_feature 572, 584, 585, 597, 598, 601, 606, 607, 610, 611, 612, 613,617, 620, 621, 623, 628, 631, 632, 635, 638, 639, 640, 646,650, 654, 659, 660, 665, 666, 668, 672, 678, 681, 689, 691,694, 697, 701, 703, 706, 710, 714, 715, 722, 725, 734: n = A,T,C or G
  misc_feature 738, 740, 742, 744, 746, 747, 749, 750, 755, 758, 771, 773,780, 792, 797, 803, 811, 821, 823, 827, 831, 844, 849, 853,857, 867, 877, 879, 883, 890, 898, 902, 906, 908, 909, 912,914, 918, 931, 935, 937, 953, 956, 966, 969, 974, 977: n = A,T,C or G
  misc_feature 980, 983, 985, 990, 995, 1009, 1014, 1018, 1022, 1025, 1027,1033, 1034, 1038, 1039, 1043, 1045, 1057, 1067, 1078, 1082,1101, 1109, 1113, 1116, 1120, 1122, 1124, 1128, 1134, 1136,1147, 1149, 1155, 1162, 1170, 1171, 1176, 1178, 1180: n = A,T,C or G
taannccccaannacnannccaantcnnnnctgatntncgaancnnangnnttttatcttacanttcaaanaanggggnnacnnnacataanctngacnttaannncgaantcgnccngaggncacancnnnncgcgcanacctnntatgcnntggnatcacactgacnaaacatactnctcacntncctncnacactctccatntcncnccactatanctctctnatctatactanatntcatncncgcgntcagacatnttnnnnnntnctnanncnctctnaactcaataanacncnctacncnctcactcatntcattaagtnngntaccnactatacactntntaccttctcncnaatacncnacntcnacatatattcngatntctacgnctatntccnntatctcnncaacnanactntcatcntcttannncntnccatctanntnncnncncgtnncatcnngnnnactannacaaacgtcacantcatnattnatnncatttcgcatgacancnantctcncctttnttcacgnacancancngtccanctacncncntacncaactaatattnnctcgctcaacanntcntaatnnatnnnntcanttnntntatcnttnnatnatnnnctaaanatgnattncttcnnagctnntncgcncgactntgncaatccancntanatnacgntnacnatcntctnnacaatgntcntctttatcncatncncncntnntnncaccnctntctcgtcatactntncccatanaatgatatatcntccanacaatntacgtgtnatcaactacncnttgnaganatgcagtataccntcgantaanatcnctcagtctcnacctgacatntnactntcacttnaattctcnacanctantnncantnaatnatacatcttactnactntnccgctaacgctctacncgngacattgtantcnctatnatnatntcncntactnactcngcatagacctcacntgtanagantctncananatgtcnngctnngtcntntgtgtaaccaanactattgctnaaactatcatntccnctctccactcactctatcncactatantccntanccanancntttnactctntntatatcatatnantacacncgcgcancgtctcgnntcttntntnntnctncanccctntcntnctnatctcttctcannnatnacataccgccatcatagcttcncactatnctncatatnttntacacgataacgcatnatctgcaacntnnncactantnantnnctnncagtnactcnncttgantcnntcacannnngacnnancatatcnttcccgannatnntctntgcntacnnnnnnattcanncttcnacntntnncactatntaccncctggacaactnnatactacnncgcnatagctnatancactcnnnctacnnatctcacntactccactgnnnnttacnaacattcnnntcatgatatatganatgccnntnctacgnatnnantannncnnctntntntcatatcncgnnaannacgcgtagcnatcttactccangtcnattncctcccaacatntntaactnatatnanctctngnctcactacgnacncnatancctcaatcnccataacacncntatccancatatccgn

SEQ ID NO: 8459 - DNA, 780 bp, Homo sapiens
  misc_feature 1, 2, 12, 15, 20, 22, 36, 54, 56, 62, 65, 68, 69, 83, 84,85, 101, 103, 115, 120, 139, 147, 153, 158, 164, 166, 169,171, 172, 179, 180, 181, 182, 184, 198, 202, 203, 204, 208,209, 210, 214, 215, 237, 238, 240, 243, 244, 254, 266: n = A,T,C or G
  misc_feature 276, 277, 289, 298, 301, 306, 308, 318, 322, 325, 326, 331,373, 374, 396, 406, 424, 427, 476, 484, 490, 551, 606, 609,612, 631, 641, 644, 661, 686, 695, 709, 722, 728, 767, 771: n = A,T,C or G
nnctaaccttgnaancccgncntttgcagacccaanaggaccccgggtaccgancncgcatncgnccnnaagggagttttttnnnaatccactggcccggngntccacagcgggngggantgggaaaacggtggcgctnccggcctngaccgncgggngggganangancnnacacacnnnntngcggacactcgaangggnnnaaannnggcnncgttggaaggaagggaaaaganngnatnnccaataggangaactggtcaangagatatcannggaaaaaaggancgaaatctnacntcttncncacaacatanggcnagnnatatncagacgattatagacctaaatgtgaaagcaagacacatcgtnncagatgataatataggagatgnctcatgactntgcattagtggaaatgtnatnaacctacacccagatgcctgtgctgatactgacatgactataatagagngggaattngccagnctgcactcaatgcctgctcatccaaccatctttaataaggcatcaccatgtgcctaccctnttaaggagcaactagaaccactaagaccaaaagagaatcctcactccttcccttnctncgntcgctcaacctcttttggntcaggtatgnggnaacttggaagcttaatntggaactactgggatatctggactngggagcccncaagatacccgaanctggggattgggncttacntggaaaacacagcatggggaaataaacaattaaaacctnaaanaaaaaccaa

SEQ ID NO: 8460 - DNA, 730 bp, Homo sapiens
  misc_feature 1, 10, 14, 16, 17, 19, 46: n = A,T,C or G
ngttttgacncctnannantcggcacgacttaaagatgcataacanagtcaggggattcattctatatgatatccaatgagtatggcattggcataaggctagacaaacagggcaggacagagggagtgaatgaacagacacacatatatttggacacttgaatgtggataaaagaggcaatgtaggaaggaagggaaaagatagtcttttcaatagaaggaactggatcaaagagatattcaatggaaaaaaagaacgaaattttacctcttcctcacaacataagtaagttaattattacagacgaattatagacctaaatgtgaaaggcaagacaacatcgtttccagatgataatataggagatgtcctcatgactttgcattagtggaaatgttataaacctacacccagatgcctgtgctgatactgacatgactttaatagtgtgggaatttgcccagtctgcactcaatgcctgtctcatccaaccatctttaataagtcatcaccatgtgcctaccctttaaggagcaactagaaccactaagaccaaaagagaatcctcactcctcccctccttcgctcgctcaacctcttttgttcagtatgtgtaacttgaagctaatttgtactactggatatctgactggagccacagatacagaatctgtattggtcttactgaaacacagcatggaattaacattaaacttaaataaaacaaac

SEQ ID NO: 8461 - DNA, 728 bp, Homo sapiens
  misc_feature 1, 9, 11, 12, 697: n = A,T,C or G
ngttgaccncnntcgattcggcacgaggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttcagataaaaaaggaagtccagtaaattctttgtttgtggctcctgctgttacaccagtgaagagtgttttagaaaaacagaccaacaatnctggtatcagactggttcagtatgatcctcg

SEQ ID NO: 8462 - DNA, 728 bp, Homo sapiens
  misc_feature 17: n = A,T,C or G
ctttgacccctttcgantcggcacgaggtgaaagcggggcctcacgatccttctgaccttttgggttttaagcaggaggtgtcagaaaagttaccacaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatgggtaccacttggttttggagcaaaaaaaaccgcttaaatagac

SEQ ID NO: 8463 - DNA, 1109 bp, Homo sapiens
  misc_feature 2, 4, 7, 12, 15, 16, 19, 23, 24, 28, 29, 34, 40, 47, 51,54, 63, 65, 67, 71, 76, 79, 83, 85, 86, 88, 93, 95, 97,101, 102, 104, 107, 109, 113, 122, 127, 128, 129, 133, 134,135, 138, 168, 176, 182, 184, 195, 203, 204, 208, 210, 211: n = A,T,C or G
  misc_feature 223, 238, 239, 243, 250, 257, 259, 263, 264, 270, 271, 277,282, 283, 284, 288, 297, 298, 306, 307, 309, 311, 315, 317,318, 320, 321, 347, 349, 350, 353, 355, 357, 358, 360, 365,366, 378, 387, 404, 408, 410, 414, 422, 428, 431, 433: n = A,T,C or G
  misc_feature 438, 441, 446, 447, 456, 457, 460, 474, 475, 476, 479, 480,481, 482, 497, 498, 504, 505, 513, 517, 523, 531, 534, 535,536, 542, 548, 555, 561, 565, 568, 569, 575, 591, 597, 602,606, 607, 608, 610, 615, 636, 637, 643, 644, 648, 652: n = A,T,C or G
  misc_feature 653, 666, 673, 674, 675, 678, 679, 680, 690, 697, 712, 727,737, 749, 760, 771, 773, 774, 777, 781, 783, 792, 798, 802,804, 827, 828, 829, 833, 838, 844, 859, 860, 866, 868, 871,884, 887, 915, 918, 926, 927, 931, 933, 936, 938, 946: n = A,T,C or G
  misc_feature 956, 965, 967, 972, 974, 976, 979, 981, 982, 988, 993, 996,1009, 1010, 1011, 1013, 1014, 1017, 1032, 1047, 1053, 1055,1062, 1063, 1065, 1067, 1072, 1074, 1079, 1088, 1094, 1099,1108: n = A,T,C or G
cngngcntgagnggnnggntatnngtanntaacnatgatngttaganatanctncgttgttcncnanctgnagtanctngacncnntntatcngncntgtnnanagntngaangtagggganagtcnnnccannnganttgaaccccgtatcgtagggtgtaccccanacagccancatatncnttcaaatacanggaatatnngtgngnnttaaaaaatatnaaaccatcattgttnntgtnacacaangggaggngngtgnntacatnngaaaanaaaannncttntggaaaacnnaggaaacnntngngggnannannagactttttgcatgattagttatttncnnagncntnngnaaaannagggaacttatnttaaacctnggaggtgtaggctgcgntgcnantcantttttacnctcacnagngnagggngcnccaanntgggggtgnnaanttgttaacccgggnnntgnnnntaataaacgagaagnnctgtanntttctccnaganataccngggtgggnaannncgatanatgtgnaccaatnggaagnctanttnnacttcnctagcccgtggctatncttggngaaancgannncncttcnatgaactatcccccaaatgcnngtcttnntctngagnnatttggggataangagtttnnnaannnaaaattattngcgggtntagggggcttcgggnaaagtggggagggcntgatcggttnagggttggagangggactaaaanggggggcgggnannganaatnanccttgggtnctcttntgancnctggggggggaatggcaaaaaannnggtngagcncagaantggccgccttggggnngggggncnagncttggaatcccantcntagtggccgggggttctgacccaaaaanccntcctgaanncggnanggntntctaccanatgggggggngataaatanangcccncngnggnanncccaanttttnggnggaaagggggatnnntnnaantctcttttgggggancccccagaaaagggncttggngnaaggaanncncncctananaactngggagaaanatgttncttancgcccctgnt

SEQ ID NO: 8464 - DNA, 754 bp, Homo sapiens
  misc_feature 6, 8, 9, 73, 74, 76, 77, 78, 80, 85, 86, 95, 98, 100, 102,107, 109, 118, 120, 121, 134, 138, 142, 165, 609, 651, 715,716, 717, 718, 719, 720, 721, 722, 723, 724, 725, 726, 727,728, 729, 730, 731, 732, 733, 734, 735, 736: n = A,T,C or G
attatncnntcagctcttgttctttttgcaggatcccatcgattcgaattcggcacgaggaagcacacctttnncnnncnccccnngagggccgnggnancntgaantntggcttttntnntgtaaagattgancttntgantcggctacagtctcaaagggcantgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggcttgtgggangagggaggaaagatgaaaaacccttaaatgtgaaggaacacngcacaagaccagtatgatttccaaggtaataaatgctgtttatgacttctttaaaaaaaaaaannnnnnnnnnnnnnnnnnnnnnaaaaaaaaaaaactccct

SEQ ID NO: 8465 - DNA, 733 bp, Homo sapiens
  misc_feature 1, 7, 13, 18, 29, 680, 681, 682, 683, 685, 686, 687, 688,689, 690, 691, 692, 693, 694, 695, 696, 697, 698, 699, 718,727: n = A,T,C or G
ntttaanccccgntcgantcggcacgagnttgaggatctcgaccttgtccttccagcaggtgctcccaagccacctctgggcctgagaataggcatcacatgactctgtttaatcctccgacacagcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctccttcccaacttctgtcccaccttgaaggctgaggcacttctttttcaagatgccaattaaagagcacttttatgagtcaaaaannnnannnnnnnnnnnnnnnccccggcccttttaaaaanttaaggggngggctt

SEQ ID NO: 8466 - DNA, 765 bp, Homo sapiens
  misc_feature 4, 9, 19, 88, 92, 103, 105, 107, 123, 127, 129, 130, 132,139, 141, 144, 154, 171, 173, 240, 724, 765: n = A,T,C or G
gatngatcntttgcaactnccgttctttttgcaggatcccatcgattcgaattcggcacgaggtttgaaatgaatgccatattaaatntttncttttttcctngncntatgggggttaatttnaaancnncngggcctnancgngttttttaanctttggtagtaaatgancntttgaaatccattttgataaacctgctgttaatgttttttccccccttgtgaatgttttctaacttntcttggtaattgcaatttaactaggtgcggtggctactaaagttcgaaggcacgatatgcgtgtccatccttaccaaaggattgtgaccgcagaccgagccgccaccggcactaacctatgaccttctgacctctgaactcttcacccaatgatgacctgaccatgcctgcctgctgatcaagttaactggtaatcgcctttgcttgcctgtcgtcagtgcagcgagctgaggcacttgtcccgttcgtcttaccatctaaccaaacaaaagacaaagaaattgttgtcctccaactcagctttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatgggccttaactactcaatgacagangcaggttactggggagaaaacttctaggaatctttttcttn

SEQ ID NO: 8467 - DNA, 732 bp, Homo sapiens
  misc_feature 1, 11, 18, 671, 732: n = A,T,C or G
ntttaaacctngatcgantcggcacgagtagaagaaacacacagaacaagcagcctgacatgtaacagagcaggaaagcccccccatgtccacctctacctcattttgtcaagtcttcaagagacctccaggcccagtcactgtgaattcattcctctgggtttaggcactcacctccccgccaccccagagaggtagcatattaaatcattaacagaatctaatataaaggggccctgtgattactgggaacaagttctcctgatttatatgcgattgaaccatattccctggagtaggtcctttagagctataagcccttgccatgatcagcccccagcatcttctctcttactcctctacaggggacttaggaaaacattttctgagtcttacccaactttagcttctgctattgctactttttgatgctgtgcaagcacctgttgactcagtggttctcacccttcttggagtcacagacccttataagaatctgactgaagccatggatcctttcttgataaaaataaatacacacttaacatttttcgtacaatttcaaggagtttatagacacacttctaaactcagtcatggatacaggttgagcaatgtgtaatgagttgcagtcaaaaactacacaaaattggtacttttttaattttcanaaagggggtcttgctctgtagtccacctgggagtgcactgggtgtaatcataactcaccgn

SEQ ID NO: 8468 - DNA, 982 bp, Homo sapiens
  misc_feature 1, 6, 12, 58, 63, 79, 83, 89, 90, 100, 102, 104, 105, 106,122, 128, 133, 137, 147, 150, 163, 169, 173, 176, 184, 188,195, 202, 212, 214, 217, 256, 259, 261, 272, 364, 408, 440,445, 464, 467, 477, 494, 496, 558, 577, 591, 603, 611: n = A,T,C or G
  misc_feature 623, 654, 658, 676, 678, 684, 704, 716, 720, 728, 739, 762,773, 790, 813, 831, 839, 856, 872, 875, 887, 891, 898, 913,915, 924, 933, 953, 954, 955, 956, 957, 958, 959, 960, 961,962, 963, 964, 965, 966, 967, 968, 969, 970, 971, 972: n = A,T,C or G
  misc_feature 973, 974, 975, 976, 977, 978, 979: n = A,T,C or G
nttatncttcanctcttgtcttttgcaggatccctcgattcgagagtgagaacccctntgctncaaaaaattgaaaaancctnttgggnnttgggccccntntnnnttgaaccacttgttgnaaaaantgacntggnaggttggttngancccagaaggccanggttgnaggnagntgtggtcncccnattgcantttaccntgggtgacanancanaaccccttttcaaaaaaaaccggccggccgtgggggttnacncntgtcttccaancattttggaaggttgaggcggttggatcacaaggtcaggaaatcgaaaccttcctgctaacatgatgaaaaccccgtcttctactaaaagtncaaaaaaaataacttgggtgttggtggccggccgccttgtagtncccacttacttcaaggaaggcttgaaggccanggaanaaatgggccgttgaaaccnccngggaaggccnggaaaccttttgccaantngaagcccaaaagaatccggtggccccactttggcacctttcccaagccccttgggggcccgnaacaaggaaacccaaaggnaacccccccatttntttcaaaaaaancccaaaanccaaaaaaaacnttggtgggaattggaattaaaaaaaaaaagnccgnccccatttaaaaaaccancnttaaanttatttccaaaaaaccccanttggccttaacnttcnttggtccnttttaaaaaantttttttccaaaaaattaagccntttttggccanccccttggaaaaatttnccaaaaaaattttaaagtttttnggggaaaaaaaaccaagntttttttnaaccttggtggtttgcntcaccaaagccttaanttnaacttggtattnaagnttcttgnccttgttgaaaaggntnaaaaaaatnaaagttcantttttgggaaaaaaaaaaannnnnnnnnnnnnnnnnnnnnnnnnnnttt

SEQ ID NO: 8469 - DNA, 1738 bp, Homo sapiens
  misc_feature 5, 7, 9, 11, 12, 15, 17, 23, 28, 35, 39, 41, 46, 47, 50,52, 62, 63, 65, 76, 78, 80, 81, 85, 86, 88, 89, 90, 92,93, 94, 96, 98, 103, 109, 111, 112, 117, 120, 121, 122,129, 130, 131, 132, 140, 144, 146, 147, 155, 156, 159, 166,170: n = A,T,C or G
  misc_feature 177, 183, 186, 187, 189, 192, 199, 202, 203, 211, 215, 217,221, 223, 232, 248, 249, 254, 255, 257, 262, 263, 264, 269,271, 281, 284, 288, 290, 297, 298, 305, 307, 314, 321, 325,333, 334, 337, 340, 346, 351, 362, 363, 365, 373, 377: n = A,T,C or G
  misc_feature 379, 380, 382, 383, 386, 387, 388, 389, 390, 391, 398, 399,400, 404, 406, 407, 414, 418, 419, 420, 422, 426, 427, 428,429, 430, 436, 443, 446, 448, 452, 461, 465, 468, 469, 476,477, 478, 481, 483, 485, 486, 489, 492, 493, 494, 495: n = A,T,C or G
  misc_feature 499, 500, 504, 508, 514, 517, 521, 524, 533, 534, 536, 537,540, 542, 544, 545, 547, 549, 553, 554, 558, 561, 562, 570,571, 580, 583, 584, 587, 590, 597, 603, 607, 608, 610, 617,618, 619, 624, 627, 633, 635, 636, 639, 640, 641, 643: n = A,T,C or G
  misc_feature 644, 645, 647, 648, 649, 660, 661, 666, 670, 673, 674, 676,677, 678, 682, 686, 687, 693, 694, 697, 708, 712, 714, 716,727, 729, 733, 736, 738, 740, 743, 744, 746, 749, 752, 753,754, 755, 757, 759, 762, 763, 764, 765, 768, 770, 772: n = A,T,C or G
  misc_feature 773, 778, 781, 784, 786, 795, 800, 805, 807, 810, 812, 815,816, 824, 835, 840, 841, 857, 859, 870, 873, 874, 875, 885,892, 905, 912, 913, 916, 920, 923, 934, 936, 947, 948, 957,959, 963, 964, 967, 971, 976, 978, 980, 986, 987, 988: n = A,T,C or G
aaacncngnanncgngntggcgnggaanaaaacantgtngnaaacnngananacgtacggannanatctcgcaaanantnngagnnannngnnnanangaatnaatcanannttggntgnnntggactnnnngagcgacntgangnngatgtccnncgnatagtcncgcngcgtggncagcgngannanagnaacatgngtnnccgcgccncccncncgcncngtttttaanaaacccctcggaaaanngggcnncnccagnnngaaanangcggatatcnagncacngngctgcanngacccgngngtacggngggatcngctnagagtggnnggnggngagggngaaantttttttctcnnanaccgtccnaagnannannacnnnnnncgggggnnntatngnnacaacantcannnanccannnnnttttgncgcgatnganangagnaacggaccnactnctnncatcccnnnaancngnntgnatnnnngggnnagtngtanaagagnganactngangagacaganngnnacngncnnantnaagnntggntgnncggcgganngcgtgaggncannctnggnattcgcntacacnaaanntnatagagnnngatgntgnagaaantnnctnnnannngnnngcgtataaganngcggngaantcnngnnnagcntgcnncgtcgnnacngactgcggcgncgtncngntacatcctatnanctgncgnancngcnnancangcnnnngngncgnnnncgntntnntatanggngantnggaggactngcgcngactnancgnanctnnacgcaggngatcgacagancacanngagcgagcacgcacangngacatagtgcntcnnngtacgtagtntggacancagatcacgagcncgtcacnnacncgtncanacatgagctcngngggcacgtggnnatcgtagangngcannganagcntacgngngngggagnnngananatnncgnatgtncganacnnagnanagttntcatgcacatcgagtgangaanncgataangnaangncgatcgcntgtagaagttcncacanggtntngcncgacntangtcgagangtacagaagagnaacgntnatncngnngtaatgngcgcncagacgcgnnaatanagcagacgctcgcggatttntacangggngaantgtcangantcagangaagtgtcggagatgcncnaanatagacatgcnaagtacgatagcggncgcacgggaggancnnantgggatgncagantaaggaagtgananacgcgctcgtacacacgnncttagannaccgtnncncantncanacttgantgtgagancgcnctgatgatanncncgcggnnanaacggagcngagtangannancgcgaatnngntgcngaatanacgcagatgatacagatnncncacgngagagtnnanagacnggcgnactcanatcggagacnctgcnnancnngaacatgtacgncgctncacaccacngtcagngcncgcannntgtancgctgnagtncgcgncatcgcnacgcgatacgagcgtaacnnatgcagctgcggcgtgtntatgagatatntgnnngngacannngnacngantnngattcatggngacgtacggacactggnngggggacgannctgaagagtncncngtnaananctangcgcncgcacgggngcncaacgcgn

SEQ ID NO: 8470 - DNA, 735 bp, Homo sapiens
  misc_feature 1, 5, 12, 651, 681, 692, 729, 735: n = A,T,C or G
ntttnacccctntcgaatcggcctctctagatcttccccaggccactccttcacactccttactagcagcccctgcttacctccacactacggcctggtgacctggtccatggtgctcgccctggtgcttgaagcctggcaagccccagggctgtccttcgcagctgcttcaggtgctctgtcccacccatcaggcctttcttttggcctggctgtcaacgtgtttcccttccttgattaaatggtgttcaggcttcatgtccttcctcccgcagggagccttccctgatttcccacactctggcccctcacctggttttgagctcatgaggcaggtgaggttggatggccctcatctctctgcacacagggcctcttctaggggagactgagccccaggacaggggcaggggctccttatttctgagggccctgctaggtctttcctcctctggccccagcagaacacagcccagcccacttccacccttcttcacatgtaggtgggcctggggcgtgcctgagtggtctggttggtgtactccaggagcaggttctgagtaaacaccatctctctctctccactcgcactctgctgaatgtccaccccaagcaagtgtcttggtcagctgggagcttctgataggagancagcttcagggagagtgaaaaaggacaccnttcaccctgancaagatgtgggacattggtgtcaacttccggctgcanaagggn

SEQ ID NO: 8471 - DNA, 1111 bp, Homo sapiens
  misc_feature 5, 9, 12, 15, 16, 17, 22, 28, 34, 41, 49, 59, 61, 77, 81,82, 85, 89, 90, 94, 96, 102, 105, 112, 113, 114, 126, 130,133, 134, 156, 160, 170, 173, 177, 181, 182, 183, 184, 191,193, 204, 208, 210, 214, 233, 236, 252, 254, 255, 256: n = A,T,C or G
  misc_feature 264, 268, 272, 273, 278, 283, 298, 301, 303, 322, 324, 328,336, 339, 346, 347, 348, 358, 361, 363, 370, 373, 375, 378,379, 382, 390, 392, 398, 403, 404, 408, 416, 426, 427, 429,431, 439, 440, 443, 452, 458, 465, 466, 467, 469, 472: n = A,T,C or G
  misc_feature 475, 482, 490, 491, 494, 495, 497, 498, 499, 501, 509, 510,511, 521, 528, 530, 537, 538, 541, 552, 554, 556, 558, 573,577, 578, 581, 584, 586, 592, 595, 597, 598, 605, 611, 620,621, 625, 629, 653, 654, 668, 671, 674, 699, 706, 707: n = A,T,C or G
  misc_feature 710, 712, 714, 723, 724, 725, 728, 730, 749, 750, 754, 759,761, 772, 779, 783, 794, 797, 804, 806, 809, 810, 813, 818,821, 822, 823, 826, 837, 838, 851, 852, 853, 854, 863, 871,872, 873, 876, 888, 890, 897, 905, 909, 910, 912, 915: n = A,T,C or G
  misc_feature 927, 933, 935, 946, 951, 952, 960, 963, 967, 968, 972, 975,976, 979, 980, 988, 992, 999, 1003, 1006, 1018, 1023, 1024,1029, 1041, 1044, 1050, 1076, 1077, 1078, 1079, 1090, 1091,1097, 1099: n = A,T,C or G
cgganctgnccncannncccanaagccncgggcnggccccnggcggggncgacctccanangggagcccccccttgngttnnccnaccnncaangncagaanccnacggcgnnntttttttatcancaanaannacccaacccaccgggggggggnttanttaaaaaaanccnaaancccnnnntaacccnancacccgccccnacancncaanaaaagagacaccacaccgnaanaaccacaaagggagancnnnaccagacnccanaacnnaaaanacacnccacacacaaatagnaanancaccccgcccaaaaaacgncngaanaaaacacnccnacacagnnnaaagcaccanaanancaacagnacnanggnnaangccaccancntcaacnacccnnaccnaaaaaaanaccaaacaanntncnaaaatagnncanacaccccancgaacnaaaccannnancancgnccacganaaaccaannaannannnanacacaagnnncagcacgganaccaccnangagcgtnnaanaaggacacaananangncccgagaaacaacangggnnacnaananctcgantgngnngaaaccngaaaantaccccaannaacngganccccgtaaaacaaccaaacagacnngcggcccaaaaacncanggnaagagcattacaaacacaacaaacncagaccnnagnananacaacaaannnacnantacacgaaactgcacaccnnaagnacaantnacatacaccancgaaccnctcnagaaagcactnatnacggacnanacnnganatcanccnnnaangcactacacannaacatgcagagcnnnnaacacatancacaacannngcnctcacaaaatanancacaacnacagccancaanngncanaacacaccgaancggagntngcccataccangcaannccacacanaanacanngagnacnnccnntacacganacanaccccanaacnaancccgataaaaangcgtnnacaanccaaaacacacntanacgcgnacgagccgacacacaaagacgacaannnncaccaagcgannaccacngnaaaacgcgcccg

SEQ ID NO: 8472 - DNA, 771 bp, Homo sapiens
  misc_feature 4, 17, 25, 26, 27, 28, 48, 59, 80, 81, 90, 97, 101, 107,108, 112, 115, 117, 120, 122, 124, 588, 655, 695, 735, 764,770, 771: n = A,T,C or G
gacnactccgttacagnctcctggnnnntttgcaggagcccatcgatncgctatagtgngccctctgaaatggacctcannggaaaattngtttggngttncattanngctnttncnccngntngacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaaattcttgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaaggttcagaattcatgtgaaatcttctttggggcaaaagtccttcattcctggtatttattggattgggaaatctgtagcaaagatgctgnttaaaaataccatattgggttttttatcttatccttagctctctggctattgacttccttttcttgnttgaagttagcttcaaatttgctctatgctaaatacctgnaaaatattctgggatagggaactacttgaaatagtaattnggtaaaaagatatgaccaaaatgaaaatncttaann

SEQ ID NO: 8473 - DNA, 730 bp, Homo sapiens
  misc_feature 6, 12, 16, 23, 25, 26, 28, 37, 39, 40, 43, 70, 83, 92, 109,125, 129, 132, 133, 134, 137, 138, 139, 140, 143, 144, 145,146, 155, 156, 160, 165, 169, 170, 175, 176, 190, 197, 200,206, 211, 214, 230, 240, 245, 253, 267, 269, 270, 301: n = A,T,C or G
  misc_feature 309, 311, 317, 324, 325, 339, 346, 350, 357, 358, 363, 365,367, 370, 376, 406, 408, 419, 420, 426, 430, 433, 434, 442,451, 465, 468, 478, 480, 481, 483, 542, 543, 558, 562, 580,589, 592, 601, 607, 610, 618, 620, 637, 641, 645, 648: n = A,T,C or G
  misc_feature 663, 671, 676, 686, 702, 713, 726, 730: n = A,T,C or G
tttaanccccgntcgngacattngnnancgcgtctgntnnaancactactacgcttgtggttgcacacangacgaaaagtganaatgcattngcatgacacagcattcntaggtccggcactttngttnctnnnccnnnnttnnnncagctgtanngatnaatanatcnnccttnngatagccctggtgncctctgnctnctgatntgatncgntactgtgtcagtgtangcaatcagancgcgnctcacctncacatacatgtttncnnaatcaaggtctctacagctcatcctaatcancattaatnangtaatnggctatnncgaacataatgttntctgcangaangaaagtnncatantnanganaatggnggtggataagaacagatataatgaataacngncacagctgtannactttnattntgnnttattgcnaacacgccntaactatcctgtgnganaatgggaatntnnantcccatcttgcaattgctatgttgcatgcagggttaggggcctgaaagcatgcaagaanngaatgccatgtgatngggnttatcctggattcacaanaatactgtnatngcgagccanatcccncantggttgananttctaatgtcgactgtntgcnggcncanaacatgattgctttntaattctnacaanaggctggccngtaagtacattcttgnctagagtcttntgcacactttctntacn

SEQ ID NO: 8474 - DNA, 727 bp, Homo sapiens
  misc_feature 1, 9, 12, 572, 665: n = A,T,C or G
nttaaaccntgntcgaattcggcacgaggccttttgttgtgaagttgctcatcatttaggagtgtttaattctaaaaagccttcagcctaagaaagcttcatctgtggggaccagagacttgttgctcagggagttagtgatgggacttgggcatctgatctgcaggtgacaagtttagttcaactgaagttgtagggaatttagacagttgcacatcattgccgttctaggggccttgtagaaagatgaaacagttgtttttcatttaccagcacctctcagttatagaggtaatggaacattcgcttacttttcatcatcattctttaaaaagggaacatacaaaaatctaaactatggcaataatttatttttataatagtttacggtaggctttaattaaatggcaaactcctctgggacccctaagttatggcgtgattagccaaatttgatttccaacagtcatttatggccataactattgcatagagtgcaggatgccagcaaagatgagggtgggggcagatactggctcagtgatttaactcacattatagatgaccccttnctcaacagaaatgctactgagagaaccagaaaagcctgggccaggcaggtcttatttgagaggagattatttgataattgctttggttagaangactttacatttcctgatttcaagtccaccaccaatttagaaagttcagagatgaaacccct

SEQ ID NO: 8475 - DNA, 962 bp, Homo sapiens
  misc_feature 4, 5, 6, 7, 8, 9, 10, 11, 13, 14, 15, 16, 17, 18, 19, 20,21, 22, 23, 24, 25, 26, 27, 28, 29, 30, 31, 33, 34, 37,38, 39, 40, 41, 42, 44, 45, 46, 47, 48, 55, 56, 57, 59,61, 62, 63, 64, 65, 66, 67, 68, 69, 70, 71, 72, 73, 74,76, 77: n = A,T,C or G
  misc_feature 78, 79, 80, 81, 85, 86, 87, 88, 89, 91, 93, 95, 97, 98, 99,100, 101, 102, 103, 104, 105, 106, 107, 108, 113, 118, 119,120, 121, 122, 126, 128, 129, 130, 131, 132, 133, 134, 135,136, 137, 138, 139, 140, 141, 142, 143, 144, 145, 146: n = A,T,C or G
  misc_feature 147, 148, 151, 153, 156, 161, 171, 197, 198, 208, 217, 221,225, 231, 235, 237, 239, 240, 241, 242, 252, 255, 258, 259,260, 268, 272, 273, 274, 276, 278, 279, 283, 284, 285, 289,290, 291, 306, 307, 308, 311, 312, 314, 315, 317, 321: n = A,T,C or G
  misc_feature 323, 328, 332, 333, 335, 339, 340, 341, 342, 343, 345, 347,349, 351, 353, 354, 356, 358, 362, 363, 364, 367, 371, 372,373, 375, 377, 378, 402, 411, 413, 414, 415, 416, 421, 426,427, 429, 431, 435, 436, 438, 444, 446, 452, 453, 458: n = A,T,C or G
  misc_feature 463, 464, 467, 471, 472, 474, 476, 479, 483, 489, 490, 501,504, 512, 513, 514, 515, 516, 520, 521, 522, 524, 529, 530,533, 534, 535, 539, 545, 546, 553, 555, 556, 562, 563, 567,575, 578, 581, 584, 585, 589, 592, 597, 598, 599, 604: n = A,T,C or G
  misc_feature 608, 612, 613, 614, 617, 623, 625, 626, 633, 637, 639, 641,642, 644, 650, 652, 653, 654, 657, 659, 660, 663, 670, 675,678, 680, 682, 684, 686, 687, 691, 693, 694, 695, 696, 699,701, 704, 705, 706, 708, 709, 713, 715, 719, 720, 721: n = A,T,C or G
atgnnnnnnnngnnnnnnnnnnnnnnnnnnngnnggnnnnnngnnnnnggggggnnntngnnnnnnnnnnnnnngnnnnnngggnnnnngngngngnnnnnnnnnnnngcctnggggnnnnnatanannnnnnnnnnnnnnnnnnnnnggngntgnaaaancccctttttncccaagaacctcccccttgggggggnnctattttttntattatttngggncacncccccnattncngnnnnccccgccganacnaannngggatggntatnnntngnngtgnnngaannnagagggagatgtgcnnntcnnanntntttntnttttnggtnngntagnnnnntngntncnanntngntcannnatnggtnnnananngggggggggggggggggttttttntcttttaanannnnattgntgctnntntntttnntnaacccncntctacnnttcangcggnnatnggcnnantntcngatnggggtnngtatagaagtnggnctgttttnnnnngatnnncntattnnggnnntagnggcagnngttatgngnngtgttnntggntgtggacnttngtncanntatnttntttannntttcntttntatnnnatnatgagngnnggtgtgntttngnanntnatgagngnnntanannttngtcgctnggggnatntntntngnnaggntnnnnatntnttnnntnnttgntntttnnngatgtttgtnanntnngnncnnntataannngtgactngtattntgnnnnttggtnnctcncttncnnagggtnntnntngagagtggtatanggnnatntannngagttantngnngnngtntnnctangtanngacngngnaannngntgnggnggggnnnaaanaaggnggggggnggggntatgntannaaangntgtntaacanntttnctatggggggggganggagnnttnatn

SEQ ID NO: 8476 - DNA, 909 bp, Homo sapiens
  misc_feature 2, 4, 5, 6, 11, 13, 17, 18, 20, 22, 24, 25, 26, 35, 43, 45,52, 53, 54, 56, 57, 60, 70, 73, 81, 84, 87, 95, 96, 104,108, 109, 110, 112, 114, 115, 116, 117, 118, 119, 120, 121,122, 123, 124, 133, 136, 139, 150, 154, 157, 165, 166: n = A,T,C or G
  misc_feature 177, 179, 207, 225, 240, 253, 336, 440, 467, 490, 515, 521,552, 562, 571, 574, 591, 596, 612, 619, 643, 649, 675, 705,713, 718, 727, 730, 746, 747, 760, 767, 771, 772, 774, 777,787, 789, 801, 804, 820, 823, 825, 829, 831, 838, 841: n = A,T,C or G
  misc_feature 845, 871, 872, 897, 900, 902, 904: n = A,T,C or G
tntnnntcgcntntctnnantnannnataattatntttttttntntttacgnnntnntgnataaccgtcntgnaactgtanttntgnttgtccannatcagganatannncncnnnnnnnnnnngaacccttngantangcccacgtacnatanctngtcttaannacaaatttatnantaatatgggtgcacaaagaaggctttantggcttcaagaggtatgngaccgctgccgaggnctttgagcttgangccaagatcgcagttgttgaaaagtataacatcaggattccagagctggtgcaaaggatagaaaaatgccatatagaagattnggactttgcagagtacattctgggcactgtgcacaaagccaaaggcctggagtttgacactgtgcatgtttttggatgatttgtgaaagtgccttgtgcccggnataacctgccccacttccgcacttcanagttgagtcattttctgaggatnaatggaatttactgtatgttgcagnaactcngagccaagaagcgtcttatcatgaccaaatnatttggaaancattttganttnggcttggggagtacttnttgcnagcagagcttgactancaccgtnttaaaaacaggcgtgggttgcgcntgctgngtgggacaatgcaacaatgccatccntgttgacaccgtcctttaccattgaagaanctgccccntctcntttagccancanggaaagggaaaacaanngggggggcttacnttatggntcanntnctngagccgggangnaagctgccattntgnggccccctgggcgttnccntnacanantctttcnccngaanccatggtggccctcccctagggtaannggccaactggtggggagtaaacatnttntntncttcg

SEQ ID NO: 8477 - DNA, 756 bp, Homo sapiens
  misc_feature 6, 9, 12, 13, 17, 20, 24, 26, 31, 54, 56, 60, 74, 85, 86,94, 96, 98, 100, 103, 111, 122, 131, 132, 143, 168, 175,176, 178, 180, 182, 186, 202, 212, 730, 744, 748, 755, 756: n = A,T,C or G
attatncgntcnncgcntgntgcntntgcangatcccatcgattcgcagacagncnaacngaccttttgggttnatgggaccggnnttgtattntngngntancccatttnaagggggcacntccaacggnnatgcccacccnacgggacggccttaattatgacgangtcccgnncntnancggntcgtgggaaccggaanacggctttcntgcttcctgcagcaaaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctctcgggctcaactcgcaggtacggcatcttcttctgtaagattctagaccaccttcaagtcacattgctccaacagagttttgcaacttgtagtaaatgggactcatcaaaggcaaagcataatgtgtttttttttctcaactagaatataatttgcagcctgactaccaaggaactgatgagatatttctaacgagctcatggtttatctgaaccactgtgttctttgcccacatctggctctctttctgtcttgggaaaattcccagtgaaaatttgtgaattatgtcaactaaaggcagagaanttaaaaaagaaacnggtnataaaann

SEQ ID NO: 8478 - DNA, 726 bp, Homo sapiens
  misc_feature 7, 10, 15, 126, 633, 659, 687, 709: n = A,T,C or G
tgaaccncgntcgantcggcacgacaggaataatgctgacatacatacatatatatatatatatgaagagagagagagagtcacacacagacagacagacacacggagtctcgctgtgtcgcccangctggagtgcagtggcgcaatctcagctcactgcaagccctgcctcctgggttcacactattctcctgcctcagcctcccaagaagctgggactgtaggcgcccgccaccatgcccggctaattctttgtatgtttagtagagacggggtttcaccgtgttagacaggatggtcttgatctcctgacctcatgatctgcctgcctgggcctcccaaagtgctgggattataggcgtgagccaccacacctggccataatgctgatattttagttcagggtcatgcagtcaacattacagatgttgtgaaggactacatgttcatttgtccaaattgtccctttaaaataaggagattacaaacaaatatttgaagctctttgaggaggggcttttcagatttaaagtgataaaccttattagtctctctttaggcagagaactgaagatacatgtatatctcaaacttgtgagtgaaattctctttcagactttaacattgaaaagntaatttctaattctttctcatatatncatgggcattggtaatgatgtgccgaanatgtcctgtaactttgagaaanggagaaaattatatgat

SEQ ID NO: 8479 - DNA, 856 bp, Homo sapiens
  misc_feature 44, 351, 531, 594, 605, 632, 636, 661, 677, 687, 718, 738,740, 741, 758, 761, 782, 785, 787, 795, 797, 822, 825, 831,834, 855: n = A,T,C or G
tactatccgttcagctcttgttcttttgctgatcccatcgttcncttcggcacgaggagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcangttgagctatcactatggcaaaaaacataaatattatctcatttcagtgtgtggagtttgtggttgtagtgtttgcctggtacatcacccatgatgtcaattaaaaaaagttttgatcttttaatgtaactcagattggatttagataaagttgttaaatttgaaatattagaaaatgtntattatagaacatgatatatatttacattcatctctgtattccctcagcctgttgtttagaanggacaggaatngtttaaaacttttatctttaatttagngtantacctaagaaaagggggccaggtanttaattaccttggttntaaaaaggtngaaaagggccttggaacttggaaaaaccttnaaaaattattttttccattnanngggcttttaaaccttangangggcccaggaagtttaaccgnggntnttttgggntncatttgggggccttccctttggttnccnttaagnttnttttccatttttaaattaatnc

SEQ ID NO: 8480 - DNA, 733 bp, Homo sapiens
  misc_feature 1, 4, 13, 15, 16, 733: n = A,T,C or G
nctnacccttttncnngaggtctacaacccattagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagttcaagttctctttctgatgatgatttttgggtgcgtgtagcgcctcagtgaaatgcacaggatcaacagggtttgttgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattttctgtgctaagggtccaggtattttaatttggattatttaagtatggttatggtttcatggacacttaatttaggctttttgatn

SEQ ID NO: 8481 - DNA, 759 bp, Homo sapiens
  misc_feature 3, 6, 507, 556, 606, 631, 705, 723, 734, 746, 747, 751, 756: n = A,T,C or G
ganatnctttcaactcttgttctttttgcaggatcccatcgattcgaattcggcacgaggggtcaaaagaaaccacacgcttagattggtaagagggcaccctatgaaatgaaatggggatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggangcccgggctggaggggcagtgttgctgttcatagattttgttccattgncgttgctctgttgaatttaatttcagtcttcctgaatcttcccttctgtnaagtgtacattaccaagttccttgnttttttatatatatatataaatatatatatatacaaactgtctctttttgcctttgacattcaggcaagaaganaaaataaatctttttaanaagacaatccnaaaaaataaaannatanaaaancct

SEQ ID NO: 8482 - DNA, 1107 bp, Homo sapiens
  misc_feature 7, 10, 17, 29, 31, 32, 35, 41, 46, 48, 51, 53, 57, 60, 65,81, 83, 88, 89, 90, 93, 102, 103, 104, 106, 107, 117, 118,120, 121, 122, 125, 133, 134, 137, 142, 143, 144, 145, 147,150, 160, 161, 163, 166, 169, 170, 171, 173, 174, 179: n = A,T,C or G
  misc_feature 181, 189, 209, 211, 213, 217, 220, 225, 233, 235, 239, 242,244, 250, 270, 293, 294, 295, 297, 303, 305, 315, 317, 320,325, 329, 330, 334, 344, 348, 350, 364, 367, 382, 386, 389,393, 395, 398, 399, 405, 413, 436, 451, 452, 454, 459: n = A,T,C or G
  misc_feature 460, 462, 473, 475, 488, 489, 493, 496, 499, 512, 515, 521,526, 529, 539, 557, 560, 562, 564, 567, 568, 569, 572, 587,590, 627, 630, 637, 653, 663, 669, 679, 689, 696, 698, 701,712, 733, 734, 739, 749, 764, 773, 783, 822, 827, 836: n = A,T,C or G
  misc_feature 841, 849, 858, 859, 861, 862, 866, 875, 897, 898, 905, 907,915, 928, 934, 936, 948, 954, 962, 969, 981, 995, 1009,1012, 1017, 1024, 1034, 1036, 1038, 1039, 1047, 1048, 1056,1057, 1058, 1071, 1078, 1086, 1092, 1102, 1106: n = A,T,C or G
gaagacnctntcaactnctggtgcttttngnnagncccctngcccntnttngncganganatctnaggtctataagacggntnttttnnntcnaatgccaannntnnaagggggggnngnnnttntaagaatnngtnggaannnntngcncaaggaatgnncnaanctnnnannccaanantatggatnaagggttggacagggctttncnanatgnatnctggnaaaaagcntntggntgncncccaanccttgacccggttccggttnaaaggggaaaaacctaaagaaannngnttaagntngtttcgcatncngtnattcnagcnngagnttacagaagnttantntttccacaaaaacnaancatgggccctaacanaatnaangggnanccnncgggcncttttttngggtatccttggggttcttttcnaacccaaaaaaggtnnancaatnncnattcccccaantncacccaattccgnncttnggnccntttcacccccccnagncccccnattgntcnggaaacccanccctttctattgaaacanatngncnttnnnccntcctttttaaacccncgntgggggccttggccccggttccaaactttcccttctnccnattgggnttactgccttggcaantactcggggnaacatnggcaattggnctttaaaatngctccananaanccttttaagtnggccttggaacccaaagtttnnttttncaaaatatgngaaaaccatgtatcnccggccttngggtaaaaanaaatgtggccaaggatataaaattgggttcccccaatgnggccngggcccccnctaanaattcctntccaagganntnnttgnccttggggnagaaaatttttttagggggtannccatacnancatttagngggggccaggaancaaggnangggtttccccantggggngcaatatntctagtnaaagcttaatgnttgggcaccccccnaaccaatggaaganaantttgngggaaangggataaaancnannaaagtccnnaatttatnnngggggcctaattntgcccanggggaaanaactanggggcaaganaaant

SEQ ID NO: 8483 - DNA, 724 bp, Homo sapiens
  misc_feature 14, 606, 724: n = A,T,C or G
ctttaaaccttttncgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccacactcactgaaaatgaccgagacagccagtcgccgttgaggaatnctctgttgtcaacatcgagacccctggttttcgggaaaccaatggtgatgcagttgattatcagaaacagctgaagcagatgattaaggattagcccaaaaaaaaaaaaaaaaactcn

SEQ ID NO: 8484 - DNA, 966 bp, Homo sapiens
  misc_feature 1, 2, 3, 4, 5, 6, 7, 8, 9, 10, 11, 13, 15, 16, 17, 18, 19,20, 24, 25, 26, 27, 28, 29, 30, 31, 32, 33, 34, 35, 36,37, 38, 39, 40, 41, 42, 43, 44, 46, 47, 48, 49, 50, 51,52, 53, 54, 55, 57, 58, 59, 60, 61, 62, 63, 64, 65, 66,67: n = A,T,C or G
  misc_feature 68, 69, 70, 71, 72, 73, 74, 75, 91, 97, 100, 104, 105, 125,129, 141, 142, 143, 144, 147, 151, 154, 158, 170, 185, 187,219, 228, 239, 242, 247, 262, 264, 268, 274, 276, 277, 285,288, 290, 293, 294, 295, 296, 298, 307, 308, 318, 320: n = A,T,C or G
  misc_feature 326, 364, 380, 384, 385, 399, 402, 404, 410, 416, 422, 424,429, 431, 444, 445, 452, 458, 464, 471, 484, 487, 494, 497,515, 516, 529, 530, 531, 545, 552, 562, 564, 567, 571, 572,588, 592, 593, 595, 596, 599, 605, 617, 623, 628, 630: n = A,T,C or G
  misc_feature 631, 633, 639, 644, 649, 653, 660, 663, 664, 676, 680, 682,684, 686, 700, 709, 712, 719, 741, 745, 748, 752, 753, 760,762, 765, 780, 790, 793, 795, 798, 820, 825, 826, 827, 841,842, 851, 864, 868, 871, 875, 877, 894, 905, 921, 923: n = A,T,C or G
  misc_feature 924, 944, 947, 956, 957, 963, 964, 966: n = A,T,C or G
nnnnnnnnnnncntnnnnnngtgnnnnnnnnnnnnnnnnnnnnngnnnnnnnnnngnnnnnnnnnnnnnnnnnnngtaagaatcctttcanctcccngtncttnntgcatgaacccatcgattcnaatncggctccgaggnnnnatntgantantacncacggcacattntttttcagggggaangngaacgaacgcctgctggggagtgggctggacntgactgttncattgcaaagncanaggtnagagcctggcgcagnancatngactcngnnggatccantgnangcnnnncnaggggccanncaggaagggncntcaagnctatttcctcatacgcaccgggatgacatggatgatgntgacagggccccatancccnntgggaaagtgaagncananaaaggncagggnagtggnantaggntncagggggtgaggnnataaaantaatantactcnctgttgnaaaactcctaganggnaaatatngcntgaagaaatatcacgaannatgggaggaatcnnnatcgtttatatacncggttgnttgaaaagancnatnaccnnctgatccacataaggncttnntnnacngggatntcctggaccggnatggcnctcancnngnaacagnttccnaaccngggnagggcangcnncccagggccttnaatncnangntgccgggaagccantcaacttgncgncaaaatnaggaacttgggcttgacctggnttgnccntccnnaccgcgntngantgacttggatggganacatacaacnggncnttngccatatggtcaggtggcaccngggtnnnttttttaaccatanncagaacccnagggaacgttggngtanaantccncnatagcccagtatttggntattctttaanggggcggaacctcagntnnaattttttgggtccaaaaanccntggttcccnnacatannan

SEQ ID NO: 8485 - DNA, 1130 bp, Homo sapiens
  misc_feature 2, 7, 12, 15, 18, 22, 23, 28, 30, 31, 38, 43, 44, 51, 52,55, 56, 57, 58, 59, 62, 65, 66, 68, 72, 75, 78, 80, 86,89, 91, 93, 95, 99, 104, 107, 110, 112, 116, 117, 119, 120,127, 130, 133, 134, 141, 144, 145, 146, 154, 155, 158, 159: n = A,T,C or G
  misc_feature 166, 167, 169, 170, 174, 176, 177, 180, 181, 184, 193, 195,196, 197, 199, 208, 209, 215, 217, 218, 221, 223, 224, 227,229, 237, 242, 244, 250, 266, 273, 275, 279, 282, 291, 296,298, 300, 305, 321, 326, 339, 340, 341, 350, 351, 352: n = A,T,C or G
  misc_feature 362, 367, 374, 376, 377, 380, 381, 385, 389, 391, 393, 397,405, 407, 409, 417, 421, 429, 430, 431, 441, 442, 454, 457,459, 461, 471, 472, 473, 476, 482, 484, 489, 495, 497, 501,502, 503, 510, 511, 514, 516, 517, 525, 534, 536, 537: n = A,T,C or G
  misc_feature 540, 541, 542, 557, 559, 560, 563, 564, 567, 568, 569, 570,571, 573, 574, 576, 577, 578, 579, 587, 592, 594, 598, 600,603, 604, 605, 606, 608, 610, 613, 614, 619, 620, 622, 623,628, 630, 636, 640, 641, 643, 646, 649, 656, 659, 662: n = A,T,C or G
  misc_feature 663, 666, 669, 674, 676, 677, 679, 691, 693, 694, 696, 704,706, 708, 712, 714, 716, 719, 721, 740, 749, 750, 751, 753,759, 760, 763, 764, 767, 778, 786, 793, 796, 799, 801, 802,810, 811, 812, 816, 823, 826, 830, 835, 838, 839, 846: n = A,T,C or G
  misc_feature 847, 852, 853, 862, 867, 868, 869, 870, 871, 872, 882, 885,894, 898, 900, 907, 923, 925, 927, 931, 936, 941, 954, 962,974, 975, 977, 978, 987, 1003, 1007, 1010, 1013, 1018, 1020,1024, 1028, 1030, 1033, 1039, 1040, 1041, 1052, 1059: n = A,T,C or G
tnggggngaaangcngangaannggganannggggctnacgannacggggnnatnnnnnggnaannangccncgnaanangtaatncgngngncncccncatgnaangtnangganncnntagcgcnganggnncgggcanatnnngacacacnngcnngcgtttnnanngtangnnacnncgnataacagcncnnncntgtcgtagnnaccaancnnacncnnacnangcttttgnaaacncntctcangcgccccccgaacgcnaaataantnatgncgnccccccccngaggngncnactgnggaggggggggggggnacacntttttaccaacannnccaacccannngggggcggtnggaanaacccantnnctnntttnactncncntganggtggccngngntggacggntaancaaacacnnngcgagagctnncgccaccgagcnagngncnagaggaccgnnncgntcgagngngaganaagggngngcannnctgccgnngcngnngagtctgngatggcgcncnnccnnnagcggccgcaccggnanngannggnnnnnannannnnagggaganaatgngnaggngnaannnncngnaannagaannannggtgncngaagangganngnagnacngacgccncgngannganggncggcngnntngggcgggaggangnnangtgtcgangngnggcngntnccncngacacgcggggtagttgtngcgacacgnnntncagcannaannganaccactcacancagattangctgatngtnaancnngcgcggcnnngagnaacggcncangatncactngtnngcggggnnagctnnacgcgtcanagcgnnnnnntcgcggcgcnagngggccgagnacangnaagggancgaccgagtcagtcgnangncgtnaagcncgcancatcggagactgncacaaacncgctcaggaacnngnngtctctggnacagcaagctgcgacntgtngcnganacagngnacgncaananggngaaaannnggcggcgcacngaggcgncgcgnngtgcncgtacgancntgggagacanccncgagatncgacnnnctagagtgccagnagagcacncg

SEQ ID NO: 8486 - DNA, 901 bp, Homo sapiens
  misc_feature 3, 5, 7, 16, 47, 49, 65, 73, 86, 88, 95, 96, 97, 98, 101,105, 108, 121, 123, 137, 139, 141, 144, 148, 149, 157, 158,166, 168, 191, 194, 198, 199, 201, 211, 232, 235, 239, 246,249, 250, 267, 322, 346, 349, 367, 370, 424, 454, 461: n = A,T,C or G
  misc_feature 464, 546, 563, 599, 601, 640, 663, 689, 733, 760, 771, 782,799, 822, 836, 839, 842, 845, 849, 856, 886, 889, 890, 896,901: n = A,T,C or G
tcntncnccctccaanctccgtgctctttgcaggagccctcgattcncntagatgaagggctganaattttanaaaaagcgccttnanaagcctnnnnagnattnctnggaaattattggngnccaaagcccctagncngnttngggnnaggcaccnncccatggntntaaccccgttcccaaaaaccatngtnaaanncnttaggattcnaggtttggaaaatcttttttncgnttanttggtanttnncttcccaaaaacccccnttaaaatagccctcctttcaccatggctatctttttttcaaggttttatatgcantagctctctcagcaccttggaatnggnaaaaactggtaccagcanttngggaggtgggtttttcttttaagaacattttgccagatctttatcttcaagggnggactaaggaacccccagagcctaagttantcttggnganggcaatctctgcgaaccgcctgaaccttaccctaagttgggtttctatggaaatatggtagaaatgccacctggcaagtaancccatttggtaaggaanggtacctatacccgggttttttttgggggcctttgntnggttggttggtttggggtctggagaaatggtactggccnacccccttctttttattaaaganaaagaaacctggatttttggataccnttattttttaaaaaatattgaataggttccaggaagtttaaatngggatggtttaaaaaatttttaatttncttttggtttnggggcaagttnggaatttaaaatccggngaaatccttattaaattccggtnccctttttgggggnaanttnttnttanccccggntttattaaataaatacctggggcccccaanccnnttttgnccttn

SEQ ID NO: 8487 - DNA, 732 bp, Homo sapiens
  misc_feature 1, 11, 15, 33, 37, 97, 113, 117, 119, 121, 129, 133, 135,144, 663, 675, 704, 707, 732: n = A,T,C or G
ngttttgacgncctncgattcggcacgacttanaaancgaaaacctggcgctgcaaaatgtgcaggctcgaatacggatggtcctctcctatctgtntgctcagttgagcctntggntntnggggtgtncacngngggctcctngtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatcttgcgaccatttctgtacaacacaagctggcctttggcagnttcggtgcatanaaaaatcaggtgcttcaacttcgagcctnttnaactatagtgaggtcgtattacgtn

SEQ ID NO: 8488 - DNA, 760 bp, Homo sapiens
  misc_feature 1, 10, 14, 24, 29, 34, 44, 45, 47, 53, 58, 76, 81, 93, 96,102, 103, 105, 108, 113, 123, 129, 131, 135, 136, 145, 146,159, 160, 166, 167, 172, 174, 178, 181, 182, 185, 196, 199,201, 206, 208, 217, 219, 225, 228, 234, 235, 248, 255: n = A,T,C or G
  misc_feature 256, 257, 258, 285, 298, 302, 309, 311, 315, 321, 322, 327,328, 333, 340, 344, 345, 351, 356, 368, 383, 384, 391, 393,395, 401, 426, 434, 437, 449, 453, 454, 457, 501, 514, 516,518, 521, 523, 532, 533, 553, 557, 560, 562, 564, 565: n = A,T,C or G
  misc_feature 566, 572, 574, 577, 582, 583, 588, 590, 592, 595, 596, 605,606, 609, 615, 616, 619, 620, 629, 632, 637, 641, 642, 643,649, 654, 658, 660, 664, 670, 675, 682, 683, 684, 685, 704,711, 718, 720, 722, 726, 727, 733, 737, 741, 747, 755: n = A,T,C or G
nttgactcgntcgnttccgactangttcntcatncatgacaaanncntgaatntgctnccagatggtaggacatgnacctngaccttgggaanacncaaacnntngtntctgntactgccctnccacantnaccnnaatattacnngcactgccccagnngattgnnggccncnctgnctnnctnctgtgtgcacnccngnaaagncngggcctcgntntccatntcntacctnncactgcattaagnagatggnnnngtcccgccctgacctgagtctaggcgngctctgctgctgngatntgaacananctcnaacctnnacagnnactgncgggatnctannagtgtntaatncccatgtggcantgttgcactgttgcnntccatgngntncatggncaaagcataaccttccattaactantgaaaccnttntattggttgtangtcnngtnaataatgatgggtactatggctttaaaacttttttcacatgctngcacctctggatngntnggnanaccaaagcnnggtctttaaccgcgcctcantttnaananannngggagncnaangcttnnatttntncntanncggaaactnncanctacannttnnttggcaacnatnccatngcannncccttnaattngggngnaagngaaaanggctnccctggnnnnaaggaactgggattttttnaaccctngaaacgnananaaanngcgggnggtnggcncttccnctttttcncccct

SEQ ID NO: 8489 - DNA, 741 bp, Homo sapiens
  misc_feature 46, 51, 53, 54, 56, 62, 70, 71, 76, 83, 86, 88, 89, 91, 98,118, 121, 125, 130, 139, 143, 144, 146, 149, 152, 161, 164,172, 182, 192, 194, 208, 213, 233, 243, 245, 248, 251, 253,280, 312, 475, 565, 606, 638, 670, 679, 704, 711, 719: n = A,T,C or G
tatccttcactcttgtcttttgcggatccctcgttcgaaacaagcnacctntnntngtgatnggaattgnnaattnaaaaggnggntnntngggtttnggccaccttaaccaccaaanttngaantggtngattgaggnccgnngnccntgntgaaagggnccntttggaangggttggggnggaagggaantntttccgggtgggtntgaanctgttggctttccaggtcantttttgcccntncanccntncttgcaggatgatcagaaatcacggcncctcattgggaaggttaagactggaccaaacnttttccaagggtgagcatattcaccgttacctgggaagtctcttctttcccacctggggctaatcaggttaccaatttttcaaggggtaaaccaaacttacccacttccagggataggggaaagtggtggtgggaataaagaagaaccattgataccctgganggaaggggaagaaacccccaagcctttttcctactgaaaaaataagggtgacatgtcagtcaaatcttgatcaactgggacttgagtttncagttaaattcctacactaggagggagtttctatcaaaatnctcagattgaagaacttggttattagaaccanctgtccttttcaaactgttaaaatagatctgnctcccctangatgatcatggcctggtggggccanaatccgngtgtttgnacctgtgcgatttatgcataaa

SEQ ID NO: 8490 - DNA, 914 bp, Homo sapiens
  misc_feature 2, 8, 9, 18, 26, 31, 46, 66, 76, 79, 80, 81, 83, 88, 92,93, 98, 99, 100, 107, 113, 114, 118, 120, 122, 133, 140,141, 148, 174, 176, 178, 184, 189, 197, 199, 201, 205, 208,215, 221, 226, 240, 358, 415, 422, 499, 504, 530, 534, 578: n = A,T,C or G
  misc_feature 582, 586, 632, 638, 654, 663, 699, 705, 719, 811, 827, 833,886, 913: n = A,T,C or G
gntattcnntcagctctngttctttntgcangatcccatcgattcncccggctgaacacctcccancatgccatgnacnnncntcggntggnngagannngaggggncctggnntaangntnagttaaaaganctctggnngatgtancccttcctcgccttagggccttaatncntnacttcntgtcncggttgcncntngaanccnttttccntggaancatancaaagcaggctgcnttaggaattatgcagatggttgaagacaccctcattgaccatgctcataccaaacctctccttccaagtcagcttggttcggtatagaagaaagttcagctccctgacagaagggatnggttttggtttatcaagcagaagaaaatgaaagttcaccaaataacctggtgggcantccgagnatattacttaccccaaaccaggaccattggccaaaagccacccttcaagaagaaaataatggtttttcttgggaagncttcntttcttggtccaagaaatttaattcnttcnggggaaacccctttggccttttcaaaccaaccccccttggcggnccancccnaaaggggaagcccaagttttgggggggccttattaattccggtccnttttcnaggccgggggccccancggttccgnaggccttaaatggggccattaaccaagggggctttnggaagnaatttcattcaatnccaagtccaagaaaaaagcccccctcacttaccctaaaaaagccagaagtgggaagccttctttaattaccattgggaaaaagtccataganggacatgacagaagangccttncaaaacacatttcaggcattagcaattcgtcgactagaccaacccaagaactntctgctgagtgtgctaaaactggggana

SEQ ID NO: 8491 - DNA, 728 bp, Homo sapiens
  misc_feature 1, 14, 625, 628, 705, 706, 707, 708, 709, 710, 711, 712,713, 714, 715, 716, 717, 718, 719, 720, 721, 722, 723, 724,725, 726, 727, 728: n = A,T,C or G
ntttacacccttcnaattcggcacgagagatagtctctgaatttagaactgggacgaaagtgtacataatagggctattataaaatttttagaattggatttctaaacttggggtcagtgaatctagcaggcttaagcagtgttctcaggtttttctggcacagacaaggaatataagaggaggagagaaaaggagagacagtagtgggagggaatagaatgagagaagatagaaaatatggaattaatagagaaaggatacatgaagtattacaagattttcttggaaaaattggcatttcagtgatggatcaaagatgtctaatgaggcaaaatactactattacttaaatatttaatgttttaaagatttgaggataaaaggatatagatctgatggcgttcatactaattgctgtagtgttgatgttggagagaggggtaatgtatcaagacagagcagacagaccctttacaatgagagcagaagatatgttgtttactgattctactttcccacaaaatgctaatgcttttataagtccctcctccttattttctagattaactccttgtttcttcctctaaacagaggattatggcagacaggcaaaaaaaaaacctntanaactatagtgagtcgtattacgtagatccagacatgataagatacattgatgagtttggacaaaccacacccttatnnnnnnnnnnnnnnnnnnnnnnnn

SEQ ID NO: 8492 - DNA, 1632 bp, Homo sapiens
  misc_feature 3, 4, 6, 10, 12, 16, 17, 21, 22, 26, 27, 28, 30, 32, 33,41, 43, 49, 53, 54, 57, 60, 64, 76, 79, 85, 86, 87, 94,97, 100, 103, 104, 106, 108, 109, 111, 112, 113, 116, 122,132, 136, 137, 142, 145, 149, 154, 156, 158, 160, 162, 164: n = A,T,C or G
  misc_feature 170, 172, 180, 183, 185, 188, 189, 190, 191, 193, 194, 198,206, 210, 220, 222, 228, 230, 237, 247, 249, 251, 253, 255,261, 262, 267, 269, 272, 283, 287, 288, 292, 296, 298, 304,306, 308, 309, 313, 314, 316, 318, 325, 329, 333, 342: n = A,T,C or G
  misc_feature 346, 349, 351, 353, 354, 355, 362, 367, 376, 379, 382, 386,392, 394, 397, 401, 402, 403, 405, 407, 413, 420, 423, 431,435, 437, 438, 442, 447, 450, 451, 453, 454, 463, 471, 472,473, 474, 475, 480, 482, 483, 487, 489, 491, 496, 497: n = A,T,C or G
  misc_feature 505, 506, 507, 510, 514, 516, 522, 526, 529, 534, 539, 540,542, 547, 548, 550, 551, 554, 556, 557, 558, 564, 565, 567,570, 575, 576, 577, 583, 585, 588, 589, 590, 592, 593, 602,603, 610, 612, 616, 618, 621, 622, 625, 627, 631, 632: n = A,T,C or G
  misc_feature 635, 637, 638, 639, 641, 642, 643, 644, 645, 647, 649, 650,651, 653, 655, 661, 664, 667, 669, 673, 674, 675, 678, 682,684, 688, 695, 706, 707, 710, 711, 712, 722, 729, 730, 733,737, 743, 747, 748, 750, 753, 756, 759, 769, 775, 780: n = A,T,C or G
  misc_feature 781, 786, 790, 794, 798, 799, 802, 804, 807, 808, 809, 812,813, 815, 816, 825, 826, 832, 837, 847, 848, 850, 851, 853,868, 878, 881, 886, 887, 890, 892, 894, 895, 903, 911, 917,921, 928, 936, 939, 941, 942, 946, 947, 950, 966, 970: n = A,T,C or G
acnncncgananaagnnaacnngtannnananntgcgtaantngacctncaanncancgngaangcacgatagtanganctacannnacacgcncgnacngcnnananncnnncgnccacangacgcgatcncaannaactnagntggnagcancncncnananagactnanactatacnacncncannnnannactngggaaaancctnttgccaaaanancccccngncgcgganaaaagatacngncnancnagagannagtcncntanaacacggcatnaacnnacancgtngngggagngntnngacnntntntttatanagcngcgnactcacacnaatnccncncnnncgagggnggggnggggcgttnaancanaagngaaatncnccngatnnntnanctcgancacaccnacnctcagaanagcncnntatntaagnganntnnaaccttggnagcaaaannnnntaacnannaccncncnacatnntaagaatnnnaanaagncngcacancaanaanccaanatacnnantcggnnanngcngnnnataacnngncgnaggtnnnaagaanancannncnngagacatcnncaacaananaacncncannganangatnngangnnncnnnnngncnnncnantccganctntcnancacnnntantgantntacnccaggantgatcacacgnnggnnnatgaagatanactccanncancacngctganaccnncncanagnacngtataagctnatcacncaacnntcgtntcgnggtnaacnnatntntannntanngnngcgcgtatnngagcanacatntgacacatannannanatcaagaccggcatnaccatgaatnacngaggnntcncnannacacagangcaagacngacatncgtngcgatanttcgccgngananntccnnaanaataatcgcgacgcanaaanatgagactacncnacaaanncacnttanaataancntgaatancanagnacctgcgnttataaacagnnancnnnaangagatancgatcaaanccccgnangntccangataactcacgtncatgnntgtcgaccnaaatgacaancatnanacgagngacncgaaacagaantcagacggcgnnntantnaccccatntcgtcatntcctnctntntaacgcnactnttnagcnnnacgtgncngcnacagcnantanaaccaccaacatcnccatangtcgctnagacaaaacgaaaccgnancntatanccnngnncattccacgaanatacnanacncatcatnctcagtagctatgaancgcgacgcncanatagcaanaanacnctacatacacgcgnagactagancgcaaanntacgcactnantagnanatnanaaccacgacntacagaacaactatcgagcacgcctacantgcatgacatgacanacncacnngnacgagtanaacatanntgntnangtcntaacgagcanacacgacgaancacgatnnaacancgnacacaacnantcantatcangntacgcagcnntnncncggcacntaagngcananaccganacacctnanacgtcncgcatcnnnncgcg

SEQ ID NO: 8493 - DNA, 957 bp, Homo sapiens
  misc_feature 2, 7, 14, 32, 42, 119, 120, 121, 206, 213, 217, 226, 229,238, 240, 249, 251, 252, 254, 262, 264, 268, 270, 273, 277,278, 282, 285, 289, 294, 295, 299, 304, 306, 308, 318, 323,327, 338, 364, 380, 382, 391, 392, 399, 402, 405, 406: n = A,T,C or G
  misc_feature 434, 438, 442, 452, 455, 461, 464, 471, 472, 480, 484, 489,509, 511, 518, 521, 526, 534, 538, 539, 540, 542, 571, 581,585, 586, 588, 591, 597, 599, 614, 618, 623, 626, 641, 649,650, 651, 670, 678, 680, 681, 686, 688, 690, 696, 708: n = A,T,C or G
  misc_feature 709, 712, 716, 719, 722, 733, 734, 736, 751, 755, 765, 768,769, 772, 778, 781, 786, 793, 794, 797, 798, 799, 809, 814,816, 817, 822, 825, 834, 836, 839, 855, 860, 869, 870, 874,875, 882, 886, 887, 888, 892, 894, 896, 899, 901, 902: n = A,T,C or G
  misc_feature 905, 913, 918, 929, 931, 937, 938, 946: n = A,T,C or G
tntaatnctttcanctcttggtctttttgcangatcccatcnattcgctgcactgtgaacctgggcactccgcgccgatgccaccggcctgtgggtctctgaagggaccccccccaatnnnactgccaaattctccggtttgccccgggatattatagaaaattatttgtatgaataatgaaaataaaacacacctcgtggcaaanaaaaaanaatntaattaaantanaattaaatnanaaattctcngnncntttaaaantntaantngantctnntttnctnatanatccnnaaanatcgntnantattcctttntttgnaggntttggaacaanatccccccattcttagtaattgctanctgtaaaaaaatattncnttttttttnntttgaanttnttnngtgaccccccttccgtctcttattttgntaancccntttttttaanccntgttanttnacccaannttataccngacnaccantttggcaattctttttctantngttaccnagngtctnctggtgtngtannntncttttaaaatttttttttaaatttctctncgggtctccnctgnntnccnatattncnatctggggccctcgngctnccccnacntttttatttttcccntttttaannnatggttttttattgtctcnctcttggntnnctaancncnttggancattttccttgnnttncttnttnganaaaaattggannantactgcttctccaanttcnaacattaaanatnntcnaatctngtngatcnattaatnnctnnnataacgctcntggtnanngtccncanttcttctcntntcnttaaccttcctttttnattgnatgatcggnncccnnatctgcncccnnntaancncnttntnnganaaatcccntcacntctcccatatntntttttnngtaatctntcctccttctt

SEQ ID NO: 8494 - DNA, 777 bp, Homo sapiens
  misc_feature 65, 73, 87, 108, 119, 161, 170, 362, 588, 613, 623, 701,709, 719, 726, 742, 753, 757, 764: n = A,T,C or G
tattattcgttcaagctcttgttctttttgcaggatcccatcgattcggcacaatgtctacccangggatgtntgttcctgacctgncgcccaccttctatggtgccntcaagaacctnggcaccaaccaatgcctggatgtgggtgagaacaaccgcggngggaagccnctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccangatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaaagatggatttctnaacccactgggtggcaaggcaggancttcctaatncttgcaacaacattggggcccattttcttttcttcacaccgatgggaagaaaccattaggacatatattttagcctancgtttttncttgttctangaaatangaggcttccaaagtangggaaaggcancctngggggangggttcaagggct

SEQ ID NO: 8495 - DNA, 901 bp, Homo sapiens
  misc_feature 7, 13, 17, 19, 20, 22, 23, 25, 26, 27, 29, 30, 31, 32, 33,37, 40, 42, 45, 46, 50, 52, 53, 54, 56, 58, 60, 63, 65,73, 76, 87, 88, 91, 99, 100, 101, 105, 107, 109, 110, 113,114, 115, 132, 145, 157, 177, 184, 187, 188, 234, 242, 256: n = A,T,C or G
  misc_feature 274, 276, 279, 298, 316, 317, 321, 323, 326, 333, 346, 348,352, 395, 398, 401, 404, 406, 438, 460, 476, 484, 486, 497,504, 512, 576, 592, 601, 631, 642, 694, 712, 713, 718, 732,736, 742, 756, 785, 788, 794, 796, 806, 809, 820, 821: n = A,T,C or G
  misc_feature 831, 833, 834, 840, 847, 848, 849, 852, 857, 861, 862, 869,872, 877, 879, 888, 890, 892, 893, 900: n = A,T,C or G
ccccccncccctnatgncnnannannncnnnnnaacnaancncannggcntnnntnananatntnatatgganaancgccctaatannccnccgtacannnaccncncnnacnnntgaaacccttcgaaacncacgagaaaaaanaggaattttggngcgggttgaccgagggttantgtacanatnnggaaaaaaagctcacggggtgggcaggaagacaagcctatggatcntgctccangcatcaagctcatntacatgggattttctggncnctnaaaaacaatcaggattgcnctagacattcgaaaggcnngcantntcntctcttntgttttaacctgnanacangctgataaaagtcctccacatctcagcttacatttggattcanagncgntgncnacggagggtgagagcagaaactcttaagaaancctttcttctccctaaggggangaggggatgatctttngcggtgtntngatcaaacttntattttncctagagntgtggaatgacaacagcccatgccattgatgctgaccagagaaaaactattcaattcttgccantagagacacatccaangctgccatnccaaaggggtcaaaaagttttcaaataacngtggcaagctnaccaaaggtgggggaaagcatgataagcttgcaggttatggtaggagagggngagatataaagacatacnntactntaggatttttaaantatnaaaagncaaaaaaatccatnagaaaagtatcccttttttttttttgganaanggggtncntccacttaangtnggcccagggcnngggtcttggnannctcccnaaggccnnnaanggganaccnncccccanctnggggncntccacaaangnanntcggggnt

SEQ ID NO: 8496 - DNA, 699 bp, Homo sapiens
  misc_feature 6, 10, 126, 220, 279, 289, 294, 297, 317, 331, 333, 341,348, 355, 403, 426, 470, 500, 524, 535, 538, 566, 575, 584,585, 594, 601, 607, 613, 633, 638, 645, 659, 668, 676, 684,685, 686, 690: n = A,T,C or G
ggcttnagantgcaatgccaggggtgccttcccaaaagttctttctgcctgggtggagcgtagacagctcagcaccccacggggggcggttggaccagccttggttttgttgggtaaggatgttanaaagaggggcgaagacccatagccactggtgtgaagggtctgctcttgaccgaagctgcctccctctgggtgcagaccagcaggtggtcccagncacggtgccctggggccactgggtctgtctgccctcaggctccactatacacacctgcngaggcagcanactancancggtgtctgtgaggggcagntgcacagtcccctntngagggtgntcctaancgttggntaagcccatgcgtttctgctttttggggagcagagcctggagtcctgncattgttggggaggaagctatcncatgcttgagcgcgggcctggggtgctgacctgcatcccaagancaaatttgcccctggcctttctgggcctgncctttcttgtaacaccacacttgnacacctgggancanaagcgtgccccccggcaggatcccacantggctggtnggaacactnngggcagcangtgactnaggtcnccccanaacttgagggaacaccttantccanggaggangctgaagcttccanggacacaantaaacaangtggggannnggancctcacaat

SEQ ID NO: 8497 - DNA, 1344 bp, Homo sapiens
  misc_feature 2, 4, 11, 12, 13, 100, 111, 114, 118, 132, 140, 147, 163,197, 206, 233, 250, 298, 310, 431, 478, 488, 525, 533, 546,549, 584, 589, 597, 611, 657, 673, 685, 692, 703, 710, 716,724, 737, 759, 769, 807, 825, 837, 845, 848, 855, 877: n = A,T,C or G
  misc_feature 881, 888, 894, 910, 933, 939, 1018, 1021, 1032, 1035, 1049,1054, 1062, 1071, 1086, 1095, 1102, 1116, 1120, 1124, 1140,1146, 1151, 1163, 1167, 1191, 1195, 1199, 1207, 1219, 1256,1282, 1293, 1314, 1321, 1326, 1338: n = A,T,C or G
antnaaattcnnntactcaagcttgcattgcctggcagggtcggactcttaggagggatccccccggggttacccggaacttcggaatttccgcccttantaagtggaagntcngtanttaacaaaatttcnacttgggncccgtcngttttttaacaaaacngttccggtggaacttggggggaaaaaaaaccccntggggcggnttaacccccaaactttaaatccggccnttggcaagccaacaatnccccctttttcggcccaagcttgggccggtaaataagccgaaaagaanggccccggcaanccggaatcggccccttttcccaaacaagttggcgccaacccttggaaatggggcggaaatgggaacgccgccccttgtaagcgggcgcaatttaaagccgccgggccgggggtggtgggtngggtttaaccgccgccaagccggtggaacccggcttacaactttggnccaagcgggnccccttaaaccggcccccggctttccctttttcggcnttttttcnttttccccttttnccnttttttctttcggccccaacggttttccgggcccngggcntttttttncccccccggtttcnaaaagggcctttcttttaaaaaaattccggggggggggggcctttnccccctttttttaaangggggggttttnccccggnaaatttttttnaaaggtngggccntttttttnaaaccgggggggnaaaccccctttttggggaaaancccccccccnaaaaaaaaaaaaaaacctttttggggaaattttaaaanggggggttgggaaaattngggggtttttcnaaaccggnttnaaaattngggggggggcccccaaatttcngggnccccccnttgggnaattaagggaaaaccngggggttttttttttttcggggncccccnttttttgggaacccggtttttgggggaaaggttccccaacggggttttcctttttttaaaataaagggggggggaaccnttnttttgggtttnccnaaaaaacttggggnaaacnaaacaacntttcaaaanccccttaattctttngggggcctnaatttcnttttttggaatttnaatnaaangggggaaatttttggnccgaantttcngggccctaattngggnttaaaaaaaaatggaagcctggantttnaacnaaaaaaantttaaacggcgnaaatttttaaccaaaaaataatttaacggctttaacnaaattttccttgggaaggccggggantttttcttccnttaacgccaattttgggggcnggggaanttttnaacaaccccggnataatg

SEQ ID NO: 8498 - DNA, 733 bp, Homo sapiens
  misc_feature 1, 86, 118, 162, 672, 673, 697, 733: n = A,T,C or G
ntctaaccctttcgaatcccacgagaccacgtcatatacagcctacaaagagctcttgactgtgagctcgcagaggcccagttgcnttccactgccattgacaaagagggtcgtcggnctgttaaagcgggagcttatgctgcttgccaggaagcaaaggangatttaaagagtcattcagaaaatgtctctcaacatccacttcatgtagaagtattacactcagagattatggctcatcagaaatttgctttgcgtcttggtcctggatgaacaaaattatgagctattcaagtgactttaggcagatcttttgccaagcatgccttagagaagaacctgactcggagaatccctgtctcataagcaggttaatgctttgggatgcaaagctttataaaggtgcccgtaagatccttcatgaattgatcttcagcagtttttttatggagatggaatacaaaaaactctttgctatggaatttgtgaagtattataaacaactgcagaaagaatatatcagtgatgatcatgacagaagtatctctataactgcactttcagttcagatgtttactgttcctactctggctcgacatcttattgaagagcagaatgttatctctgtcattactgaaactctgctagaagttttacctgagtacttggacnnggaaccaataaattcaacttccanggttatagcccagggacaaattgggaagagtatatn

SEQ ID NO: 8499 - DNA, 769 bp, Homo sapiens
  misc_feature 1, 2, 17, 64, 69, 77, 92, 96, 107, 127, 153, 156, 160, 191,210, 212, 222, 227, 231, 241, 268, 274, 545, 641, 677, 709,738, 741, 766: n = A,T,C or G
nnatccttcaactcttntctttttgcaggatccctcgattcgaattcggccgagggttaaaggnaaacntccagggntttttcggaaatttnattnggaaagggatncgctttttgagggcaaaatngccaatctgcttgcctttataagccngtngatngtttaaatccggtttacccagtttatagttnccctgggtgctgaaaggtntnctggatgatncctanccancagagaaccnttgaatgccgttcaaaatggactgaancatcancaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgctctcttggggaacaaataaccgaaaagatactcagcaccctggttggtacataggtggtcagttgatttatacttcctggntttcagtgttgcttgaattttctaaatggaaacacagtacctttataatcagaaaacaatcccgagttttgatttgagggtgtttgtaaaaagttnaaaaaaaaaaaaaaaaaaaaaaactcgagcctttanaactatagtgagtcgtatttaccttagatccngacatgataagaaacattggatgaagttnggncaaacccccaactttgaatgccagngga

SEQ ID NO: 8500 - DNA, 736 bp, Homo sapiens
  misc_feature 8, 634, 636, 637, 638, 645, 646, 647, 648, 649, 650, 651,652, 653, 654, 655, 656, 657, 658, 659, 660, 661, 662, 663,664, 665, 666, 667, 668, 669, 670, 671, 673, 674, 675, 676,677, 678, 679, 680, 681, 682, 683, 684, 685, 686, 699: n = A,T,C or G
  misc_feature 701, 708, 710, 712, 713, 718, 719, 720, 721, 724, 726, 727,728, 729, 730, 736: n = A,T,C or G
ttttaacnctttcgaatcgcacgaggagttctacaggtggagtgtggggcccagaaaggggctcaggtcttaggggtgtcatctgaaaaaacagagatggttgatggggacaccagttctagggagccctctgcatggccactttctgcctcagctcttctaaagcatttcttctgttcccttccattggggtaaccactgatctgtcttcccaaaaactgagtcagaagttggactttgttacttggctcatctacatttaagatatagtcagaaaaaaaatgcagtctttacatcttaagaaagcttacatgggccaggcgcagtggctcacacctgtaatcccagcactttgggaggccaaggtgggcggatcacctgaggtcaggagttcgagaccagcctcaacatggagaaaccccatctctaccaaaaatataaaacttagccaggcatggtggcttgctcctgtactcccagctacttggggggctgaagtgggaggattgcatgagcccagaagtgggaggttgcagtgagctgagacgagatcgcaccactgcactctagcctgggtgacagtgagaacttgtctcaaaaaataaataaataaataaaatccattaaattgccnannnaaaaaannnnnnnnnnnnnnnnnnnnnnnnnnntnnnnnnnnnnnnnnaaaaaaacccccntnaaaaaanantnnggggnnnnttntnnnnnaccccn

SEQ ID NO: 8501 - DNA, 802 bp, Homo sapiens
  misc_feature 2, 14, 34, 68, 70, 78, 95, 99, 110, 117, 118, 119, 129, 130,131, 132, 136, 151, 156, 159, 166, 169, 176, 179, 180, 181,183, 190, 193, 199, 200, 203, 231, 234, 240, 245, 246, 248,252, 263, 271, 285, 303, 308, 726, 730, 783, 800: n = A,T,C or G
antctatctctttnaactcccgttctttttgcangatcccatcgattcgaattcggcaccgagcgttnangggttggngaaaaggcctttttttncctnggtgggtgggncccgttnnnggccttcttnnnngggncaacccagaaatgtntgttnaanccattanggngttccanaannncnctaaaanggnataaanncantcttcaaatcttaagggacctttccttnctncagatncaaanncnagancttgagggttncagggaancgaggtatcagttncttcagcttcgacctgcncaganagcatcatggattggttatgctattgcttaccatttattagaagattatgaaatggcagccaaagattttagaagaatttagggaaaccacaacaggacatcccctgacaaggtggattatgaatatagtggaactactcttatatcagaatccaagttcttcgggaagcaggtctctatagagaagctttggaacatctttgtcctatgaaaagcagatttgtgataaacttgcttgtagaagaaaccaaaagggggaacttctggttgcactatgtcgtttggaaagatgctgccagatgtttatagagggattgcaagagagaaatcctgaaaactgggccctattaccaaaggcttggaaaaaagccactcaagcccagcttaatatgttagaaacggcttaaaaaattatgangganccctggactaaatattcccaggggactgggtgcccaaaaaggcttgcccgttnaaacttttttatctggngg

SEQ ID NO: 8502 - DNA, 1160 bp, Homo sapiens
  misc_feature 2, 5, 6, 9, 10, 13, 16, 18, 22, 24, 26, 27, 29, 31, 32, 35,40, 41, 44, 47, 49, 50, 51, 54, 56, 57, 58, 59, 62, 63,64, 67, 70, 77, 79, 80, 81, 82, 83, 84, 85, 86, 87, 89,90, 96, 97, 99, 100, 101, 102, 104, 105, 107, 109, 110,112: n = A,T,C or G
  misc_feature 114, 117, 118, 125, 130, 131, 133, 140, 145, 148, 153, 155,158, 160, 167, 170, 172, 174, 177, 190, 195, 197, 198, 199,200, 201, 202, 206, 210, 211, 212, 218, 219, 221, 225, 226,229, 230, 232, 233, 235, 236, 237, 242, 244, 245, 246: n = A,T,C or G
  misc_feature 247, 252, 256, 258, 259, 266, 283, 291, 292, 294, 296, 302,303, 304, 311, 315, 316, 319, 320, 326, 332, 334, 335, 337,341, 343, 352, 363, 366, 380, 386, 387, 388, 389, 395, 399,402, 403, 404, 420, 421, 424, 425, 426, 432, 439, 443: n = A,T,C or G
  misc_feature 446, 449, 451, 453, 454, 459, 461, 465, 470, 474, 475, 488,491, 498, 512, 513, 517, 521, 523, 526, 529, 531, 533, 534,535, 536, 537, 538, 541, 543, 544, 545, 549, 550, 551, 556,557, 558, 563, 568, 576, 585, 586, 598, 599, 605, 606: n = A,T,C or G
  misc_feature 612, 618, 622, 626, 629, 630, 640, 641, 643, 649, 650, 652,654, 656, 657, 658, 660, 664, 665, 669, 670, 677, 683, 688,689, 694, 695, 700, 702, 703, 709, 712, 713, 714, 716, 721,722, 723, 726, 729, 730, 733, 744, 747, 748, 749, 755: n = A,T,C or G
  misc_feature 759, 763, 767, 768, 771, 773, 774, 777, 778, 780, 781, 786,787, 790, 794, 805, 813, 815, 816, 817, 818, 822, 826, 831,834, 837, 838, 841, 854, 857, 861, 862, 864, 865, 868, 871,872, 873, 875, 876, 878, 881, 887, 890, 895, 896, 898: n = A,T,C or G
gncgnnggnnggngangngggngnanngngnnggngggannggnggngnnngangnnnngannnaangangagtcgnannnnnnnnnanngggaanngnnnngnngntnnananagnnggatganggggnnangggaaantgggnganggggngnganangaagganganananagngagggaaagcagnggagngnnnnnngcgngcgnnnggaganngngtannganncnncnnngcgcncnnnncccangttngnngaaaccnccgttatgcggaaaacncggccctnngntnataggnnngaccccngggnncgnncccgcngggagnanngnaaanantaacggggnggggggggggnagnaaaattttttttcngatagnnnngaggancggnggnnntggggggggagcgcgnnagnnnaggaanccggggnattntgnggncnanngcgcngnagcncaggngcgnnggcgaagaaaggncantcaggantggcggaaagggcnnatgncgananggnggngngnnnnnnagngnnnaagnnnagggnnncgagnggggnaggggcgntcggggagnnggggaagagggnngtgganngagggnagtggngaancggnggnngcaccgaaanngnggaganngngngnnngngcanngggnncacgagncggggngggtnngagannggagncnngacagnacnnntnataannngcnggnnggngaacgaggagnggnnnaagganagcngggngggnngancnngcnntnnacggnnggngatnatgcgcgcggnaacggggngnnnngtgngagncgcgngangtnngtntggatgcacgcgngangggnntnnacngannnanngnggntagggngangaganngnggcgagctagangggacgagaggatggangantgtgngngannngngcaangcgnatangagtgcgncgagggggcnaannatgtnngtcggacgagngngacggacgnganncacgagcgngnngaggagcgtngggngggnacaactgggagacgcgcgcgaaggggtngannangaagtaacgtgngagacgagggggttagnannacagngagcgcagnggnnngangnncgngggnacgaggngnggnganncgcgc

SEQ ID NO: 8503 - DNA, 756 bp, Homo sapiens
  misc_feature 1, 6, 8, 9, 10, 13, 16, 30, 32, 36, 49, 51, 52, 60, 61, 69,76, 94, 104, 119, 121, 132, 140, 153, 161, 162, 166, 168,201, 230, 255, 264, 272, 275, 285, 292, 300, 306, 307, 311,312, 313, 321, 323, 324, 325, 326, 330, 333, 336, 337: n = A,T,C or G
  misc_feature 340, 341, 342, 349, 355, 361, 370, 371, 390, 393, 394, 395,399, 403, 405, 406, 407, 408, 411, 413, 415, 416, 418, 419,431, 434, 443, 480, 500, 525, 526, 536, 574, 577, 583, 584,588, 590, 592, 598, 599, 609, 610, 612, 625, 651, 658: n = A,T,C or G
  misc_feature 663, 695, 699, 714, 717, 718, 722, 730, 733, 737, 751, 756: n = A,T,C or G
ntaacncnnnttnccngagcatgatcccangncctnttcacctctgctntnncctgacgnngttgtatnagtaacngctattctaacagcctcngttcagacangatgtccaatggtgncntttttgcctgngctggggngcctcatgactgntggcccgnnggantnaactgcctgtgtactccaggactcatgacaatnctgtaactagacctgccgcaactcatggntcgtatgatcattctattggatctncaggggcangggagganganatccccattntgctacngctaatgngcaccnnctgnnnaaaagggnannnncganctnganntgnnncccatgnttaaanactctntgcaaggcnngcccgttcaaccatttctnatnnntccnacgnannnngtncntnncnnagactgattacnacntggtgtatntgggtagggcatgttccaacggggcctctctcatggntaatggggcatcggggaaancacagaatactttgccctttaatanngatgatacanatcaggatatccattactcacatgtgtctggcatgcantanctacgnngctncnantgtctnnctttctgganntnttttgaattgtanaaatgactttggccctaaaattcttngctcagnggctnctagctgtgtacaccatttgaacacatgtttnaaanaatatcccacccacnctnncttngcttcagnctntggncaggtatgaacctnttcan

SEQ ID NO: 8504 - DNA, 808 bp, Homo sapiens
  misc_feature 1, 28, 71, 73, 82, 84, 85, 90, 91, 109, 112, 117, 118, 140,141, 143, 149, 161, 163, 171, 176, 178, 182, 192, 212, 715,726, 733, 741, 751, 776: n = A,T,C or G
nctatccttcaactcttgtcttttgcangatccctcgttcccctccgcacgagaattaattaatgggcccngnttaattgcntnnctccnncaaaaggaaattattggngcnaattnnccggccaccccacagaccgggnnangataanactgtgtaaccngngcttgtgncaaananctanttttcagaanctccagggaactcaattcancaggaaaaataattaatcccaccaaaaagtgggcaaatgacatgaatagacatttctcaaaagaagatatgcaaatggtcgagaaacatatgaaaaaatgttccaccatccctattcattagagaaaatgcaaattaaaaaccacagtgagattatcagcttattccgtctagaatggccattattagaaagtcaaaatacaatagatgtttgtgtggatgtggtaatgcttatacactactggtgggaatgtaaattaatacaacctttatggaaaacagtatgggagattccttaaagaactaaaagtagatctaccattcaatccagcaatcccactactgggtatctatccaaaggaaaagaagtcattatatgaaaaaagacacgtgccacaccttatctttattgcaggacccatttcacaattttccaaagatattggaaccccaccttaaatgccccatttgacccaatggaggtggaatataaggaccaaccgntggttgtattntggtatnataccccncccattgttnatactaccttcagccccttaaaaangggaatggaagttaatgttggtttttgcacct

SEQ ID NO: 8505 - DNA, 1425 bp, Homo sapiens
  misc_feature 2, 6, 10, 12, 21, 28, 33, 36, 37, 38, 39, 43, 56, 59, 60,62, 66, 69, 72, 75, 77, 78, 79, 84, 85, 88, 96, 98, 102,103, 106, 107, 109, 110, 111, 112, 114, 116, 122, 126, 138,144, 145, 156, 157, 163, 164, 168, 170, 172, 174, 177, 179: n = A,T,C or G
  misc_feature 195, 196, 198, 201, 207, 209, 218, 221, 223, 233, 236, 244,247, 255, 266, 267, 274, 275, 276, 278, 292, 294, 297, 298,299, 305, 308, 311, 313, 318, 331, 335, 339, 345, 347, 348,356, 359, 363, 373, 375, 385, 386, 389, 391, 403, 408: n = A,T,C or G
  misc_feature 413, 414, 418, 419, 420, 423, 425, 451, 453, 455, 459, 465,466, 470, 471, 475, 476, 477, 480, 484, 485, 497, 498, 502,514, 516, 517, 518, 519, 523, 524, 526, 527, 528, 531, 534,540, 544, 545, 547, 552, 554, 558, 560, 561, 562, 563: n = A,T,C or G
  misc_feature 568, 569, 580, 581, 583, 585, 595, 599, 600, 601, 606, 618,619, 621, 623, 628, 643, 651, 658, 659, 661, 662, 666, 669,672, 694, 701, 702, 703, 706, 709, 715, 718, 722, 723, 727,730, 733, 735, 736, 737, 744, 747, 750, 754, 756, 759: n = A,T,C or G
  misc_feature 762, 768, 772, 779, 783, 784, 786, 790, 792, 802, 815, 820,823, 825, 832, 847, 850, 852, 854, 857, 859, 867, 872, 879,892, 899, 907, 914, 915, 918, 922, 932, 937, 939, 940, 942,944, 948, 949, 954, 957, 958, 959, 961, 963, 967, 970: n = A,T,C or G
  misc_feature 977, 985, 986, 987, 988, 990, 999, 1002, 1020, 1036, 1038,1048, 1056, 1063, 1075, 1093, 1098, 1099, 1101, 1103, 1105,1117, 1122, 1124, 1138, 1144, 1148, 1149, 1152, 1154, 1162,1166, 1167, 1172, 1175, 1179, 1181, 1187, 1188, 1190: n = A,T,C or G
cnccgnaacnanaatggcganagagctngtaanccnnnngcanattcatctgcggncgnncnccancgnaanaangnnncacanngangtgccaancngaannaannannnntngngaaccntggnagaaccccacangaactnnaaaagcggccnncccagnncaancngncnggngnggggggagagccgaanntncanggtcananagcagccgntancngggcccgagngcnatagcagnccnagtgggancgatattctanngggcccnnncnaagctgggggccantnacnnnttgcgnggnagntnagcanaggcccgtgggcnagcncagntggtcnanncggagcgnccnaccnaagaatcggngnagcaaacggnngcnancgaggaaccaangggcnggcgnnaaannnatntnaacaagggtaatgaaaagaacagggntnanggangaaaannactnngggnnnggnagcnnggccctgaccanngaangaaagtggggcngnnnnccgnnannnggncgnaaagcncccnnanccccntnctgnannnnggacnnggctagccaanntncncctctcacgngcgnnnctgcnaatcgcatgcgnngngngggtngcaacagcgagaccnccatcacnccctatnncnncgcncanctntacgatcgctacatccacggtntatagcnnnctngtngcgcancgnacgnnggcncanggngnnnacttgcnggntcncgancngcngangggggncaanaagacgnctgnncncgcncnctatacatcncacaacacacgcngaaanatngngagtgancgggaaaaacacacngtntncncgnanacgggaanacatncggactnacacacatcgcangactganggcgggancgcacannagngcangagacagaangtgcntnncncncgannaggcncannntnangaanagntgacagnaccacacnnnncnctgtcacanccnatcgcgcacactatagcncacgcgacatacgaancncataacgtgnacacatcnccaccgnagagatcacacnccagactctagagaacgnctcgnngnancnctcaacaggagnagcancnccgcgggagaagangagatncccnnctncntccctgtnagcnngcgcnaantgtngncacggnngnganccgcnagancncgancnnnacgcnnnngngntncnangncnngcnnagcnacttaacgtcgcccanccgntatntgcacanacnacnnntntntaanngcgacgnccganncncangnaagtcnngnanagcgctangagcagcancgacatgtngccncgnaccgcccnnntatannacncncatcgcntcaacanngagagaatgcgagctgcnntctgtaanctcnccg

SEQ ID NO: 8506 - DNA, 1125 bp, Homo sapiens
  misc_feature 3, 5, 6, 11, 12, 13, 14, 17, 18, 19, 20, 21, 22, 23, 24,25, 26, 28, 31, 32, 33, 34, 36, 39, 41, 42, 43, 44, 46,48, 49, 51, 52, 58, 61, 62, 64, 65, 69, 70, 72, 73, 77,79, 83, 85, 86, 87, 88, 89, 93, 94, 96, 101, 103, 106, 107,110: n = A,T,C or G
  misc_feature 111, 112, 116, 119, 121, 123, 124, 125, 126, 130, 133, 134,137, 139, 141, 143, 144, 145, 150, 158, 160, 161, 166, 169,170, 171, 175, 178, 179, 180, 182, 185, 190, 199, 200, 201,205, 206, 214, 215, 225, 230, 236, 252, 256, 258, 259: n = A,T,C or G
  misc_feature 265, 268, 269, 275, 276, 282, 291, 292, 299, 300, 303, 305,307, 312, 313, 319, 323, 332, 345, 354, 357, 358, 360, 363,365, 367, 371, 382, 383, 384, 385, 386, 391, 399, 400, 402,403, 409, 416, 418, 422, 426, 432, 457, 458, 460, 463: n = A,T,C or G
  misc_feature 467, 474, 477, 481, 483, 484, 491, 494, 501, 505, 521, 522,530, 544, 552, 557, 559, 563, 568, 589, 602, 604, 606, 615,616, 622, 626, 643, 644, 648, 654, 656, 666, 669, 679, 682,686, 688, 699, 708, 722, 723, 730, 732, 733, 743, 747: n = A,T,C or G
  misc_feature 754, 756, 760, 783, 786, 788, 791, 797, 798, 808, 818, 819,823, 825, 831, 838, 843, 847, 849, 858, 865, 867, 873, 882,890, 895, 905, 906, 910, 911, 912, 916, 920, 929, 932, 935,940, 942, 943, 945, 955, 959, 971, 978, 981, 994, 996: n = A,T,C or G
  misc_feature 997, 999, 1000, 1001, 1004, 1010, 1012, 1013, 1019, 1021,1023, 1026, 1030, 1033, 1037, 1045, 1048, 1053, 1056, 1057,1060, 1062, 1063, 1064, 1070, 1071, 1075, 1078, 1089, 1096,1100, 1104, 1106, 1109, 1117, 1118, 1119, 1120: n = A,T,C or G
cancnnccccnnnnaannnnnnnnnngngcnnnnancgnannnngnanncnnccccanccnncnngccnncnnccangnaacngnnnnnccanncnacgangnccnnccnnnccangangncnnnncgcncannccncncncnnncccgncaccgcgncnnacacnccnnngacncannngngtntcacnaactcgccnnncacnncagcacanncacccccacntcgcnctccanacccgacgcaccacanctcngnnaggcanccnntttgtnntcgggnaaccccctnncgcagcnnccngntnggacnngcccanaccncgcagaacncacacaagcggcnacttcagcngcnncngangnangacnggggcacagannnnntgaanaagacaannanngatccncggtcangnggcnagcnaggccnagcccgaccacggagcataagcgtnnanaanggcnagcactntcncagntnngaagccngcnagacctnggcnatataaaatagcacgnngacacggncaggagcagagggngtgcgagnagganangacnaggancggcaccaccaatcagaaaancagaccagcacancntnaactgagcnnaggctnatgnagccaggcactatactnngagnggagcntngaaagacacncanaaaaagacangangccnanaaggctaaggncagcggctnatagcccgtaaacnncggcacntnngagagaccangggnggagcancnaagngccagggagtgccgagcaccagncangngcnaactanngggggacaancccaaccatnnacananaagacnaaccacnagccngaangngggggggcnccacacncngcagcncaggccaantctggganggacnacagcggggnnaaannnaccngganccccggganagncanggccngnngnagagccaatngatncgggccactggncccacancgnccggcggcgaccncnncnnnaanagacgncnncaccanananctncgcnctnccancccggcgngcncccanatnncangnnncaagannccanacnccgcccaaagnccacccncgcnccgngnccncgggcccnnnncccct

SEQ ID NO: 8507 - DNA, 763 bp, Homo sapiens
  misc_feature 2, 3, 6, 7, 17, 423, 520, 585, 597, 610, 647, 662, 663, 671,682, 696, 704, 706, 715, 716, 717, 721, 752: n = A,T,C or G
anntcnntttgttccanacccgaattccgttgctggtcggtttcttaacatttctagttgtctgcaaccatccctgtcttacattacattattaagttagttctattacaagactaatgaatgacagaatagagcaaacatggactttggagtcagacagacatgagtcagataagagttcaaacccactgactgccgtaaacttgggcaagagatttaaccctgtcagggcctcagtgtactcattagtaaaggtaataataagtctgtaggaaataatacctacatacttacatttgacatatatttaatgctccagcttaataaggttggagtattcgataactgataaaaaaccttgcacagtattgagcaggtaacagacattcagtaaatggcagtaccattccgatgatactttanatgcttgtgtgctatactgttcaagaaccagctggaaaagacctcaggttacctccagggtagggataacatttaccttagagtttttgttttttgnttttttgagatggagtctcgctctatcacccatgctggagtgtggtggcacaatctcactgcaangtccgctcccangttcactcccttntcctgcctcagccctcccgagtagctggggactaccnggcacccgccaccannccccagcntaattttttgnatttcttaagtagnagaccggngntttcattgnnnttancccaggatggtctcgatctcctgacctcgtnaatccgccccc

SEQ ID NO: 8508 - DNA, 754 bp, Homo sapiens
  misc_feature 1, 2, 3, 4, 5, 6, 13, 16, 538, 567, 612, 655, 664, 706, 745,754: n = A,T,C or G
nnnnnnttttacncgntcgattccttgctgtcggccaagggctccactccagtcccttgcctgtcaatcagaagatgctcagaggagagcttctgcatcatcttcatcttgacattccaagagcagtaccgggtcagcatccacaaaagcacactgtaaaactgggaactgtgtcttacccttcctgagtgaaaagggaaagtttatgcctcagcctgaggcaggtgggccccttgccatgcacacctttgtcctgcagccagggatccacttggctgggctcaacccttccccgtcagggacgactgcacagaaaggagcgcggatagcagcaaggcccgccacggggaaggcctgcttctgtgggtccccctgtgtggctggcagggagtggtacggcgctgggagtccagaatcactgaggacacggaaagcttcagcttctttgagaaaactcagattttgtaaatgcgcatccagttgacagcacttacggtggaatccgtggagttggacttgtgagaagccttgccctganggggttcttggctggtgtctgtcctggangtggatgccttgatggcttgtgtctcccgtgctcccctcacccangtcctcatcctcaggactgtgagacgccgtttggaccttggangagcctgangagctcttggctctgtgggtatggtctgctggcatttgccantttgaaacctgaaggattggaaaatgtctgtataccaanttccaaatn

SEQ ID NO: 8509 - DNA, 752 bp, Homo sapiens
  misc_feature 1, 2, 3, 4, 5, 6, 15, 20, 629, 680, 685, 693, 696, 706, 713,714, 715, 717, 727, 731, 732, 733, 734, 735, 737, 738, 740,741, 742, 743, 744, 745, 746, 747, 748, 749, 750, 751, 752: n = A,T,C or G
nnnnnntttactcgntcgantccgtgctgtcgccttgaatatgtaaaaatacctatcatatcagtgtaatactatcttaacaatcctaaaaaccaggaaagaaaagcaaaatacagccaaatcaatgtcaagaattcttgggaaggctgggtgcagtggctcctgcctgtattctcagcattctgggattacacttgagtccaggagtttgagaccagcgtgggcaacatggcaaaacctcatctctacaaaaggtacaagaaattagcaggcatggcggcgcgtgcctgtagttccagctatttgggaggctgagttgggaggatcacttgagcccaggaggtgaaggctgcagtgagtcaagattgcaccactgtactccaccctaggcgacagagcaagaacctgtcttcaaaaaaaaaggaattcttagaaatatacaccagatattaccatacatatgaaactcatatatagagggttataaacttttgcagatcatttacctgcaacattgttgattttactccatgaattctctattcacattgcatcatagtacacacacctgcaacccaaatataagtaattcctagacagctttgatacatccccagagattttatgtncaattcatccagctaaaaaaaaaaaaaaaaaaaattcctggggccgttttntacgnaaatcccnccntgataagaanccttggnnnantttggacaancccnnnnntnnannnnnnnnnnnnn

SEQ ID NO: 8510 - DNA, 1601 bp, Homo sapiens
  misc_feature 2, 4, 5, 6, 7, 8, 9, 10, 11, 12, 14, 16, 18, 20, 25, 28,32, 34, 35, 39, 40, 42, 45, 49, 53, 58, 60, 64, 65, 66,69, 76, 77, 78, 79, 80, 82, 83, 84, 85, 87, 93, 96, 97,99, 100, 103, 104, 109, 111, 112, 113, 114, 115, 116, 119,121: n = A,T,C or G
  misc_feature 126, 128, 131, 132, 133, 135, 147, 152, 155, 158, 159, 161,164, 165, 170, 183, 195, 198, 211, 215, 220, 225, 242, 247,249, 259, 263, 278, 291, 301, 310, 315, 316, 317, 319, 321,328, 333, 336, 339, 340, 342, 345, 350, 352, 370, 375: n = A,T,C or G
  misc_feature 380, 385, 387, 390, 403, 411, 413, 415, 426, 428, 429, 435,436, 440, 443, 447, 448, 457, 458, 464, 471, 472, 479, 489,495, 504, 505, 512, 517, 518, 528, 530, 534, 536, 538, 541,547, 554, 556, 557, 569, 570, 573, 574, 584, 604, 609: n = A,T,C or G
  misc_feature 612, 615, 619, 621, 628, 633, 640, 650, 657, 658, 662, 663,672, 677, 682, 683, 693, 695, 696, 698, 699, 704, 708, 710,715, 717, 723, 732, 740, 744, 747, 749, 751, 752, 754, 762,764, 771, 772, 773, 777, 779, 780, 781, 791, 799, 806: n = A,T,C or G
  misc_feature 808, 815, 817, 818, 819, 827, 829, 830, 843, 852, 854, 855,856, 861, 880, 884, 887, 888, 894, 899, 909, 929, 933, 935,947, 948, 952, 963, 969, 971, 972, 975, 977, 981, 983, 992,1001, 1002, 1004, 1006, 1010, 1016, 1018, 1036, 1039: n = A,T,C or G
  misc_feature 1043, 1045, 1047, 1052, 1053, 1060, 1065, 1066, 1071, 1072,1079, 1083, 1084, 1087, 1089, 1099, 1100, 1101, 1102, 1104,1118, 1122, 1127, 1130, 1133, 1134, 1136, 1153, 1155, 1156,1161, 1163, 1166, 1170, 1182, 1184, 1190, 1191, 1195: n = A,T,C or G
cncnnnnnnnnnanancnanacacngcnacancnngcgnncngcncaanagangaacncncgcnnngcnggcccgnnnnncnnnncngacagncgnncnngannacggncnnnnnnggncnaccananccnnncnccgacccccccngagcnacnacnncncannaaaanggcttggaccctntggaagccaagncgnagggaggaaaaantggngcccncggcncgaggggacagcagagncgagnanggtgagacgnggancgaaggcccagggangggcaaggaaggngagacggccnggtcagaangaaannnangngcgaggnagcantgnacnngnccnggagnanggaagagggcccagccgngaagnagccncacangngcnacagcccctgganatgcgtgngnanaaaacacgganannggaccnnactnggnaccnncgactggcnnggcacngccaaanncgccacnggcaggaacnaccacnggggcacanncaggccngagcnnaaggacatcnanacgnangnaanacccgngggacgngnnaaagtaagacannggnnaaaagacaanccggggagggaagaggcggncgcanggnggngcananaagcaantttcnaccgatnaaccgggggngcacaannaggnngggaaccancggcngaaanngaaaacgatngnncnnggggnaagnanggccnangcaacnggagaaacnaccacggncatntgnancnnangaaaaccncngggcaannnccangnnngggcaaacgnggggcacnacgggcngnaccatgnannnaggcctcngnnggggcgccaaaanagaatcggncnnnggganacgcaaagaccgctcgccncagnggnnggaaanaacanaaaaggggcnccaccgggacaaaaaatcanacancnaaaagggggagnnacantctcggagacncgaacnannacnancaangntcaggaacntggggccannananggcnaaacgnangacccacacggggggganagncacncntnagggnntaaaaangacannacaanncgggganaggnnacncnccgggccaannnntntcgggggcccgaangagncaaangcnganntncaacacgcgaaaggggngnngcgcncnccnaaanaggggggaaacnantcacanngggnacaaagcgcgnganctcgnggcgccnangggaaaggngcanngcagnggagtagngcaacacgngcaaaangaaaaagngccgngaaagggccgcggnnaacacagaatncacganaaaaggncngaagcnnnnancnnnggnnatncnaaanaanaangngnncncgcacnncacagganngggccnngcccgcgagagaaangnangccancacagagnggggaccttcnngngggaaccncantggggngcaaccnnnnacaaancagacnngngacngaannncgncacngcnnaccnnggngaaacccntcaanannggccaaaacnnananccnangggagggnnccntananngggccccaaaaaanaanngccnnncagaancnaanccccggncgnn

SEQ ID NO: 8511 - DNA, 746 bp, Homo sapiens
  misc_feature 1, 2, 3, 4, 5, 9, 656, 657, 658, 659, 660, 662, 663, 664,665, 666, 667, 669, 670, 671, 672, 673, 674, 675, 677, 678,679, 680, 681, 682, 683, 684, 694, 696, 699, 701, 715, 716,717, 718, 719, 720, 726, 727, 728, 731, 739, 743, 745: n = A,T,C or G
  misc_feature 746: n = A,T,C or G
nnnnntttnaactcgttcgattccgtgctgtcggtgggatggctccccctatgaaagttgtccagtgagcagggtcaaggtttaggtttggggtacggacatgagtgcaggagccttactctcctgtgtgttgtcagggatggataaaggggatgaagttggaggggtttagtgaatggttgggacagcaaatttcagagaagagcatttggaaataattttctcaaatatatatttttaaaatccatatttgatttttttccctcagggattcccaagcatagtagagctaaaatgaattaatttgggtaaaagtaaagttaaggctaagttaggaaacacttttaaaaacaggaacctgctgcgtgcggtggctcctgccttgtagtcccagcactttgggaggcagaggcgggtggatcgcctgggatcaggagttcgagaccagcctggccaacattgtgaaaccccatctctaccaaaaatatgaaaattagctgggtgtggtggcgcatgcctgtggtcccagctactcgggaggctgaggcagaagaatcgcttgaacccagtaggcagaggttgcagtgagccaatattgcgccattgcactccagcctgggcaacagagcaagatactgtcttccaaaaaaaaaaannnnncnnnnnntnnnnnnncnnnnnnnnaaaaaaaaantnttncnggggccttttttcnnnnnncccccnnnttnaaaaaccntttngnn

SEQ ID NO: 8512 - DNA, 743 bp, Homo sapiens
  misc_feature 1, 380, 397, 403, 407, 419, 466, 479, 518, 522, 533, 543,545, 559, 588, 593, 612, 617, 621, 626, 636, 641, 664, 668,671, 672, 689, 704, 705, 706, 719, 721, 737: n = A,T,C or G
nttttactcgttcgattccgtgctgtcggtgcagtggcacatacttgtagtccaagcttcagaaaggctcaagtgggaggatcgcttacacccaggagattgaggctgcaatgagctgtgatagtgccactgcactcagcctgaatgacagagggacaccctgtctcaaaaaaaaagtcagtttctcacttggactaactactttttaactgttaatagctggtggctgccatactggacagcccaagactagaggctcaatgggctgttctccactctctgtccaagggaaccttcctttatgtgctttttgctttcaagatggggtcttgcactccagccggggcgacagagcaagactccatctcaaaaaaaaaaantaattaaataggccggntgtggnggcncaacgtttatantcccagcactttgggaggccaaggtgggcggatcacgaggtcagganactgagaccatcntggccaatgtgaaaacccgtttttactaaaattccaaancaanttacccaggcntggtggtgcncncctaaagtcccagntaatcaggaggttgaggcaggaaaatcgnttganccaaggaggcaaaggctgntgcantganccaanatcatgccantgaantcaaccctgggtgacaaaatganactntgnntcaaaaaaaaggataancttaaaaaaaaaaannnaaaaaaaaaattntnggggccttttttcccnaaaacc

SEQ ID NO: 8513 - DNA, 833 bp, Homo sapiens
  misc_feature 174, 176, 182, 187, 210, 377, 387, 416, 420, 428, 429, 445,453, 455, 514, 517, 519, 520, 521, 528, 529, 530, 532, 544,547, 548, 550, 553, 563, 567, 568, 570, 571, 575, 577, 578,580, 581, 583, 586, 591, 595, 597, 600, 602, 603, 604: n = A,T,C or G
  misc_feature 606, 608, 611, 614, 619, 620, 623, 624, 630, 637, 644, 646,650, 655, 656, 660, 669, 671, 679, 680, 698, 699, 706, 711,717, 724, 732, 733, 737, 739, 746, 748, 753, 754, 755, 757,758, 759, 761, 765, 767, 773, 774, 777, 780, 784, 794: n = A,T,C or G
  misc_feature 799, 800, 803, 810, 815, 816, 819, 820, 824, 827, 830: n = A,T,C or G
tgctgtcgtcttggagctttcatttactaatgaggaacaaatgatagtcatgttatgacaatgtgttataaattaacaatcctcttttaaactagatttataaaacctacacacttgagggtttccatttgttctatctagatgtattttgagaaatctgaaacaaaagcttgntnttttgnttgtntgtttgttgtttgaaacagtctngctctgtcacccagcctggagtgcagtggtgcgatcttggctcactgtaaactcggcctcccagattcaagcgattctcctgcctcagcctcctgataagctgggattgcaggcgcgcatcaccacgcccaacataatgaaacctccgtcttctactaaaaatacanaaaaaattancttgggcatggtggcaggccgcctgtaancccngctactcnngaggcagaggttgcantgagcccnanagtctgccattgcactccagccctgggccgacagcgggagactcccgtctcaaacaaanatnannngactaannnantaaatttccccnggnnantcntaaaaccctncatnngnntttntnncnncnaanttttntccncnctnannntngnttnaanccttnnccnntttttnacgaacnctgctancncaantatgnntccntctttcccnanaaacaatnntggccaattcccccatgnncctattnccacncccttntaaatanctcccctnnaaantngaactcnanttccnnnannncntttncnctccgnnaanctnttcntttctaaaanaattnncgngctctgntcttnnccnnccantcncancct

SEQ ID NO: 8514 - DNA, 735 bp, Homo sapiens
  misc_feature 1, 2, 3, 4, 5, 6, 11, 16, 107, 734, 735: n = A,T,C or G
nnnnnnttttnctcgntcgattccgtgctgtcgatttttcattatgtctacggaggagtgtctctgttatatcagtaggaaatcaagggggctttttcagagactgngttggttcctttcaaatatttgaaacactgacagaaggagacattttagatttcctcaaagtttacactgcccagttttggggggaggcatgcctagtttctttgaaactggctatgttttccttaatacctgatttgcctttctctgtaatccttaaaataaaatttgttaaaagtgttcttcattatggaaacaatatatatgtggtaaacagtatagaatggcatacctcattcatacttctccttcccagaattaagcactttattctttttctgatgtgatagtttctttctcttagcaatatattttcttctgtttcttgctatcactttatatatgtaattctatttcttgttattacgctaatatatataactacctggcattatgaatttgactcacttaacgagaaatgttctaggtgtttacatggtccagaattagtttgtgttagggatccaggactgtgagtactaaaaacttgatttgtgtgtaggctacaaatgaaaaagttaacaatgactttttaagagaaaacaaatgtagaaaaaacaaaaacacagtctggctcggcctcccaaagtgctggggttacaggtgtgagccatggtgcctggccaaann

SEQ ID NO: 8515 - DNA, 769 bp, Homo sapiens
  misc_feature 1, 3, 5, 6, 7, 8, 9, 473, 589, 627, 635, 645, 666, 675, 677,696, 710, 716, 724, 733, 734, 735, 741, 743, 744, 745, 755,761, 765: n = A,T,C or G
ncncnnnnnttttgaacccctttcgattccttgctgtcgctcagggcacagcaggcagtgtgttagccttggtctcccttgccctccaagtcccacagggcaatactggcaggcccaggaaagtgttacacactgcaggtttgcatgacggctaaggaaccacaatcttagggagatactatctctgtcttctaaggccatttgctgtacaaaaatccttgaaatacctgggcacagtggcacacctataatcctagcactttgggaggctgaggcaggcggatcacctgaggttgggagttccagaccagcctgaccaacatggagaaatcccgtctctactaaaaatacaaaaattagccaagcgtggtggcgcgagcctgtaatccagctactcgggaggctgaggcaggagaatcgcttgaacccaggaggcggaggttgtggtgagccaagatcacgccgttgcactncagcctgggcaacaagagtgaaactccatctcaagaaaaaaaaaatccttgaaatagtctggaacaaaatctgtcaacatctcagcccacaaaagtatcaacaaaattgatatttngctgcatttaaaaaattttaaatggtggtcaaagcgtncaaaattntgacaatttnagacaccccccatgagacacngaatttatntncccaataaaaattggtctnttaaaaaacctggnttcccncaaatatnggaaagggnnnaaaaantnnnaataaaaccntgtggngtcnaatt

SEQ ID NO: 8516 - DNA, 1145 bp, Homo sapiens
  misc_feature 17, 193, 237, 245, 292, 293, 294, 310, 315, 317, 320, 323,326, 328, 344, 345, 355, 358, 360, 361, 362, 365, 367, 378,383, 384, 388, 390, 392, 399, 401, 403, 409, 419, 420, 423,428, 435, 437, 439, 440, 452, 467, 470, 480, 492, 496: n = A,T,C or G
  misc_feature 509, 519, 522, 525, 527, 528, 538, 541, 542, 546, 547, 549,550, 556, 561, 564, 567, 580, 583, 602, 605, 619, 629, 631,642, 648, 649, 650, 656, 659, 661, 662, 667, 675, 676, 683,684, 697, 700, 706, 714, 732, 733, 737, 748, 758, 760: n = A,T,C or G
  misc_feature 763, 765, 766, 768, 769, 775, 785, 793, 794, 797, 798, 804,808, 817, 824, 828, 842, 843, 844, 852, 856, 861, 862, 866,874, 876, 882, 884, 889, 898, 902, 910, 917, 923, 929, 931,953, 968, 992, 995, 998, 1003, 1008, 1014, 1020, 1022: n = A,T,C or G
  misc_feature 1030, 1031, 1036, 1038, 1047, 1048, 1056, 1057, 1066, 1079,1085, 1091, 1094, 1118, 1122, 1127, 1129, 1132: n = A,T,C or G
gctgtcgcacaactggncagtggcagggctagggatttgaaagcagttcttttccattttggttgttggtgactcaaagtcattctgaactttcagaattcaggtggttgatggggtggggtgggggtgtcagtatgcgtagctcaggccactagactggtctgcgtgtcaggatggccttgtccgttgctgnatgcttagcacatggggacacgtggcagctgcttagtgaagagntgtagggnggatggatgagtggatgggtagatgggtggatggataggtggatagnnnatcggcccccccttcncttcngnccnaantcntntttcactattcttctnncatgtccctntcnannnctntntcttcctctcnacacnntttnantntctcccncncntccatncctctctttnnttnccctnccctctnancnntacccttcaatnccaccctccttctanccncttctccccnctcttcctcctnatcntctccttctatcntccatatcanacntcntnntctatcctcnacnnctcnncnncctccnctccntcntcntacccttatcccnacncatctctctctctactacnctnttcctctatctatncttacctcancntaccatatctnatcacnnnctatcnccntnntcttntctctctnnaccctcnntcagccttctctntantctccnccatctcntttcataccctccaatcnncttntccactcctcnctctctcatncnccntnnanncacctncatctctcanccattatnnctnntacctnctcnctacccctntctacantctnatcactcttctacnnncatcctcncctncctcnntctncacttctncnctctcncnctccnctctctatnatcnctctatcntctctcnactctnttatancngcatcctcttctctccctctcnacaactcatctcctntcctctctctcacacactctctcntcnctnatctnctcgnatatcncacctncncactctanncttcncnactaatctnntcaaaccnntctccactnctactatcactcnctcatnaatttntcnctctctcccacacatcatatccanccantctcnantcnctccatcctctct

SEQ ID NO: 8517 - DNA, 1500 bp, Homo sapiens
  misc_feature 2, 6, 10, 11, 15, 18, 24, 25, 26, 27, 28, 30, 31, 33, 44,45, 48, 50, 51, 52, 53, 57, 59, 63, 65, 66, 69, 71, 72,77, 78, 80, 83, 84, 87, 88, 92, 95, 96, 98, 99, 101, 103,104, 106, 108, 111, 113, 114, 118, 120, 123, 127, 128, 130: n = A,T,C or G
  misc_feature 131, 132, 135, 138, 141, 143, 148, 149, 152, 156, 163, 168,170, 172, 182, 184, 185, 186, 187, 190, 198, 200, 209, 213,217, 218, 235, 247, 248, 257, 262, 274, 283, 288, 293, 305,307, 320, 322, 323, 327, 332, 333, 335, 336, 337, 341: n = A,T,C or G
  misc_feature 344, 348, 353, 355, 359, 372, 375, 379, 382, 383, 385, 392,396, 397, 403, 407, 410, 411, 413, 419, 421, 425, 430, 436,440, 446, 450, 451, 452, 454, 464, 473, 480, 483, 490, 500,507, 514, 516, 517, 523, 525, 532, 535, 550, 559, 562: n = A,T,C or G
  misc_feature 563, 569, 570, 573, 577, 585, 587, 590, 591, 600, 602, 604,606, 608, 609, 610, 612, 619, 621, 623, 631, 632, 634, 646,649, 653, 658, 664, 666, 668, 673, 681, 685, 697, 698, 702,707, 710, 711, 715, 726, 727, 728, 740, 742, 745, 746: n = A,T,C or G
  misc_feature 751, 758, 763, 764, 772, 773, 777, 785, 787, 788, 791, 799,801, 804, 812, 818, 823, 831, 834, 836, 839, 842, 843, 847,849, 850, 851, 856, 866, 868, 871, 873, 880, 882, 885, 889,890, 891, 892, 904, 917, 918, 920, 926, 938, 946, 947: n = A,T,C or G
  misc_feature 948, 953, 957, 959, 961, 962, 978, 986, 990, 994, 998, 1011,1012, 1014, 1015, 1018, 1021, 1024, 1029, 1030, 1036, 1037,1041, 1045, 1048, 1050, 1071, 1073, 1078, 1080, 1087, 1096,1112, 1114, 1116, 1126, 1135, 1140, 1146, 1147, 1149: n = A,T,C or G
cnccgngcannacanacncacgcnnnnnanncncgaggacacgnnacncnnnncacnancacngnnccncnngcacnnanccnnccnngcgnacnncnnancnncnancananncgangncanagcnncnnncangcncgncncacannccncacngaagcanagagnananaccacggccncnnnncanacccgcangnacccggagngcgngctnngggaaccccttttacgnaagacccctggnnggaagaggncgcgngcaggctaccancgggcacgnaacgnagacncaaccgacatcngnaccgggggaggancnngggncacgnncnnngccnggnaagnaggangnccgnccccgaagcgacnccngccnggnngnacggacnaccnnagcacntcanganngngcacgncncagngcgangacaancgcncaccgncacnnncngccgacgggngggaagacnccgaccnganagcgccnccccagatgnggaagcncgagcgncnngaagcnancgcaccnggncgggccccccagggncgcagggancgnnccacannaancgcngcccaggngnagnncccggcacnancncngnnnanacaggcncnanggacagcnncncggaacaggganagngggncacgngaacancngncaacncggcgaancccncggcgccagacnncacnggggnccnngcancaacctagcgnnncacggaaacgcncnccnnggaanaccacgnccacnnacgccgcnnaaantgcgaccngnncgnacacgaangnacnggggcacnagcacnactcngacagcanagngngcngcnngccncnnnagcgntcgcgacacnanagncngacgggncnggnaaannnngggagagcgaanaggcgggcacgcnngngaagcnggactacggccnccgggacnnnccagngagngncnntcgacacggggggggnccacacancacncacncggngaaccgccacacnnannccnccncgngggcnncgacanngcanaccnggnanaaaccggggggcccacccatngnggcanancaccaanggggccggncgcgccggaaaccccncngncgggcacgcncgcaaacgncatangacccnngnncgcgccnggacgnnganggacancanggcncggcaccancnnanatnngngggcacacggcgcaacccccacgnacggncnnaaagnggcacanancnggngnngcangctncacacgncncancngnctcgaggggncgngcacanngggatcagaccgncaccnngngncgcnccncgggngnntnnncccnctcnctnganaacnngcnnnnanaggggggcccacacngacnaanggggcgacgcgcncnntacggggggcacanacnagncgnccagccgnncaccannaanaccacggggnnacgcganaaacnacagnnnccnnnnctcngnggnacaaacct

SEQ ID NO: 8518 - DNA, 749 bp, Homo sapiens
  misc_feature 1, 2, 3, 4, 5, 6, 28, 35, 54, 65, 327, 375, 403, 456, 463,706, 714, 721, 724, 739, 740, 749: n = A,T,C or G
nnnnnntttttgaacatcattcaatccnttgctgncggttgtgggccaggaaanaaccagcacanggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcanccgtccagatgtttgcaggtgaattcctctgcttgacatcctccctgncactttggaccctatgggagtgggcatntccacgcacctgtgtatgtgaaagtcattttacatttcaaagcagtgtgtgtntcttatntctatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaaatctccttctctaaaaaaaaaaaaaaaaaaaattcntggggccnttttttnctnaaacccaaactttannagaaccctn

SEQ ID NO: 8519 - DNA, 767 bp, Homo sapiens
  misc_feature 1, 2, 18, 474, 568, 604, 615, 631, 682, 714, 749, 766, 767: n = A,T,C or G
nngtctttttgaacccgnttcgaattccgttgctgtcggaagggtgctgctattgggtctatggaagcttatctatcaaaggagcaaacatccagaaaagtgtttataaagcaaatgtattgcctctgtttagagatttgcccagctgttccagttttaaacattaaaaaataaactcagttgccatggcaaaaatagaatgcacagcttacttataattttccatgcagtatagcataaggatttttgacttgaaacaaccaaagaactcctccttaacgagacagttcaaattcctgaattagtatttcttgactatcaacttaaagaatggacttcctagtacaatgttgcacttatttttctttctgaaataattctgcctgcatgtatgtgttgtgttttagcttctccccttaccccaccccaaagatcttttcttcctaatggttaatgtctcaactcggctactgnttactatcagatggtttttcattagtgaatttaagacctctttgagaaagcttgtatataaaaagttaacagatatattttatggaaaaacccntcttattttcaaatatatttaactgctgttatattntattagagganggttgtaaatattttnctaggagttctattgtaaaagaaaaagtattttttgaaaaaaaaattaatngtaataaaaaagggaaaacctttttaaatagntgggttggcgattgcttcctggttctgggctttcnttatgtcctatttttcnn

SEQ ID NO: 8520 - DNA, 747 bp, Homo sapiens
  misc_feature 1, 2, 3, 5, 15, 18, 49: n = A,T,C or G
nnncntttttgaacncgnttcgaattccgttgctgtcgggaccattaancctgcctgggtttgaatcctagcattgtcatttacaggtaatatcatcttgggcaattcatctataaattgggataataataccaaattggaacaataatgataggttagttgtaatgattaaatcaaataatgagagtaaactcctggagtagtgactgacacatggcatgtaataaacatttttctttctacgaggtattgatatttattaacctcttaaaagcaatttggactccctttgtctcttattgtcctgtgacagttaccatgagtgcattctcccatttttgtttaccagatctgccccaggaactttttaaaagattgatttctttcttttgaaaataaaacaaatatgtgaaacatactgaaaatgctaaaacctacatgagagtattagaaagtaaagaatgtaattctataatcagctacatatggataggcagagagaggggtctgcttcttgtccagctgtagctctgtgctagtggaagcatgtcctggagttcacgatgtggccaagagaacagatgtagttaggcaatggagatgggacagagagctgcaaagtgctgcacttgccctcttactggacccaaaaggctctcaagtgtaacacctttctgtagtgctgtagatcattaatctgggtgtgtgatgaccatctgatctagcacatccagtggcattgtgcat

SEQ ID NO: 8521 - DNA, 750 bp, Homo sapiens
  misc_feature 1, 2, 3, 4, 5, 6, 7, 57, 66, 100, 107, 114, 133, 161, 176,177, 213, 228, 276, 284, 285, 296, 319, 323, 390, 428, 442,459, 479, 561, 582, 593, 599, 602, 609, 611, 613, 615, 622,629, 630, 638, 676, 678, 691, 693, 702, 714, 719, 728: n = A,T,C or G
  misc_feature 743, 748: n = A,T,C or G
nnnnnnntttttgaaaccctttcgaattccgttgctgtcgggaacatttttcaagcnagaaagtgnctggcttggttctatgaatatgcaggtcctgatnaagttgncgggccngaaggaatggaaaaattangtgaagacattggtgttgaacctgaaantattattatgttagnnttagcgtggaaattggaggctgcaagcatgggattntttaccaaggaagantggttaaagggaatgacttcattacagtgtgactgcacagaaaagttncaaaacannatttgactttntgcgctcacagttgaatgatatntcgncatttaagaatatctacagatatgcctttgattttgcaagggataaagatccagaagccttgatatngatactgctaaatctatgttagctcttctgcttgggangacatggccactgntttcagtattttaccantacctggagcaatcaaagtntcgtgttatgaacaaagatcaatggtcaatgtattagaattcagcagaacagtccatgctgatcttagtaactatgatgaanatggtgcttggcctgttcttnttgatgaattngttgantgncaaaaancncncnggacatnatagcanngaactatntgaagaaaatgcaaacctttcaatttcccacgtgtatncnagctaatgtgatnanggggaaaanaaatccaacggntgcantttcatccntctgaaagactcccntagtncc

SEQ ID NO: 8522 - DNA, 753 bp, Homo sapiens
  misc_feature 1, 4, 5, 6, 19, 506, 627, 686, 717, 720, 733: n = A,T,C or G
nagnnntttttgaacccgnttcaattccttgctgtcgagatttggatttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgantgattgagggccgacagttaagtggtaacaacataaggcctgtggtcaaagttcacgtctgtggccagacacaccgaacaagaatcaagagaggaaacaacccctttttttgatgagttgnttttctacaatgtcaacatgaccccttctgaattgattggatgagatcattcagcatcncgggtttataatttctcactcttctgccggncangattgtcctgatnggggaatttaagaattgatc

SEQ ID NO: 8523 - DNA, 1471 bp, Homo sapiens
  misc_feature 1, 2, 4, 5, 6, 7, 11, 12, 13, 15, 17, 19, 20, 22, 23, 24,25, 27, 29, 32, 33, 34, 35, 36, 37, 38, 39, 40, 41, 42,43, 44, 48, 49, 53, 54, 55, 56, 58, 59, 60, 61, 62, 63,64, 65, 67, 69, 71, 73, 76, 77, 83, 84, 85, 88, 89, 90,92, 93: n = A,T,C or G
  misc_feature 95, 97, 98, 100, 101, 102, 106, 107, 109, 111, 112, 114,115, 116, 119, 123, 125, 126, 127, 131, 132, 136, 137, 139,140, 141, 142, 146, 149, 150, 151, 152, 153, 154, 156, 157,159, 160, 162, 163, 165, 167, 168, 174, 176, 178, 180: n = A,T,C or G
  misc_feature 181, 182, 185, 187, 189, 190, 194, 197, 199, 200, 209, 211,213, 214, 216, 217, 220, 222, 225, 226, 228, 230, 231, 232,234, 239, 240, 242, 252, 260, 261, 262, 263, 266, 268, 277,278, 281, 283, 285, 287, 290, 293, 294, 299, 300, 304: n = A,T,C or G
  misc_feature 308, 313, 314, 317, 322, 343, 348, 352, 361, 366, 370, 371,374, 377, 378, 380, 384, 386, 393, 394, 396, 401, 407, 409,411, 412, 414, 415, 416, 418, 424, 426, 427, 430, 440, 447,455, 458, 459, 474, 475, 480, 485, 493, 522, 523, 531: n = A,T,C or G
  misc_feature 537, 561, 564, 577, 585, 587, 590, 592, 594, 602, 610, 616,627, 629, 631, 643, 645, 648, 654, 655, 658, 659, 669, 681,686, 693, 694, 695, 699, 707, 713, 714, 716, 718, 721, 723,726, 731, 733, 740, 744, 745, 747, 749, 754, 760, 764: n = A,T,C or G
  misc_feature 767, 770, 771, 772, 781, 782, 786, 788, 792, 793, 796, 804,809, 810, 812, 815, 820, 821, 828, 840, 844, 849, 853, 866,867, 868, 871, 872, 879, 881, 882, 886, 887, 889, 890, 896,897, 909, 910, 912, 920, 921, 923, 924, 933, 937, 942: n = A,T,C or G
nnannnncccnnnangngnncnnnnancnccnnnnnnnnnnnnncccnncccnnnngnnnnnnnncnancnanggnngacccnnnggnnngnngnanngnnnccannancnncnnngcngacnannngccnncaanncnnnngggngannnnnngnncnncnngncnnccaccngnancnnncancncnngccncancnncccgagagncncnncnnccncncanncncnnnangcagnncncagccagcgncgagtccnnnnacncncgcgatcanngcnanancncgnccnnggccnngcgncgcncctannagnggagngcctttttttgaaaccccggntgcgnaaanagcctggcncgctngcannaanganntncgcncncgggccnncnggacngcgcgnancnngnnngngagggngnncangccaagcaangggacgnacgagggnagnntaaggctggagaagnncagcncgacncccagcanggcggtagcttagcagcgagcggagatcnnaccactgnggcccnccctagggaacagagcgagacggngtnaaaaaagaaaacncggggcgngnagncncnaggggccntgccggcnagacgnagggggaggtncncnggcccggcggcngncanggtganncannggggacacgnggccggaccggngccanagggggnnngccnaggagccngggaannananccncncgngcggngngaaagcnccgnnancncgaanacaggncgcncantannncccacgggnngaananaacnnaanaagaacgngggcnngncanacggnnaaacgangctccggggggngaancaaangagntgccccacggggnnnaannacgggcncnnacanngnnggcggnncagggggcatanncncaccgatnnanncttggacanaaanccgcnaangccccacgnccggngggnngcaacnnagcnataggaganctccngcgngggacgntcncccnngggggaaaaccggacccgncgngnnngnncanccaaancacgnctgccaagacganngggnatgcngcngcgngggcgacacaaacagccggggnnnananaacnnncgnnanacacnccgaannaccgcatanactcganaaacacggcgcggcganaaggagaacggtcnccacagaaancggtatcnnananancannggatnngnnngggccccaaganacgaanagcacgngnngnntngcgccanngcgacacncgntnccnccgctanacgnntngancnccacagatnncanccnngaangccggggccnanccgggccagagangngctcncacagagggggcncgccnccantgcacacantnccgnggaaactcnccncgcaanagngggggggnggcgaccacaaaacacaatnctcgcctcaagccggcggcgcncatnnanaggctccc

SEQ ID NO: 8524 - DNA, 754 bp, Homo sapiens
  misc_feature 2, 3, 4, 5, 6, 17, 28, 41, 51, 57, 68, 76, 79, 93, 94, 98,104, 118, 123, 125, 134, 147, 151, 155, 176, 177, 181, 203,208, 210, 211, 221, 224, 231, 237, 240, 241, 242, 246, 252,255, 262, 273, 290, 292, 293, 294, 308, 315, 323, 334: n = A,T,C or G
  misc_feature 337, 341, 344, 345, 348, 355, 357, 360, 371, 372, 373, 374,378, 379, 383, 385, 386, 388, 389, 391, 392, 399, 400, 412,415, 440, 448, 453, 456, 458, 461, 462, 463, 464, 467, 468,471, 474, 483, 486, 487, 492, 509, 513, 521, 522, 529: n = A,T,C or G
  misc_feature 531, 543, 546, 549, 554, 555, 560, 561, 562, 566, 575, 576,582, 584, 599, 604, 610, 616, 623, 628, 630, 635, 636, 645,650, 657, 667, 669, 687, 691, 692, 700, 705, 706, 707, 709,710, 714, 715, 730, 731, 733, 734, 738, 742, 745, 748: n = A,T,C or G
  misc_feature 753: n = A,T,C or G
gnnnnntttttttaaanccctttcgaanccctgctgtcctnatacggcccntaaatnggatatccatntcgagatntangaatccaaaccctnntatncggacnaaccattagctccngaatnangtgctaaangaggttctccaantagntctnttatattctatagcctatatnntgantcttgcatccccacgtgtggcntaatnannatcctatacntgnacagctnggagcntgnnntagntccaanccnaatgatncgaggtataanatactaacatcctttgnannnacacaaaagcttgnacctatntatatatntggctatgacngtntctntanngcnctgattnanccntatcctattgnnnntganntatnanncnntnnatgttcnnctaattctgggnccnatgttgaactttggcctaaggattnccttacanagagntantntannnncannttntgncccgaagcntannaggtnaacttctattcttaatncagnccagagannatgattngnactatgtacctnttnttnacggnnaactnnnagantatcctctnngagccntnattgcgatggctgtnacttntttggngtcttnaggaacntgaantnaaagnntgttcgcgnccttnttttctnaggaaacccntngggttttccccatgcctntaanncccgcttngttannntnncccnnattccctgcctaacnntnngccnttcngcnatnccccnc

SEQ ID NO: 8525 - DNA, 982 bp, Homo sapiens
  misc_feature 4, 5, 7, 8, 10, 13, 15, 17, 18, 20, 21, 22, 23, 24, 25, 26,29, 30, 31, 33, 35, 37, 39, 43, 45, 46, 48, 49, 50, 52,53, 61, 62, 63, 64, 69, 70, 72, 75, 76, 80, 89, 90, 92,95, 97, 100, 101, 105, 111, 117, 119, 121, 122, 124, 129,131: n = A,T,C or G
  misc_feature 132, 133, 136, 140, 141, 143, 146, 147, 150, 153, 158, 161,167, 169, 177, 185, 193, 208, 210, 211, 213, 225, 235, 416,417, 427, 433, 476, 503, 521, 528, 542, 548, 554, 557, 567,595, 604, 618, 624, 653, 659, 660, 681, 683, 684, 692: n = A,T,C or G
  misc_feature 693, 695, 697, 708, 724, 727, 733, 737, 740, 749, 752, 765,768, 771, 774, 776, 778, 782, 787, 791, 793, 801, 802, 805,806, 811, 812, 816, 834, 837, 842, 846, 847, 857, 859, 861,863, 869, 874, 895, 896, 900, 901, 904, 909, 912, 913: n = A,T,C or G
  misc_feature 916, 932, 936, 941, 943, 945, 955, 958, 961, 971, 972, 977,981, 982: n = A,T,C or G
cacnntnncnccntnanncnnnnnnncannncncntncnactntnnannnanncctgtcannnntcctnnanaannttancgcactcanntnccncnccnnatanaccatnctaccntnannancatancnnncanagcnncnacnntanccncaccnacnacaagncnaataatantctatccnaaagagcncccttttgaaccccntnncnaaaccccgctgncgacgccttntgcagagtgaaggaccccaactctggactgcccaaatttgtcctcatcaactggacaggcgagggcgtgaacgatgtgcggaagggagcctgcgccagccaccgtcagcaccatggccagcttctgaaagggggcccatgtgaccatcaacgcacgggccgaggaggatgtggagcctganngcatcatggngaacgnggccaacgcttcaggtgccaactacagcttacacaaggagagnggccgattccaggacgtgggaccccangcctccagtgggctctgngcaccanaagacccaatgccngtgtcngagatnaanagggttggtnaaagacagcttctgggccaaagcagaanaaggaggangagaaccgtccggntggaangaaaagcgggctggcccgaggaggccagnggcagnntggagcaggagcgccgggagngnngagctgcnncnangctgcacaccnggagcagcggtattangancagggnggcnaangccagcccnaanagcaggacgtggngancancancncngaangcggnttcnanggaacccnnaanngatcnngaantctgccgtgcaccccganggnagaantccnnaagcccaaangngnanggacangaccnaccaacctatcatcttccaanncctnnaanccggntcnngcngaaggagcccctttcntgcnaaaancncnctcacccaanccntanacaccaactnnggccnagann

SEQ ID NO: 8526 - DNA, 1705 bp, Homo sapiens
  misc_feature 2, 11, 12, 14, 16, 19, 21, 22, 24, 29, 30, 31, 32, 35, 36,38, 40, 41, 43, 44, 45, 46, 47, 48, 49, 51, 52, 54, 56,57, 59, 61, 63, 64, 65, 66, 68, 70, 71, 72, 76, 83, 86,91, 97, 99, 101, 103, 105, 106, 107, 111, 112, 116, 120,122: n = A,T,C or G
  misc_feature 123, 125, 126, 127, 131, 132, 139, 140, 143, 153, 154, 155,157, 158, 167, 168, 174, 176, 181, 197, 202, 206, 210, 216,223, 224, 227, 228, 237, 241, 250, 258, 268, 269, 271, 272,274, 278, 286, 288, 292, 296, 299, 303, 307, 309, 316: n = A,T,C or G
  misc_feature 318, 319, 321, 323, 324, 326, 329, 341, 353, 360, 363, 366,379, 380, 386, 391, 396, 397, 398, 401, 402, 408, 417, 422,427, 429, 439, 440, 449, 450, 454, 463, 468, 469, 473, 476,484, 485, 489, 490, 495, 497, 502, 505, 507, 509, 514: n = A,T,C or G
  misc_feature 519, 521, 522, 526, 529, 532, 535, 542, 547, 550, 551, 556,561, 567, 568, 570, 574, 578, 579, 580, 585, 587, 588, 589,592, 602, 607, 609, 610, 611, 616, 622, 624, 625, 629, 636,637, 642, 645, 648, 652, 668, 672, 673, 675, 682, 692: n = A,T,C or G
  misc_feature 698, 702, 708, 711, 714, 715, 719, 721, 723, 725, 726, 727,730, 731, 735, 740, 742, 745, 746, 752, 756, 766, 769, 777,785, 789, 792, 793, 797, 798, 800, 808, 811, 816, 820, 821,825, 826, 834, 843, 846, 849, 858, 868, 869, 870, 878: n = A,T,C or G
  misc_feature 886, 887, 890, 893, 894, 908, 910, 919, 922, 929, 931, 932,935, 942, 944, 957, 961, 965, 970, 971, 975, 978, 983, 996,997, 1002, 1006, 1008, 1010, 1013, 1028, 1029, 1033, 1045,1054, 1056, 1061, 1063, 1070, 1081, 1084, 1085, 1086: n = A,T,C or G
cnccacgcacnncnancangnncnacgannnnccnncncnncnnnnnnncnncngnncngnannnngncnnngacngcaaccncangccgnggcgcncngncnannnccanngcgnccgncnncnnncganncgagacnngcnaagcgcaccnnncnncaagcgcgnnccaagngnccccnttggaaacccctttcnggaanaccnaagncgagcngaaaaanncgnngcagaagcncccngggccgcangctagcangcgggagaanncnnanacangaggaggncnggangcancangcanacgnancgagcgngnngngnngngangcgaagcgcggnccccacgaccgngtaccanacnagnggacggagacgcnnggaggngtacnccgannnccnngcgcanggccgcccnagaangacgncngccacacccnnacgacggcnngcanccaacgcanagagnnctgngcnggtgccanncagnncgaangngcccnacngncnggacngaagnannccanagncancancgcccgncaagnccnncgcangcganacaccnncngcancggnnngcgcngnnngcngggcgcaagncgccnannnaaggncgaggncnnagcngggccgnnggacnctnganattngcggaactacgcgganacgnncnccgcagngagcaccacnagaacnccanccgggnganggnncccnananannnggnnccanccgancncgnnggcganaggnaccgacgagnganccacgggnggaccccngganccnngggnncncggagggnggnacaangaanngccnngcgactcncgcacgtcncanacngaggactcnggcacggcgnnngactcaanaggcgccnnaanggnncaccggcggcgacnanaggccgcgngcncagcgcncnngcncaaacgngngaacggagacgangacncgcnactcnngagnccnccgcngagcggcagggcnnggganacgncnanagncacagacggagcaanncaanggcgcgcgcgangacccaaancnacgangngcgcagnggggaggcgcnacnnnnncanncnaagccgcgcggncacgacagngcncgnagcgcgcgnnnnnagancagncacgcnngcncagcgccgcatcagcggcgcgcnaacacaccgcggnnagnancgcgagtcgcggnacnancccncnagnngnnngaccacagncnctccgccccacgcnncncgnatgcnccgaanacncacnnnngcnnccgngcagtcngcacgcggcgananccncgnctaacacacgcgcgncacacngcgnnccngnngcgcnncgngacgnngnnntacacncncacgcatcngacanngngancgagcntgcnancgcgnnaacanacacgnnccggggcanccacnangntcgagncgacnangagagacgngncgannngngcncancncgagctnngaccncangcgnncgaccgccgcacanncacggcngngcngaccgngcaganncacgnncnncgcagacagccagccngcncacngngcacaganggacacangcgacaccanccgtnnancacngnacaccgccacgtacgcngcnncnnnacgacnnggcgcgacagcncgacgngcccgacgacacgcgcacgggccaccgcatcgctncncct

SEQ ID NO: 8527 - DNA, 754 bp, Homo sapiens
  misc_feature 2, 3, 4, 5, 6, 7, 16, 20, 612, 626, 630, 639, 646, 649, 651,656, 671, 675, 677, 687, 689, 690, 691, 709, 713, 724, 725,740, 751: n = A,T,C or G
gnnnnnnttttgaacnccgnttcgattccgttgctgtcgcttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgccttttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtgtgggttttgttttgtttaatttatggattagtctttaaagtaggctnttttttttttttgnaaantccggcccntttaaanggncncctgnaaaaaatttaatttntttnanggcttttccnannncccccttaaaaaaacccncttntaaggcccaanntggaaacccaaagtntttttggtttnccc

SEQ ID NO: 8528 - DNA, 762 bp, Homo sapiens
  misc_feature 1, 5, 14, 22, 28, 33, 42, 44, 47, 49, 60, 63, 64, 76, 79,85, 86, 152, 215, 230, 232, 243, 250, 273, 288, 308, 309,383, 412, 413, 427, 440, 496, 520, 525, 540, 597, 646, 667,688, 692, 693, 694, 705, 709, 722, 724, 725: n = A,T,C or G
nctcncccttttgnaacctcgnttcgantccgntgctgccgnanatnancagcccctatnacnnacgtagccacantcncaaatnncaaaagggaatgttctaaaactttttcttccttaaaaatggagaaaattgcacttgtgcttgctgngtggtatataaaccaggattagtcccagggtcgtgaggttcctggtgaaaaggttaaatcgtngaagctagtatattntntatatttttgnaacaatngcttttttcatgggggaggcggngttagtatttatagncctaacaagtccagtaattnnttataaatcttcagattataaacagcccctaaaaactttacaacgtttacacagttttttaaaaagagactgtntacacttgatttgctttcaaaataaatanngtcagctagtctangaggttaacgtcnggtaggaatgctgatcatgataggtttggttttctacagattctgttccggtgccntttcctatccaggcaccacctganaaagntgtcatttgaggtcncacttggaagttacatctgtgaagcccctgtcactcgtccagatctgtgttgtgtancatgtgcttgaggaagcacgtgctgggctgtgccctcatacagtgcatnaccggggcacccagaaggctngcctggctatcttctgtctcnggtnnngtgtggagtgntggngagggaacagatncnngatcaaacctggggctggttttcccgtctaggctcct

SEQ ID NO: 8529 - DNA, 746 bp, Homo sapiens
  misc_feature 1, 2, 3, 4, 5, 6, 7, 8, 9, 10, 20, 237, 241, 243, 245, 264,266, 273, 293, 301, 305, 308, 311, 315, 325, 328, 331, 335,337, 353, 354, 359, 366, 371, 374, 385, 392, 402, 406, 410,413, 424, 429, 441, 446, 449, 461, 479, 485, 502, 509: n = A,T,C or G
  misc_feature 512, 517, 521, 533, 535, 541, 548, 564, 571, 622, 658, 663,668, 679, 683, 686, 738, 740, 746: n = A,T,C or G
nnnnnnnnnntttttaaacnccgattccaaattccgttggctgtcggtgaaacgctgtctctactaaaaatacaaaattagccgggtgtggtggtacacgcctgtaatcctaagtactcgggagactaaggcaggaaaatcgcttgaacccagaaggcggagtttgcagtgagcggagatcacaccactgcactccaccctaggcaacagagcgagactgtctcaaaaaaaaaaaanttancntntattttttagggcctttcnanataaaanggggattttcttttcctgtntaaaaatntaanctnctngttncattagtaanatngtnttgngngggttagtatatgtgnncttgnaacagtntcccnggntcctttatccnctaaatntcagtaggtncccnattntgnacactggttgngacanccaaaaaatgtntccanacnttggcaaatgtntcctgggggaacaaaatngctccnttttgaaaatcactgcnttaaatnctntgttnaggnttaaataagacncntaaaanttttaanctagcaggggactaanaatttgngagtattgtttgttgcattttcatatttatcatgttggaaatttaaatttnccctagccttatttggagagtttaactttttttttnggttngtttngttttgaactncatnttnaacccactgttaaatgttaagcccttaaagggaatttaagggaacattttgngncccccn

SEQ ID NO: 8530 - DNA, 757 bp, Homo sapiens
  misc_feature 1, 2, 3, 4, 6, 7, 15, 18, 23, 24, 27, 303, 426, 485, 490,555, 620, 645, 649, 669, 709, 713, 732, 737, 757: n = A,T,C or G
nnnntnnttttttcnaanccccnnttncgaattccgttgctgtcgcttgtttttccacacagtggagctgtaactgcactaagatggagcaaacagatttccaaagattaagattcagtaaattatagtgagaattgacaagaagtttctgtttatccattgaccagagaagggaaataattcatcaagtttagtttgaaggtctcagggatgttgaaatcagacttttacatcttaatccagtgagaatgaaaaatgaactacttatagtgtctgcccatgacaagtcatttctttgcttanggatgcaaatcgtatcacacagtggtctgaaatattcctttcaaagagataagctgtttgtttttcaaaatggagcttccaggtgtgctaattctgaacacgaagctttgttatttggagaanaatatccttttatggtggtactaggttagttggcaaatatttactaatgcatactttgngctangaactgttgtgttcatgaggacagagaaaagacaacacagatgactccttgtctgtacatagctnccactttagtgggaggagacaaatgatcaaagtgcccccatgagaagatacgataaagtgatgcnttacagattgactaaattggttaangaanatctctcataagaggcccangcgccggcggctcacacctgtaatcccagcactttgggangccnaggcacatggatcatggangtcangagttcaaagatcagcctgn

SEQ ID NO: 8531 - DNA, 798 bp, Homo sapiens
  misc_feature 1, 2, 4, 5, 6, 565, 578, 579, 582, 583, 584, 587, 588, 595,601, 603, 605, 606, 609, 612, 617, 620, 622, 623, 624, 625,627, 628, 629, 631, 634, 636, 637, 639, 640, 641, 642, 643,645, 647, 648, 654, 655, 656, 657, 658, 660, 661, 663: n = A,T,C or G
  misc_feature 665, 666, 667, 668, 669, 673, 679, 680, 686, 688, 691, 692,693, 694, 695, 696, 698, 699, 700, 701, 702, 704, 705, 707,708, 709, 710, 711, 712, 713, 714, 715, 716, 717, 719, 720,722, 723, 724, 725, 726, 729, 734, 738, 740, 741, 742: n = A,T,C or G
  misc_feature 744, 745, 746, 747, 748, 750, 752, 753, 754, 756, 757, 760,761, 762, 763, 765, 766, 767, 770, 771, 773, 774, 775, 776,778, 779, 780, 781, 783, 784, 785, 786, 787, 788, 790, 791,792, 793, 794, 796: n = A,T,C or G
nngnnnttttttccaacctcgattcgaattccgttgctgtcgaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactaaaaaaaaaaaanatccaaactaaanntannntannaaaaaanaaaatntntnnccnggnctttnttntnnnncnnncnccncnntnnnnnancnncccccnnnnntnntntnnnnncccncccccnncttctntnacnnnnnntnnnnncnncnnnnnnnnnnncnnannnnnctnccttnctcncnnncnnnnncncnnntnnccnnnncnnnccnncnnnncnnnntnnnnnncnnnnntnct

SEQ ID NO: 8532 - DNA, 852 bp, Homo sapiens
  misc_feature 1, 2, 4, 14, 17, 33, 52, 53, 63, 70, 79, 81, 97, 99, 119,129, 132, 137, 143, 152, 165, 177, 193, 228, 261, 314, 323,331, 343, 346, 349, 353, 362, 399, 401, 405, 413, 414, 425,439, 442, 448, 452, 461, 484, 489, 495, 500, 502, 505: n = A,T,C or G
  misc_feature 521, 529, 532, 535, 536, 542, 548, 550, 554, 558, 562, 563,564, 572, 573, 585, 586, 588, 591, 601, 602, 603, 604, 605,610, 612, 619, 623, 624, 637, 639, 643, 647, 652, 662, 666,669, 676, 678, 680, 688, 696, 698, 702, 708, 715, 716: n = A,T,C or G
  misc_feature 721, 724, 730, 731, 732, 733, 734, 739, 742, 745, 746, 749,753, 754, 764, 769, 778, 779, 782, 783, 786, 788, 794, 795,800, 801, 803, 807, 824, 825, 827, 832, 835, 840, 842, 846,849, 850: n = A,T,C or G
nngnctttctacangancgattcgtgctgtcgncaaaggctccactccagtnnctcgcctgtnaatcacnaatatgctnancaggagaggcttttgnantcatcttcatcttgacattncaagagcagnacngggtnagcatncacaaaagnacactgtaaaacngggaactgtgtnctacccttcctgagtnaaaagggaaagcttatgcctcagcctgaggcaggngggccccttgccatgcacacctttgtgctgcanccagggatccacttggctgggctcaacccttccccgtagggacgactgtacanaaaggagcncggatagnagcaaggcccgncanggngaangcctgcttnctgtgggtccccctgcgtggctggcagggagtggtcngngctnggagtccnnaattacctgangacacggaaagctncancttctntganaaaactcanattttgtaaattgcgccatccanttganagcacnttacngnggnaatcccgcggagattnggacttgntanganngccttngccctnancggnggtncttnnncctgtcgnntggtccctgtanntnggntgcctttgannnnnttgtntnttccccntagnntctctctttactncnaggnttcnttcanttctttcacngtanatnccgacanancntcctcttntggcactncnttanacggantcccttnnacganatncttatnnnnntctantgnctnngcnattnnttcttccttntcccntttttgccnnccnngananatcctnnaaaanncntctngctataaaccgttcttnncntatcncanatatntnatanctnnct

SEQ ID NO: 8533 - DNA, 750 bp, Homo sapiens
  misc_feature 1, 2, 3, 4, 5, 6, 7, 82, 153, 192, 274, 289, 327, 363, 458,464, 478, 493, 540, 619, 636, 640, 649, 656, 688, 690, 705,708, 724: n = A,T,C or G
nnnnnnntttttcaacctcgtttcgaattccgttgctgtcgcctgaacctgaaaatcccaggtgggcgtcggggactagtanggtggggaagccttggctccagccttcagggcagtgggtgcctttgggaaccaagtttaggcatggcccanaacacagtatccaagtcggctgtgctgaccttttcattncacttcatttcattatgttcttctatgtttattttcacagagtctcatccaagaaaaacaaatgtttaccttgctacctttntcctcttccaaatanaaatagctttattgtgtcacatgggggaaacgtagatntgcttttagattttcagattaactatctgtcaaatngaatcatgtcagtgaaagaactggccctgccgatgccagggtctggaagtatttaagaggtggcagcccatcggcatccttctagtatttctctntcattnctgaaattagaacnagggctgtgctgcanaactcgctgggccacatctagccctttggtggtgaatcgttcctctngggccccgattagccagtcaacaggtcacacagtctgctgaaatgtgttccaagttctttctatagagaatccttcccnagggaagccactgtgantganaattttgangctcctntgcccagaagtttggcatgttctgtggaaatncncaaattcttacatanaanggaaatctaaatcgcntcagatggagcttgtgttgcgagctc

SEQ ID NO: 8534 - DNA, 1233 bp, Homo sapiens
  misc_feature 2, 5, 6, 7, 8, 9, 10, 14, 18, 19, 22, 23, 24, 26, 28, 29,30, 31, 33, 34, 35, 37, 38, 45, 48, 49, 50, 52, 53, 54,56, 58, 60, 62, 65, 66, 70, 71, 73, 74, 78, 80, 82, 83,84, 85, 86, 90, 93, 95, 96, 97, 99, 102, 103, 104, 105,107: n = A,T,C or G
  misc_feature 111, 112, 114, 115, 116, 117, 120, 121, 134, 135, 138, 140,143, 144, 147, 149, 153, 156, 158, 163, 167, 169, 173, 174,179, 180, 181, 184, 191, 196, 200, 211, 215, 217, 226, 228,229, 232, 236, 238, 240, 253, 254, 267, 269, 271, 273: n = A,T,C or G
  misc_feature 277, 285, 300, 301, 310, 318, 319, 380, 385, 389, 394, 419,420, 421, 422, 458, 470, 472, 491, 502, 510, 511, 547, 571,575, 576, 578, 579, 581, 582, 588, 595, 598, 599, 601, 603,604, 605, 607, 634, 644, 645, 646, 647, 653, 656, 660: n = A,T,C or G
  misc_feature 661, 662, 664, 674, 675, 680, 686, 688, 689, 711, 718, 719,721, 722, 723, 725, 726, 727, 734, 747, 750, 762, 768, 769,772, 773, 775, 776, 780, 781, 787, 793, 796, 797, 798, 802,805, 807, 808, 812, 814, 817, 820, 823, 824, 826, 830: n = A,T,C or G
  misc_feature 831, 847, 851, 854, 859, 863, 865, 866, 874, 877, 882, 884,888, 890, 892, 893, 895, 901, 903, 911, 912, 922, 925, 931,933, 938, 940, 947, 955, 956, 957, 960, 961, 964, 965, 971,974, 975, 997, 998, 1001, 1004, 1009, 1010, 1017, 1018: n = A,T,C or G
  misc_feature 1022, 1027, 1032, 1034, 1036, 1041, 1052, 1056, 1058, 1062,1076, 1077, 1078, 1084, 1097, 1101, 1102, 1103, 1109, 1115,1125, 1134, 1136, 1143, 1144, 1150, 1152, 1158, 1160, 1165,1172, 1173, 1176, 1178, 1180, 1184, 1185, 1193, 1198: n = A,T,C or G
cnccnnnnnncctnccanntcnnncncnnnncnnncnnatcctcnatnnntnnncncnancntcnntacnnanncacnanannnnnccgnacnannntntcnnnntntacnncnnnncannactctcacacctnnacncncannccncncatnccntnctcanaacntncaannctacnnntcnccgtccncacancaancatcccacatncacncntctcatatnannctnagcngnantttttttaaccannccccgaattccgntncncnctcngcgcagtnggcacatactggtcnngccaagctncataaggnncaagtgggaggatcgcgtcaacacccagggagatgtgaggctgcagatgagctgtgatagngccantgcnctcancctgaatgacagagggacaccctgnnnnaaaaaaaaagtcagcggataactaggacaaactacnttttaactgctnanagctggtggctgcgcatantggacagaccnagagactnnaggctcaagagggcgtgtatcgtccacctctaatgngccaagggaaccttgccttaatantgcnnanngnntgaaanatggggnccnngnannncngccggggccacagaccaagactccatngcactaaacnnnncccgangcnagcnnnangacaaagggnnttaanaaagantnnacatcccaaaaccattggcggnagggccnngnnncnnnccgagcngacaaaaggcttnaangaccacgcggancactcnnatnngnngcanntggggntacaanaannnccgnccnannctangnttnaanaanngnactnnccacgcaactttttanaaangcncctcngacncnnaaacattngcnccctnanaaangncnnangccttnanatcaacgnncaagggcacnctntgcctnanagggngnaaatctntctcaggnnnccnntcnnagggcntannaacactcgggcctcggcaaacnnagnaancccannacatcgnntttngcccnggcgntncngcaanacacacccctngctngngggncacgcaacaggggnnnaaaccntctttggctgcantaannnaagcangccccnaagcaccctntcttactcncnaagatannggctcnanaaaagngnccccncgctccnnggnanantccnnatctatcntaccncanntcgntncaaacnaagccntnangnanancct

SEQ ID NO: 8535 - DNA, 784 bp, Homo sapiens
  misc_feature 1, 2, 3, 12, 17, 237, 347, 416, 417, 443, 477, 553, 555,571, 572, 573, 582, 584, 586, 589, 594, 597, 600, 602, 603,609, 611, 614, 617, 625, 635, 636, 639, 641, 646, 653, 654,655, 656, 660, 662, 663, 665, 666, 676, 677, 680, 681: n = A,T,C or G
  misc_feature 682, 690, 698, 706, 720, 721, 723, 724, 726, 733, 734, 735,739, 740, 746, 748, 749, 761, 765, 767, 772, 777, 781, 782: n = A,T,C or G
nnntcctttttnaaccnctttcgaattccgttgctgtcgctcaagcttcaaacagcgcagataaatgcaggcaagtaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgngacctccccccttctcccccttcccactgtgattggcacatcgacaagggctgtcccaagtcaatggaaagggaaagggtgggggttaggggaaggttggggggacccancaaggactcagagagtcagacagtgccacttggccacttggggtaaagccagtgccagcacttaacagnntatcatgctcattaatttgggatttnaaaacacaaatgaaaactcacacccacccacccncaagtgcatgtcttcatcacttaaaaaagtaagttcatttgaaaatattcctttctttttttctcccttcctattntngtttgattatccaaannntctgatctncncnaanaaacntcnttngnntggggntnttnagnggtttaanatgaattttnnacntnacacnaaaggcnnnntctngnnanntcttactttnnaannngtcttctngggcaaantctccttnaaaactcttaaccnntnngntttttgnnngagnnttaacntnntgccttccctanctgncncccanccttnaacnnct

SEQ ID NO: 8536 - DNA, 783 bp, Homo sapiens
  misc_feature 1, 2, 6, 13, 15, 23, 25, 349, 479, 500, 514, 579, 611, 647,665, 666, 667, 673, 675, 676, 679, 686, 689, 694, 702, 704,705, 711, 717, 718, 719, 720, 723, 737, 742, 743, 744, 746,772, 773, 781, 782, 783: n = A,T,C or G
nncttnttgttcnancccgttcnantccttgctgtcggcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgnccacgcagggggccgagggctgaggccaggcaatcacgggctatgcccggggagctgtcgggagtggcgggaatcggggccatgcccggggagctgtcgggagtggcgggaatcggggccatgcccggtngagctgttcgggagtggcggnaaatggggggcatnaccatgcctgccgtcgggttcctgcgctgacacctggtcttgtgcacctgtgttgcttacagttnaaaactggacacttttgtattgtatattatanagacacctgtttccatttctaatttatcaaaaatgngattatcctttaaaaaannnctattnannaantttcttnggnggccntttttttncnnttatantccccnnnncantttattactaaacnccatnnntncaattttttggtccaaaactcctccnntctttagnnn

SEQ ID NO: 8537 - DNA, 751 bp, Homo sapiens
  misc_feature 2, 4, 5, 6, 7, 8, 11, 15, 22, 730: n = A,T,C or G
ancnnnnnttntttnaaccccntttcgaattccttgctgtcgccttcagccccctgttcacagcatgcatttccccggattgctcccatccgagcagctgaatccctgcacagccaacccccacagcacctccagtgtcccctctaccggcctgactcgagcagctttgcagccagccttcgagagttggagaagtgtggttggtattgggggccaatgaattgggaagatgcagagatgaagctgaaagggaaaccagatggttctttcctggtacgagacagttctgatcctcgttacatcctgagcctcagtttccgatcacagggtatcacccaccacactagaatggagcactacagaggaaccttcagcctgtggtgtcatcccaagtttgaggaccgctgtcaatctgttgtagagtttattaagagagccattatgcactccaagaatggaaagtttctctatttcttaagatccagggttccaggactgccaccaactcctgtccagctgctctatccagtgtcccgattcagcaatgtcaaatccctccagcacctttgcagattccggatacgacagctcgtcaggatagatcacatcccagatctcccactgcctaaaacctcttgatctcttatatccgaaagttctactactatgatcctcaggaagaggtatacctgtcttctaaaggaagcgcagcttcattttcaaacagaancaagaggtggaaccctccacc

SEQ ID NO: 8538 - DNA, 746 bp, Homo sapiens
  misc_feature 1, 2, 5, 6, 15, 17, 223, 313, 474, 497, 545, 600, 706, 733,735: n = A,T,C or G
nnagnnttttattcnanctcgtttcgaattccgtgctgtcgccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgtcaggagaacggngccagcgtgatcctccgtgacattgcgagagccagagagaacatccagaaatccctggctggaagctcaggccccggggcctccagcggnaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggncccacagacccagcacgtatctnccatgcgccaagtggagcccccagccaaagaagccagccacaccagcngaggatgacgaggatgatgacattgacctgttttggcagtgacaatgaggaggangacaaggaggcggccagctgcgggaggagcggctacggcagttcgcggagaagaaggccaagaagcctgcactggtgggcaagtcctccatccttgctggatgtcnaagccttgggatgatgagacggacatngntcaacttggag

SEQ ID NO: 8539 - DNA, 732 bp, Homo sapiens
  misc_feature 2, 475, 489, 540, 573, 575, 605, 649: n = A,T,C or G
anctcggttcgaattccgttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccangccccgggcacctnctgcaaccatctctgggctcagcacctgaggcgggtttcctgggtcccctntccagcaagccttcaccagcaagctcggcccanancttcccttccggctggctctgaaccgtgcnttggtgcctacagcctgcatcttggagacaagctttttccggantgcttttgggagccaggccagggtgttaagggaggtgcaaaggcattccgggccgggagcaacccccaggtttgaacaggtgc

SEQ ID NO: 8540 - DNA, 859 bp, Homo sapiens
  misc_feature 2, 7, 13, 16, 27, 41, 84, 162, 172, 244, 328, 410, 451, 546,583, 599, 612, 613, 621, 623, 640, 642, 647, 652, 665, 685,692, 705, 709, 716, 718, 723, 725, 739, 749, 752, 762, 776,780, 786, 792, 799, 804, 816, 826, 827, 837, 841: n = A,T,C or G
  misc_feature 842, 845, 852, 856, 857: n = A,T,C or G
anttganccattncgntgctgtcgganacctcacgccctanggatgtagccccgctcgcagtgcacacgcagtccgcacgccgncgacctctgagcgggtcagacgcccttgtgctttttgtttctagggacagagtccccaagtgggtgcacgtgttaatnggaaaggtgntcctggagctggagcgcttcctgccccagcccttcaccggcgagatccgcggcatgtgtgacttcatgaacntcagcctggcggactgccttctggtcaacctggcctacgagtcctccgtgttctgcaccagtattgtggctcaagactccagangccacatttaccatggtcggaatttggattatccttttgggaatgtcttacgcaagctgacagtggatgtgcaattcttaangaaatgggcagattgcattcacaggaactactttttattgnctattgtaggattatggactgggccagagcccacacaagtttacaagtttcttggtgatgaaacgagataaaggcttgttggtgggagaatgctntcgcttgcccctgtttcggagacaccatttcccgtcnagcttgctgatcccgngcttacccttganntgaagtcngnaaaccttccgaaaccancntgttnggcangtttgggcccaangaacttccccctttatttgnctggaangttaaatttaccnattngtttggntngggcncngttccccccccggnaaaggggggnttngggtcattcnaccgagggaaaccngaantattgnggcccnaacccanaccantttttgggcccnttttaaaaannccctttttgnaatnnggnaaccgtngggnntt

SEQ ID NO: 8541 - DNA, 796 bp, Homo sapiens
  misc_feature 3, 4, 15, 317, 471, 497, 499, 565, 595, 614, 621, 638, 650,667, 670, 672, 718, 737, 743, 750, 759, 765, 770, 779, 795: n = A,T,C or G
ttnnaacttgaatcngcacaatttgaatcccaacctcagaattctaagtcccatatattagtttttggtaacaatcatcagtaaaggagaatattttaaaaacctataaaggagtccttgacaatactatctaaatctttttatacattgataattttataatataccctgtatatattaggtaaatgcctgtaggtctccaaagacctagaattgagaatcagagggtaaacatccaaacaaatcccctagatgtgggaaaataaggaagttatcttatttcgtcgtcatttatattgaggtgaatcatgatgganctggtatgagatttcctcaggaggtttcttgaagcttatcatgtttacagaccataacatactctttgctgattcatatagcaatgaatgataaaatcagaggcacttggtttgggcacttaaaggaatgttttcatctcttctcccagttgangccatgacttgaagaaaggttaaaangntttgagtatcaagtagcatcctacaaaaggatctaaaactagattttctagtttggctcacttaanatgataaaatgagataattggagactatcngttgtaaaatctgaagttnggaaatnacaccgtagccttgaanaaaatggtcagngattcaccaagaaaaantangnaaacaaccatttacttcaagtttttgccttcaaaaaaagttaaaanggattttttaaattggaanaaaaanctccctnaaattttgntccttntaagncctatggcncttttgaaaaaggaanc

SEQ ID NO: 8542 - DNA, 780 bp, Homo sapiens
  misc_feature 3, 10, 30, 58, 63, 65, 69, 70, 74, 80, 88, 94, 97, 405, 408,412, 424, 469, 478, 510, 519, 529, 533, 554, 556, 561, 567,619, 630, 656, 668, 696, 700, 721, 754, 770, 773, 778, 779: n = A,T,C or G
ttntactcgntcaattccttgctgtcgganaagttgagtggttgggacagtggtcccnttcgngntggnnagancactgncttagatnatgtgnggntcttctctggtcagaggcccaaatgagtggacaagtactgtgatttctcaagcccctatgcagtgttagatgccactatgaaatacgagccattgaaagagatctcttcaacttattattttttatcacgaacgtacatatcagttatttatgagatttttttttttaaatatttcattttttttcacgactttttctgccattgaattagcctttttctcatgcactggtggtcaagaaatacatgccataataagatggcagttaaacttcatcagtattttttttttttaaataagattttttanccnggcncaggggttcgcncctgtaatttgaaccttttgggaaggccaaggcaggaggatcacnttgaggccnggagttcaagaccagcctaggcaacttattgngaccttgtntttcagaaantganttccttggccatgggggcatntncctgnaggaanctgaagtgagaggatccttgagcccaggagttcaagaccagcctgggcaacntagtgagaccntgtcttttacagaaaaatttaaaaanttaactggggcncttggggccccgtgcctttttaggaagncttnaaattgggggaagggatcccnttggaaccccaggggagttttgaaaccttccantggggcccaaaattcnccncttcnnt

SEQ ID NO: 8543 - DNA, 806 bp, Homo sapiens
  misc_feature 4, 401, 418, 424, 433, 438, 459, 470, 472, 484, 498, 504,509, 530, 532, 546, 547, 552, 560, 563, 571, 578, 583, 585,609, 634, 651, 654, 655, 664, 667, 678, 702, 705, 709, 710,715, 716, 745, 760, 770, 772, 780, 784, 791, 797, 801: n = A,T,C or G
tcgntcaattccgtgctgtcgcttgtttttcagacctcgaactatggagaacaggaattgaagcccaggtgggtgtccaatgccagaccatggatcatcagcctgggacaccaaagtgccacactctcagagtgaggatgatcctcaggaagtcagctctaccaccctccacaccaggaagtgcaagcagactcacctcatgattgagcagaataagagaatccttgagaagtcataagtttgcatggatttgcagcacaagttcaaacaactagatggcaccaaatccctcaatttatgaagacatttaacgtggtacccaattggaaacgcctcatggcagaaacaaacataaatcctttctagaaggttgccttgtccaagtgtttcccaaaccagtntttttagggaaaatgcncagctnactataacngaatnttaacctaaacttggaaatanggaaccagcananacaggtctgcanatatttcggatatnggaagnatcanacacagattttaaaacaactntncttaagatgcttanngaatnaaaaggcnacntttaaaanttatttnccccntngaaaattttttaaaaacaatccancatgtttggaaaagagaagcccaantggaaattttcctaaancannaccaaaccnaanccaaatggaantcaaattggaaattttaccaccancancaannccccnnaacacattggggaaaaattaaaattgccnttttgaaagaagagnaatttaagtngnaaccttgnaaangatttangggaanaagnaaaaa

SEQ ID NO: 8544 - DNA, 842 bp, Homo sapiens
  misc_feature 8, 59, 68, 90, 95, 97, 104, 107, 109, 111, 120, 133, 134,145, 148, 151, 154, 169, 171, 174, 177, 181, 183, 192, 196,199, 205, 215, 218, 231, 245, 255, 259, 303, 392, 425, 429,510, 525, 542, 562, 588, 644, 695: n = A,T,C or G
tacttcgntcgattccgttgctgtcgcttgtttttcagacctcgaactatgggagaacnaggaatttngaagcccaggtggggggtccantgccngnccttggntcntnancctgggccnccaaagggccacnntttcagagggnggntgntcntcaggaagtcagctntnccnccntccncnccaggaagngcangcngactcncctcatgatngancagaataagagantccttgagaagtcntaagtttgcntggntttgcagcacaagttcaaacaactagatggcaccaaatcctcantttatgaagacatttaacgtgggtacccatttggaaacgcctcatggcagaaaccaaccataaatcctttctagaaggttggccttgtnccaagtgttttcccaaaccaagtttttttttangggnaaaatgccccagctttacctattaaaaaaaaattttaaccctaaaccttgggaaaataaaggaacccaggcaggaaaacanggtcttgcaaaatantttcaagaatatttggnaagtatcaagacaccaggantttttaaaacaacctattctttaagnatgcttaaaggaaagtaaaaggcaagcttttaaaatttataggaccataggaaaantatttaaaacaattccagcatgtttgaaaggaagagcccaataggaatttnctaaaccaaccaaccaaccaatggaatcaattgaaatttacaccaacacacaccccacaatgggagattagatgccttttgagagagaattagtgactgaaagataagagagaagaagtccccgaacttacctattgcaaaaaaaaa

SEQ ID NO: 8545 - DNA, 813 bp, Homo sapiens
  misc_feature 1, 4, 10, 571, 581, 591, 646, 685, 689, 702, 721, 738, 739,745, 750, 753, 754, 779, 783, 793, 810: n = A,T,C or G
nccnttcgantccgtgctgtcgctgattatccgaatgagtaagtagatttctcactttgtggatggtccgttacctgggatctcctatcctcctggggctgaactaggagagtggaaccagagtcataatgaggcatctgatgaggggaggggtagggagagagagaaagagacgtagagaggaggagagagagaaggatatctcagatctcattttaaggctaatttgagaggagacacgtagagtacttgagaacctgggtcctggcaccagacaacctggattcagatcctggctgtgccatttcctggttgtatgatgttgggcatgtaacttgacttctctgcctcagtttcctcatctgtaaaataggataatagttttacctcatagggttgctatgaaatgaagtaagtaatgtatatatagagtgattagaagtaaaaattcgaggctgggcggggtgactcaacacctataatcccagcactttgggagggcaaggcaagaggattaattgagcccaggaatttgcgaccagccttgggcaacatggtgaaaccccatctntacaaaaatncaaaaattanccggggttgttggtggccacattgcctgtaatcccagcttcttcaggaaggcttnaaggtccgggggaaggaatggctttgagccccaaggaanggtnggaaggttccaantggggtcccaagaatccancccttggggtggaacannaaaccnaaggnctnntggttccccccccatttcccccccnaaanaaaggggagnttaaaaaaatttgggancct

SEQ ID NO: 8546 - DNA, 765 bp, Homo sapiens
  misc_feature 2, 3, 10, 226, 235, 237, 679, 749, 756: n = A,T,C or G
tnnacatcgnttcgaattccgtgctgtcgccagaataagcctatcaaacataggtcaaatggttaaataaagaatgaaagcgtaaaagccatagaagaatttttctgttgtcttggagtagagagaccttcctaagtttgacacaaatcccagaagctataacataaaagactgatacatttgacaacatcaaaatgagatccacttcataagagtaacactgtanacaaagtcnanagatacatgataatctgagaaaaataatttggaaaaaatatgataaaaggagttaattttcttaatatacaaagagcccttaaaaataaataaaaagggtcattaattgaaaaatgggcaaaaggacatggatagaaattcacagaaaagaagtgtaagtggttcttaaatatatgaaaagacccacaaccctcttataataaaaagtacaaatcagagctgcaataagaaggcatttgtaacctatcagattggaagagatcaaaatatttaataatacactgatttggtgacagtgtaaagaaaaattactttcatacattgctggtgagagtaaatggatacgattgctttggaaggcaatttgtgatatttatctaaattatgaatgcccatctcttagaacccagcagttccactaatagggtatccggcctagagnaaccctcccatggtccaatgtcatttggccattattggaatccatgggaaaaattgaaggaccaccaatngtaaatntccctccgc

SEQ ID NO: 8547 - DNA, 834 bp, Homo sapiens
  misc_feature 3, 447, 476, 543, 561, 592, 596, 607, 619, 635, 641, 658,669, 686, 701, 710, 726, 736, 737, 745, 747, 748, 752, 754,757, 763, 766, 769, 774, 778, 790, 798, 816, 817, 826, 831: n = A,T,C or G
cgntcgaattccgttgctgtcgggtttttaagaagtcgttaaacttaatatttactagaatatttgtttttggatggcatctaatatattaatagcccagaaaaaaggcgccactaatgaatatgtcttggattacatagtgacatatattagcttttcgtccacatttgataacattgctaatattttctttttttttactgaagctctttgaatttaaagttttctctcatttaaatttattaattaaaaacatacctttactctgttccctttagcatttcaacctgatgttaaaagatgtgtatgtgtgatatgtgtgtttgaaattttaactttcatcttggagtatttaattctctgaagcagtgcatgactcttgctcttcagcctcttgagagtgtcccctggtttatattcctgatgatacaaaccctggaatttctngctgaagtgttaacactttatttccaggncctaatttgatttgaatagtggaagttcagattcaatgccattaatgacagattctatgttgacttnttcagatttgccagaccngaaaaacctcctttatgtgaaggaaaatcanttangccttttttgnctaatcctcctntggtattaaatggagnacctcntttttcttcatttaagnattgaaggttnaaaaaaggaatcccagnaaggaatggatccancccaggttnttcccccccaagaaantttcctcatnnttaatttnannaatntnggnaaaaanggnaanacccnaaantcccttgggggnatttcccnttttccccttaaaaaaannggggttcgnatttncct

SEQ ID NO: 8548 - DNA, 745 bp, Homo sapiens
  misc_feature 9, 382, 658: n = A,T,C or G
cgtaaaagnaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagntagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataatantattaaaaagatctttgcattctgggcagtccttttaggattataggttgcaaattatccaaatatatatcccatttttaaagcata

SEQ ID NO: 8549 - DNA, 921 bp, Homo sapiens
  misc_feature 3, 4, 6, 8, 9, 10, 12, 13, 19, 20, 21, 73, 74, 75, 79, 86,87, 88, 89, 93, 94, 101, 120, 127, 136, 137, 138, 140, 143,150, 187, 192, 198, 205, 208, 220, 221, 224, 225, 228, 237,242, 265, 268, 272, 277, 279, 286, 290, 291, 295, 301: n = A,T,C or G
  misc_feature 304, 308, 310, 328, 329, 334, 339, 353, 365, 366, 367, 368,374, 377, 380, 398, 409, 421, 422, 424, 433, 451, 469, 479,495, 502, 510, 513, 517, 530, 536, 563, 572, 601, 610, 615,617, 636, 642, 659, 671, 675, 709, 723, 728, 738, 758: n = A,T,C or G
  misc_feature 762, 767, 777, 792, 798, 805, 815, 818, 824, 832, 833, 834,836, 873, 885, 912: n = A,T,C or G
ttnncntnnnannccgtgnnngccgaatgcctgcaggtcgactctaaaggatcccctggagccgacgcctatnnncccnacggtgnnnngtannacaggcngtggccgtccattgcagcntcttaantgggcctcnnntnggnggatttnaaaaaaaaattccccacttgcccttttcgcctggccntttcnttgatnggtgggnggntaaaggttggtnnaanngantttgaaggnccggntttagggacctctgccattgggnttnctgnttgangngaccagnagtnncccnggttcnccntttngnccttctttacaaggtccnnaaagncttgncaaaccggaatccnttgcctttcctnnnntggaangtnttntattacctagggcctgcncttgagtaatnttatttttgccnnanccgctggcntttaaaataggggatccntctcaatttttttccctngggtatttgngggaaataaaaaaaancttttcnaagcctanaangganaggttggcaccanggaccncaatgtggcctggaattttggcagaangattcaagnatgcctggcgccgggaaaatcttgcatanaattttttnggttnancctaaacccttggaggganaagccnttggacccaattaattnggcaaccaattncccnttttttttcttttgtgtttgggaaattaaaaccngggggggaaggccnttttnggggaaaaangggccttttaaattggaatngggnaaaanggggttagancaaattctttttccnccttanggggggnggaaaaaggnaanggcaancccccttnnnangggaaattgggttttgcccttgggggtaacccccttncccaaaaataangtttttttttttaaaaaaaaggttttnaaattggga

SEQ ID NO: 8550 - DNA, 789 bp, Homo sapiens
  misc_feature 1, 2, 3, 13, 31, 32, 33, 39, 42, 47, 53, 58, 60, 61, 63,66, 90, 91, 92, 94, 96, 108, 112, 118, 139, 149, 173, 217,222, 279, 301, 332, 361, 397, 413, 437, 448, 452, 480, 502,599, 621, 649, 654, 659, 663, 668, 679, 686, 700, 704: n = A,T,C or G
  misc_feature 707, 709, 723, 726, 733, 754, 756, 759, 760, 765, 770, 771,772, 778, 784, 785, 787, 789: n = A,T,C or G
nnncttagacctntcgattccgtgctgtcgnnngtgtgnaanctacntgtggnacccntnncnaangtgtcccaacatttttttgacctnnnancncacaaacccggnctgntcattnttcaagtgtaaaggccatggnttggtgctcncaagcatgaaagcccttggggaanatggtgtccaactttgggtggggcccgtgggaggctgaacaaancctanccattggggagctgggtgaagtcagaacaggaggactgggtaggaaggagagacctntttcccttatagaatgactaancactgtgggaaatatgggtttcaaaaccaantcttgaaaatttataaacaccagtgtaancctatggagaaggttggtgggactcaaattcctggngacataggtactttcnccacctcatcttccttaatggaanggaaattcttnaccngatgataaaataaaaaaatattgggccnggtaggtaaaaaaagaaaaganggttcatgcattatgtaaaaattaccaaaaaggcttatcattgaaagtaaaaaataatgttttaaatccaaccacttcttcccatcactcccttatnctggagcaccccctgtcccttncaaacatctttgacttttttttttttgngacanaaatnttanctctnccccaaggctnggaattncactggggggagantttnaananctactggaaacccnccncctcccngggttcaagccgaattttccntnccnnaaccntcccnnntagctngggacnnancn

SEQ ID NO: 8551 - DNA, 1209 bp, Homo sapiens
  misc_feature 11, 17, 18, 20, 22, 23, 25, 26, 27, 30, 31, 32, 39, 41, 44,46, 47, 48, 53, 54, 57, 58, 61, 62, 63, 65, 66, 72, 73,74, 76, 77, 78, 79, 80, 81, 82, 83, 84, 85, 86, 87, 88,89, 90, 91, 92, 93, 94, 95, 97, 104, 106, 113, 125, 126,127: n = A,T,C or G
  misc_feature 128, 129, 130, 131, 132, 136, 138, 140, 141, 144, 145, 148,151, 161, 168, 172, 177, 201, 205, 206, 214, 215, 216, 222,230, 231, 233, 234, 235, 239, 242, 247, 248, 251, 253, 255,257, 258, 259, 263, 264, 266, 267, 270, 271, 277, 278: n = A,T,C or G
  misc_feature 279, 280, 284, 285, 292, 296, 301, 302, 303, 306, 310, 311,314, 318, 321, 324, 326, 332, 339, 340, 345, 346, 361, 363,367, 369, 377, 378, 382, 384, 385, 388, 390, 394, 399, 408,412, 414, 416, 420, 421, 423, 424, 425, 426, 438, 442: n = A,T,C or G
  misc_feature 447, 453, 465, 471, 482, 484, 489, 495, 499, 506, 508, 525,529, 531, 533, 534, 535, 536, 539, 542, 543, 547, 550, 561,566, 567, 569, 580, 582, 591, 602, 603, 604, 610, 613, 614,617, 621, 622, 624, 625, 628, 634, 635, 643, 655, 661: n = A,T,C or G
  misc_feature 664, 665, 671, 674, 687, 692, 693, 697, 698, 703, 709, 710,721, 722, 734, 740, 764, 766, 768, 770, 776, 777, 778, 781,783, 784, 787, 789, 800, 808, 816, 819, 826, 830, 837, 839,865, 866, 872, 875, 877, 879, 883, 891, 893, 897, 902: n = A,T,C or G
  misc_feature 914, 918, 922, 923, 934, 938, 941, 947, 959, 962, 972, 976,992, 999, 1001, 1008, 1015, 1019, 1023, 1024, 1029, 1032,1033, 1036, 1037, 1040, 1041, 1045, 1046, 1047, 1053, 1054,1057, 1058, 1074, 1079, 1080, 1081, 1083, 1085, 1087: n = A,T,C or G
ccccccacganccgaannangnnannnacnnngaggggngnggnannnggggnnggnncgnnngnnggacgnnncnnnnnnnnnnnnnnnnnnnnantgtcgtngnacctttngggaaacccccnnnnnnnnggcngncnnggnnacncgnctgggggggnggcggangcgnggggntttggccccttttttttctgaganggcnncgagcggnnnccgggngggggganngnnngggngcnggacnngcncntntnnnggcnncnncgnnagaggnnnngggnnggggccnacanagagnnngancggnngcngggngcncangnaggggnggggagnnggagnncgtggatggtggtgncngcgngngagcgggnncggncnngcnangatntgcgntgaccgccntagnangngggnngnnnnctaaacagcgtngtangtaanataggnggggggggcagnaatacncggaggaaggngnagggngaggcnggancgggggngnggcggcagaacctcggncggncngnnnncgnagnnagcnggncctcgagtgtnagggnnangggggcggggnanaggggccancaagggggcannnggaagncgnncangggnngnnctnggcggnngaacccgngggggcggtggngggaanaannaaatgnggngaagcccgagggnggtgnntaanngaacngggggnnggggggacgannacgggggggganggggcncatagggagcacggtacagggagnancngntcaagnnnagngnngtngngcgccgggagnagcgaggngggaggcncgngggcggngganagagccncnggaccgaagaccgggggaaggggcannaagggnggngnangganataggccnancganccacnggggaccccagngggnagannacagaggtagnacgntangggggngcaacggagcanctnaggagccccnaggncggcgcagggtgtcangggaggncncaacgtnagagcgngggnacgnnggggnggnncgnncanngtgnnnaacggnnggnnaggaggacgggggggncggtnnnangngncnacagaggcagggngngaagcacnnngtacatnacggatganngatgggncngaggggnnggngnngggacnnccgntgnnggganacgaaggctcggaggcncnncnacaccgggggccg

SEQ ID NO: 8552 - DNA, 784 bp, Homo sapiens
  misc_feature 1, 2, 8, 15, 16, 21, 48, 54, 59, 75, 79, 81, 91, 125, 142,146, 170, 181, 188, 190, 201, 207, 209, 236, 246, 302, 344,446, 468, 483, 561, 572, 597, 603, 607, 656, 667, 671, 679,695, 709, 740: n = A,T,C or G
nntccttngaccttnngaagncgcatggttaggaagaactgttccacntacacntgacnttggagtcagttaatngatntntttggagatnggcctttcaacagttttcatatttgaagaattanaaatgaagtccgttcanattntccaaagaacctccagccactggngggggacattnttaattnanattcctatcanttggtntntcctgtccctgaaaacactgatgaggnttgggagganaatcccacctttccctgcagggggttaggctgggcagggcagggaggtgagggcgnctggtccaaaacactggcaagggatgggaacctaacttcttnttgtgcttctgatttgcccttgcaggtgtttttccaggtctgaccacctggcccttgccatgaagaggcacctctgagggacagaaaaggtggatcctgtangctaaaaggctttcaggctganagccgcccgtggaangagggatgcgtgttccagccaaagcatgccgttcttgcacccttacccaagttgccttccagggcctctccttggaangtctttttgangggctaaaaaaggtcttgttagaanccggcnatancaccccgtggtgcatgggtattgtgggtgaccctggactcgccactggntaccccgcccnttcngaagcggngccctaacccttttgncgtggagccttccncacttgagaaatgcttaatgggttggggttngaattggtattgttgaaggaatcttattacttgacccgaatgat

SEQ ID NO: 8553 - DNA, 1538 bp, Homo sapiens
  misc_feature 12, 13, 15, 17, 19, 23, 24, 26, 27, 29, 30, 32, 34, 37, 38,39, 40, 42, 46, 47, 48, 50, 52, 53, 54, 55, 57, 58, 66,67, 68, 71, 72, 76, 77, 81, 82, 85, 86, 88, 89, 90, 93,94, 100, 109, 110, 114, 115, 117, 118, 120, 121, 123, 124: n = A,T,C or G
  misc_feature 125, 126, 127, 128, 129, 130, 131, 132, 133, 134, 139, 140,156, 160, 161, 162, 163, 164, 165, 166, 167, 168, 169, 172,174, 186, 190, 193, 194, 198, 199, 200, 201, 207, 215, 216,217, 218, 221, 222, 224, 232, 233, 234, 235, 239, 240: n = A,T,C or G
  misc_feature 243, 244, 254, 256, 258, 265, 269, 277, 278, 282, 290, 292,295, 298, 304, 313, 314, 317, 318, 329, 332, 338, 346, 351,353, 355, 358, 361, 363, 364, 373, 374, 380, 388, 392, 396,399, 400, 401, 405, 406, 410, 413, 424, 425, 429, 434: n = A,T,C or G
  misc_feature 441, 442, 450, 451, 462, 465, 475, 477, 485, 487, 492, 494,500, 503, 507, 510, 511, 519, 525, 530, 533, 538, 546, 547,549, 550, 551, 552, 553, 556, 558, 563, 570, 571, 575, 576,585, 590, 593, 597, 598, 599, 600, 607, 616, 619, 625: n = A,T,C or G
  misc_feature 629, 631, 636, 639, 641, 643, 651, 653, 656, 660, 662, 667,669, 680, 681, 685, 688, 690, 692, 697, 698, 700, 704, 705,718, 719, 720, 744, 747, 752, 754, 757, 760, 775, 778, 779,784, 788, 791, 794, 796, 802, 806, 816, 819, 822, 827: n = A,T,C or G
  misc_feature 835, 836, 840, 843, 847, 850, 854, 855, 857, 859, 862, 866,868, 872, 880, 882, 883, 884, 911, 914, 922, 924, 931, 933,936, 940, 943, 944, 949, 950, 951, 952, 954, 956, 972, 973,976, 978, 980, 982, 991, 992, 997, 1004, 1005, 1008: n = A,T,C or G
ccccggcggganngnangngcgnngnnanngngnaannnngnaggnnngnannnngnnagaggagnnnganngcgnngcgnnggnngnnnganngagggnggaagaggnngaannannanngnnnnnnnnnnnntgtgnntaaacccttgggaaancccnnnnnnnnnnaananagagcccggagngcgngannagannnngggganggggggannnnacnnantttttttnnnngcanngcnnggaggggganangnggaggantcgnggaggggnngggngcagatgntntgnagngggganagaggaggnnagnngaggggaggangcngggagnaatgaggnggggnangnggnggncnngcccagganngggggngggggganacgngggngannnacgnngganganggggcaggaannggangacgngacggcnnacggacgnngaagggggggnccncgaagcacgngngggagcgncngagangngtgcgnagnggancgnngaagagangggacngaggnggngaagngagggggnngnnnnnagngnggganaggacanngacnnagggagggnggatnatnacgnnnnagcgcanagacgaagnganacgcgngggnanaggangcncngngagggggngnggnaaangngacgnanacgggacgggnnccgnagngngngaganngnaggnnggaggaaagggannnggcgggggaggggaaggggggggnganggggnanggnaangggggaggggggggnganngggangggnaanggnangaaagnagcnaggggagggnaanaangggancaagggcnnaggnaangganggngaanngntnggnacgngngaancaagagcnannnggagggacaagccacgggaagaggaanggncgggaagngnggggcgnanggnaagngtnngcgannnnancngaggcaggggtcgcgnnggngngngngacggggtnngaagnagacggnnganacgngggnacgntganggnaanggtacgggngancggaggcgagngnaggggangcnagggangggngacgnnangagancgctcgatcgntgaanggcngggaagagnggggcgggtnaggganggngangcnacgcanggggaacggnannggnngngatagnanagggnacgcgangnnggggcgcanacggnacncgnangcggacgngganggaaggggggagggangngnncgngcgggtnagccgcnngngcgnangnnggggngnggaagcgggangcgatngggatgggcacgtacgggaaggggggaganacgngaangnanggnggagggngcgggangganggggacgngaagngaagcgacggcnggganagncntggncgcgaagngcgggaagnngcggatccnngaangncacggncnnngcnnagcncgnagnacgannaaggcngtgtgtangnncacacggnngncncggnccacgggaccgcnaaggnaccgagggacgcgantgnnccg

SEQ ID NO: 8554 - DNA, 786 bp, Homo sapiens
  misc_feature 3, 8, 9, 23, 31, 34, 40, 70, 75, 81, 83, 85, 91, 98, 104,131, 135, 141, 145, 148, 149, 156, 157, 163, 181, 196, 199,213, 228, 248, 250, 253, 258, 273, 301, 322, 349, 351, 519,620, 622, 623, 633, 639, 662, 685, 694, 722, 768: n = A,T,C or G
cantttannccctttcgaagccnttgctgangancctccnactcatatcattgtccctatataactgagngtcancagagntntnaggttnggccttngggatnaccttcattttccagggtctggccctntgcncttcanccanagnncaacctnntgttancagctgctactaagtctntatgcccattcgttnatnccacaaaacaggcntctgactcctctggncaccatggaacaaggcactngnaanaggcngggggtccacaggcncagggggcttcactctggaacaggatanctggggtgcagcgggatgtantcctcacttaatcaacccacaccccancntcccctgagctttctctaaatctcattctaccccatcttgactcttcggttaaaagggagttctcatttggagaatttgtctctgggattaatgaagtgtatgcctagctactttctccagttacttttagaccatattgttgtttggttttgaatatcattccttangctatgttgagaagtagagtggcttccattaggagaactaaatttagggcatgtcttttgctgaatcccgtcagcatatttaacaaaattcccaattctanannaattttcccntttatntctcttaagtacccttttgccangggcttctaccacatcaaaaggnggttcatgnaagtaatttggccaaaaggaaaagaacnagttaattgaccacctaacaccataaatggaagtggattaagttantggttccaaggccattgg

SEQ ID NO: 8555 - DNA, 746 bp, Homo sapiens
  misc_feature 7, 12, 74, 97, 100, 111, 115, 145, 551, 610, 617, 640, 650,660, 662, 715, 717, 726, 743: n = A,T,C or G
tactcgntcgantccgtgctgcgcaaatctttgcccttctaaagcccaaaaattactattccggatcatagatngtttactgctgccacatgcagtnttncagcaagagangganctgcctgcacctatgttgtcagcaattcanaaaagtcttcctttgtatctccagggcatgtgtatcgggtgttgtcaatctcaaaatccgaatgcctatttgaatcaattgctagggaatgttattgagcagtatattgggcgatttcttccagcttcaccatatgtttcagatcttggacaacatcctgttttgctggcattgagaaacacagccactattccaccaatatcatctctaaagaaatgcattgtgcaagtcataaggaaatcctaccttgagtataaggggtcctcacctcctctcgcttagcatccattctggccttcatcctccaactcttcaaggaaactaacacagacatttatgaagttgaactactcctccctggcattttaaaatgcttggtgttagtcagtgaaccacaagttaaaangctggccacagagaacctgcaatacatggtaaaagcctgccaagtggggtcagaagaanaaccttnctccagctgacttctgtgtttangcagtttatncaggattatngnatgaggtctattaccagggttacagcattttaaaaacagtagccacattggancnacaggtggncatccacttgattctancct

SEQ ID NO: 8556 - DNA, 781 bp, Homo sapiens
  misc_feature 1, 2, 3, 4, 5, 16, 21, 75, 85, 89, 100, 115, 118, 120, 125,139, 141, 148, 150, 158, 164, 173, 194, 263, 333, 401, 413,441, 490, 505, 588, 631, 633, 635, 639, 644, 647, 682, 687,697, 700, 709, 723, 730, 746, 754, 761, 763, 772, 781: n = A,T,C or G
nnnnnttgaccttccngctgncggctctacgatggagtcaaggccagattgggctctatttccacaaccccctanggagtttttnaccnttgtcctaagnggctgtttcctgggngancntagancatatttgctgtcncnctgggantnccaggganaatctnatgcttggncagaggacatgatcatctttntgtttgtaacctcgggcctggaacagtctccttttgtgttcacttgattctgaaaggtcagtgttttanaacaggcttttcacatggttcaccaggaggccagttagatcctgtagtggaaagggcaaactcatggcancccttctgctttctcaaggcaggatgcttgcaaggggcagtgaggtaagaccggtggacaccgtgganggagaacaaaanggggagccccaggggcatctgcagccangtggacccgttcagccttctggcacacatctgtttggcttgggtgggangtatgaagggcgcanatctgaaaaccaagtggtgacctagggagggaacaagcgctgtgcagcattgatgaaacttaaaagatgaagtcctggtcccnggcaccggtggctcacttctgtaattccaacactttgggaagncnangcangaaanatngcttcaacccccgaccaaaaaaaaaaacccaaaantttanccggggccgnggngacattgtncctttagtcttaanttactcngggaggcttgaggttngggaaaanaattttnanccttggganggcaaagcn

SEQ ID NO: 8557 - DNA, 753 bp, Homo sapiens
  misc_feature 6, 10, 25, 75, 76, 79, 80, 93, 104, 124, 129, 148, 157, 169,184, 190, 227, 235, 255, 261, 279, 281, 283, 285, 291, 293,335, 353, 436, 495, 497, 513, 557, 589, 599, 604, 608, 649,658, 688, 689, 690, 691, 692, 693, 694, 695, 696: n = A,T,C or G
  misc_feature 697, 698, 699, 700, 701, 702, 710, 718, 722, 725, 728, 729,731, 736, 747: n = A,T,C or G
tctctncganttccgtgctgtcggnctttggttgctgttctttcctagactcttcagaaaaaaaggaattacctnncanngcttaaagaggtngtaaatccaanccaatccattttcattccanctgcntttcatgcttcaaagtaanggctgttanccagaatcactngtgaagctttatccncatatncattctgtgatcttattccctgtaaacccctattcantagtcggnctgtgatgaaatcccaggcntcttcnttcaggttaaaaaaaatntntntntgtctncntgaaattctggtattccctgttgaaaaccagtcttaagttanaggcattctgcagttgtncggaaagtaagggaaacaaagttaaaatggaaaaaattgaattaagaggcagaagtaatgaatttgatcatttgtcattgccnctcattgtagacacttatttttgatctctgtaaacatcagcttattctcaaagtatgangnctgaatacttgcttgngggtgatcatctttgtgtagaatagaaaagacaaagtaggaccnggtgcagtagctcacacctgtaatacccggcnctttcgagangcccnaggnggtagaaatgcttgagcccaggaatcaagaacagccctggncaacatggngagaccctgtctcttctggaaaaaaaaaannnnnnnnnnnnnnnaaattccnggggcccntttntcnggnntnccccnctttaaaaaanccttgg

SEQ ID NO: 8558 - DNA, 747 bp, Homo sapiens
  misc_feature 6, 11, 85, 117, 126, 162, 210, 551, 589, 612, 616, 629, 648,661, 665, 670, 689, 731, 742: n = A,T,C or G
atgtcnttcgnatccgtgctgtcgtcctcctttatgagaaaagaaatagaccctgatagatgaagctataaagttctataacatntcttcattgaacgtgtgattttttttaaagtntaaatagcntattcatatttttgcaaattgcttgttttcagtacncagcgttttgagagctgtgtatgttaatgcagttgactcccgaacagngggtttgaattgctcaggcccacttatacctagcttttattcaaccaaacacataatggccagcatatatgaggagctaacttttcatatgtgtggtctccacagggccgactgcaggacttgagtatgcatggatttggttatatgtgggtggtcctagactagtctcctatgtgtgccaagggacagctgtacatgtgggcctaatcctttccttttaaaaatttatttgagatatcatcattcatataccatgcaattcatcttcagtggttttaaaatatttaccaagttgtggcccggcatggtggcttatgcctgtaatcccagcactttgggangccgaggcgggcagatcacgaagtcaggagatcgagangcgcctgtagtcccagctactcnggangctaaggcagganaatggcgtgaacctgggangtggagcttgcantgangcganaatgtaccactgccttcanctgggcgacagaacaagactcatctcaaaaaaaaaaaaaatngccagccttgnggctt

SEQ ID NO: 8559 - DNA, 732 bp, Homo sapiens
  misc_feature 3, 10, 27, 34, 59, 62, 71, 79, 83, 96, 110, 112, 126, 136,149, 153, 159, 160, 163, 164, 167, 185, 193, 194, 196, 198,199, 207, 208, 214, 224, 231, 234, 236, 237, 247, 259, 260,263, 265, 266, 268, 272, 274, 284, 285, 296, 302, 325: n = A,T,C or G
  misc_feature 329, 342, 354, 358, 361, 386, 389, 393, 401, 416, 421, 457,463, 471, 481, 488, 492, 505, 506, 517, 522, 527, 557, 583,593, 600, 610, 615, 625, 628, 649, 655, 693, 695, 717, 730: n = A,T,C or G
ttntgacgcnttcgtgctgtcggcctnatccctntagacaggactacaattggcagctnccnattacctgnatgtggangganactttttttactntgcgtgttctggcntnagcgtgcatctggngccttgcacntgatgctcacatncctnaccctnnctnnggngtcaaacaatgtactttncagggtgnnantnntctccatnnctattngaagtggctngaaaaangcnannttgactcttntgacgttggatnnaancnncnaatnanccctcgagtnnttcaatgatanctgacnaactaaattatttccctataaangaanatgacatgagtgntgtgtggtttgnctanacnactgcatttacagctttttcagggntantcgnagcactgnacgttcagatgcatnccaantggtgcatgggtcctaatcacacatataaagctggntaccanctttggcncagcactgtnatctggncaancaactgtggtaannacacatgtaanatgcnttttnacagctgatactgtttcagacaaacccttnatgcaaaatttggctttagattggcnctttttgaanatatgcnacaaatatgngatgngatgccgganggncgttttgtcttaatgggaaantttaantccttgtgacacttacaggttctttgagacatgacttngnaaggatgggcctatttctcctntgaatgtcatagnag

SEQ ID NO: 8560 - DNA, 821 bp, Homo sapiens
  misc_feature 4, 11, 14, 91, 105, 111, 113, 117, 125, 137, 153, 163, 183,198, 200, 206, 210, 224, 267, 285, 287, 294, 326, 383, 421,446, 469, 522, 538, 557, 579, 594, 614, 624, 628, 666, 680,714, 729, 780, 791, 795, 796, 800, 818: n = A,T,C or G
tatnttacgcnttngtgctgtcggggggatcaggatactcctgctcacagacacccatctccccctaccaaaaataacgctgggctcctcnttccaccctgactntgcctntntgtntgcaggancctggtcggggngctccacaaaagctgngcctgggctngggagccaaggccatgtccntttcccggccagggnanacggancccntccacagtgtcagntatggccatgtggccgcctgccagctaatgggcccccacaccntggccttgagggtgggananagccagntcctcctgcaaagcccccaggtggaaaaaatnatgcagctggtgaatgcctacttggccaacccctcccccgagaggccctgcagaagnttttttcctccatgccaagacctgccagacacctcccntccaagccagcgcccggcctggacnagcccaaggacaagtctggctgnttggggcaacttgcaggactgagcctgccaagaggtcacgacttccttcttgncttcagcctgggccangactgctctgagatttganggaaacatggaccctttttggnccttgcaggggacangggcacattccaacaacccnaaggcttacnaatnggggtgtggggtaaatttttctaagtttggtttccttnaaatttaatttggnaagaaagaaaaaacccaaaaaaaaaaaaaaaagnttttttttttttttncccccaaaaaaaaaaaaaaaaaaaaaaaaaaatttttttgggggggccggntttttttttcngggnnaaancccccaaaaccttttaanaat

SEQ ID NO: 8561 - DNA, 921 bp, Homo sapiens
  misc_feature 4, 6, 29, 88, 91, 146, 218, 378, 413, 482, 485, 500, 508,531, 573, 577, 585, 623, 637, 642, 651, 662, 697, 704, 724,731, 778, 835, 837, 839, 842, 852, 868, 882, 884, 885, 891,892, 899, 901: n = A,T,C or G
ttancnaacccctttccaagccgggggcncgatcttaaggacagtcgctccctgaacgcggagccggaggagacgaagggaaggtggnttngacgccacccgcgcaccgggcaggcgcggagaccggcgtgggacagccacctggngcgcagctgccagaaagaaggactttgctgctttgggccaggatctgaacttaggtgtaaaccattgccctnggcagaagggaacctaccccagtccattgctggcctgctacaagaatattgaaacagtaatgggcacaatatttttgggttattgaattcactcaagtgggactggtgggaattggaaatggaaactggtattcccattcccccaatcaatgaatggtancaagaaaacccaaggtcttcttttcaacttaaatngggaagttcttcaacttcttggttggcccccaaggccttgggaagtggccaaatggggtgccaaaatcnttngggcttttactgggnaacccttnccaccttaccattgtttcaaagncaaattcttccttggccttcaagccctccccgaagtaggttngggnacttacangcaccgttgcccaccattgcccaacttaaatttttggnattttttaattaanaaacnggggtttcncccatattggncaggcttggtctcaaactccctggaccctttatgnatccctncccaccttgggccttccaanggggctngggaattacaaggcgttaaaccaacccggttcccaaacccctggggnttaatggaatttcctaaaaacacctttttaaaatcaatttcttaaaaaaaaattttntnanggnggtttggtanaaaaatttaaaagggnaaaaaaatccctcnannaaatannttttggnancattcattaaaaattggcct

SEQ ID NO: 8562 - DNA, 773 bp, Homo sapiens
  misc_feature 1, 6, 23, 106, 339, 374, 466, 507, 557, 560, 568, 571, 574,586, 604, 610, 625, 638, 657, 669, 675, 694, 697, 699, 704,710, 716, 726, 734, 740, 741, 752, 753, 754, 755, 756, 757,758, 759, 760, 763, 767, 768, 769, 773: n = A,T,C or G
ntactntttaccaccctttgctntccgttctcatggctatggctaaagtgtaagagggtaagcctccttgtacaagctcatgtaagattcttgcttatgtccgtgnactactcacatctcaattggccaaaacaatgcccaaatttgccaaagtccatggatgggagggattgcaatgttatattgaaaaaacttgatcatagaagggggggagattggaccagtcattcacctccccatatcttgccagccattaatatgaatacatattctatttgatattaattgttatctcctgctcatgagacagggcttgctccctgttacttctttcctcantgtctgtctgagtgttgcctgtcctggaattatanatatcatttgaagtattggttggataataaagaatgaatgagcccggcatggggtgcatgcctgtgatcccacacttttggaaggccaaaanggtggattgctttaactcaagggttcgaaaccactggcaanggggtgaaacccccatcttgcaaaaaagcccattattaacccgacctggnggngcatgccnggnggnccctggctaccncaaggaagctttaaggtngggaanggttcatttttgggncccccgggacaanttgaaggctttaaaattgnaattcttttaanccatgncccatttggcccttccaanccntngggtnaaaaangggggnggagaacttntttttttnaaaaannaaaaaaaaaannnnnnnnnttnttcnnncgcn

SEQ ID NO: 8563 - DNA, 644 bp, Homo sapiens
  misc_feature 7, 13, 22, 24, 26, 52, 53, 62, 65, 67, 82, 83, 89, 113, 146,151, 164, 178, 181, 185, 221, 223, 229, 236, 241, 308, 326,337, 396, 463, 496, 517, 531, 533, 587, 613: n = A,T,C or G
ttactantgaacnccttttctnananacgtgactcgggttcctctagaaaanncagtgggcngantnaaattccaaaggcanngggganctggaggaaggccttaaccagggncggcggcttggtaaggtttgtaggaggactggntgcancaaaggcaggganaccagtgtggagtntgntcancaccccactgggaaggtggtgatcgccgtggtgatnancagttnttggtanctgcntgtgaggagggtgacaggtcaggactttacctcaggaaaccctgtggatggtggaggggaaaatcanctggttttggtccgggtncttttgagcanctgtgaagacctccaggacagtcccaatcctggaatgtcttgactaaccagatgcttanacttgggtctttctcaaccgtcttgggtacaatctgactctccactttcttggcctcctggctttanttgcttattggaaatgggcattttatcagcagncgtgatggatactatggtcangactgtacccactntnctcttaatatcaaacaaaaagtattaccaggactttatatgctactgctgggtntatccaccatcataagtaatgaaatnttactagattaacactgcactagaacctttt

SEQ ID NO: 8564 - DNA, 1127 bp, Homo sapiens
  misc_feature 13, 14, 15, 16, 17, 18, 19, 20, 21, 22, 23, 24, 25, 26, 27,29, 30, 31, 32, 33, 34, 35, 36, 37, 38, 39, 40, 41, 42,43, 44, 45, 46, 47, 48, 49, 50, 51, 52, 58, 61, 70, 75,78, 81, 86, 87, 90, 91, 92, 113, 123, 124, 127, 129, 130,132: n = A,T,C or G
  misc_feature 138, 150, 160, 164, 167, 173, 181, 184, 185, 187, 198, 200,209, 213, 215, 218, 220, 225, 232, 234, 244, 246, 247, 248,249, 250, 251, 252, 257, 259, 261, 264, 265, 266, 269, 270,272, 273, 275, 276, 277, 278, 279, 280, 283, 284, 285: n = A,T,C or G
  misc_feature 286, 292, 295, 297, 303, 305, 306, 309, 310, 311, 312, 314,318, 319, 320, 321, 323, 326, 330, 331, 332, 336, 337, 339,340, 341, 342, 344, 345, 353, 354, 355, 364, 365, 369, 377,379, 380, 381, 382, 385, 386, 387, 388, 389, 393, 400: n = A,T,C or G
  misc_feature 404, 405, 406, 407, 408, 414, 415, 417, 420, 421, 422, 428,429, 432, 434, 436, 437, 440, 441, 442, 443, 445, 446, 448,449, 451, 453, 455, 456, 467, 469, 471, 473, 476, 479, 480,482, 484, 485, 496, 501, 503, 504, 505, 506, 508, 511: n = A,T,C or G
  misc_feature 516, 520, 521, 527, 529, 536, 537, 540, 543, 547, 556, 562,564, 567, 568, 572, 575, 576, 583, 585, 594, 595, 596, 597,601, 604, 606, 611, 613, 614, 615, 620, 622, 629, 632, 637,651, 653, 665, 667, 668, 684, 690, 692, 694, 695, 702: n = A,T,C or G
  misc_feature 704, 705, 707, 720, 722, 723, 724, 726, 729, 735, 738, 741,749, 751, 752, 754, 755, 757, 764, 767, 776, 779, 781, 786,793, 796, 800, 801, 803, 808, 810, 813, 817, 819, 830, 831,833, 838, 850, 853, 858, 862, 863, 866, 869, 871, 879: n = A,T,C or G
ccccccccccccnnnnnnnnnnnnnnngnnnnnnnnnnnnnnnnnnnnnnnngcgttntgnctcgagcgnggcgngcngcntttcnntgnnnggggggggggggggttttttntttttcccgnnggngnngngggggnggggggggggcncgcggggcgntttnttnggtggnggcggggncgnngngccgccggggncnccgccgggngtgncnggngncgcgngcgcggncnccgggggggngnnnnnnngggcngngnggnnncgnngnngnnnnnncgnnnngggggnggngngcgggngnncgnnnncnccgnnnngncgngggnnngggnncnnnngnnggcggggnnnggggggggnncccngggggggngnnnngcnnnnncggnggggggngggnnnnncgcggnncncgnnngggggnnccncngnngtnnnngnngnngncngnncgcggggggcngngngnggnccnngngnncgggcggccgncggcngnnnngncgngccgnctcnngccgtngnccccggnnggnggnggcngcggggggngggccncnccnngtcncgnngggggcngnggggggggnnnnggcnggngngccgngnnnccggngncgggggnggnggggngcggccccccgggncnggggcgggcggncnnggggcgcgtggtgggnggcggngngnngccgcgngnngnggggcggggcggncnnngnggngcgcgnggntgnggcggggncnngnngngggcgcncgnggggggacnggncnggcgnggcgggngcngggnncngcacngnggngggncngggggggcgcnngnggggnggccgtgggccnctncgggngccnngcngcngnggggggcncccncngggntggnggggggctgggcgggncnnnccccggncncgncnnngncgccgccgnnggcnnngngnggngcgcgggtnccgcgnggtggggnntgngnngcngccgnngggccccgggnngcgtcggnnggnngnncngttcgcgggggcggnggngngcgncggcntgggnnnggggngggngcntgcncgncgngnctggnngncgggtgntggccggcnnggcgcnggggccggtcccg

SEQ ID NO: 8565 - DNA, 1109 bp, Homo sapiens
  misc_feature 1, 21, 23, 56, 64, 67, 79, 99, 108, 110, 115, 120, 127, 129,130, 147, 149, 152, 176, 177, 179, 180, 182, 190, 193, 197,199, 210, 222, 223, 225, 226, 247, 253, 254, 255, 261, 266,268, 271, 285, 293, 299, 303, 318, 323, 334, 335: n = A,T,C or G
  misc_feature 339, 348, 354, 363, 365, 368, 371, 376, 381, 383, 385, 387,393, 401, 403, 405, 407, 412, 419, 426, 427, 428, 430, 433,443, 445, 447, 449, 452, 459, 460, 463, 466, 468, 482, 483,484, 498, 499, 508, 509, 513, 514, 523, 524, 527, 532: n = A,T,C or G
  misc_feature 538, 548, 552, 557, 562, 563, 575, 578, 587, 593, 595, 601,602, 604, 606, 612, 618, 620, 621, 624, 630, 631, 641, 643,651, 655, 658, 660, 663, 671, 673, 684, 687, 690, 692, 694,696, 699, 702, 707, 709, 711, 713, 716, 724, 730, 733: n = A,T,C or G
  misc_feature 744, 751, 756, 757, 758, 766, 770, 773, 774, 778, 782, 784,791, 792, 798, 804, 817, 821, 823, 828, 832, 834, 848, 850,855, 857, 859, 865, 867, 868, 869, 877, 881, 883, 888, 891,900, 901, 906, 908, 909, 913, 916, 920, 923, 925, 927: n = A,T,C or G
  misc_feature 944, 948, 949, 952, 955, 958, 963, 967, 970, 974, 975, 977,985, 988, 991, 1005, 1010, 1012, 1023, 1037, 1038, 1045,1047, 1052, 1057, 1058, 1062, 1064, 1068, 1069, 1071, 1076,1086, 1087, 1092, 1097, 1098, 1100, 1103, 1106, 1108: n = A,T,C or G
nacctatcgacgttctcagcngnagccaaaacgtcgactctagaggatcccaaggntccgggtnggncctccccccggntttttctcttttactggganacatgagancnaacanggganatagggncnntgggtccatagccaatngnatncaatgtgggtgcccccatcctccnngnngntagtcttntcnccananaggaacccganccagcttggggnnannttttggctctcctacacgctngtcgtnnnttttancctcngngcntgaagggaaagtantgatggangaactngtgngcatgataacaaagntgcangaaaaatcatnngccntactgtccncttgantgtaacaancntcnttnttacntgtcnanantncacccnggaatggncntngnccctntgcgtantgtgggnnnanttncaaaaccccngntncntancttactnncantantngccccacctggatnnngcatagggtttggnngaagacctnnaccnnataattgtnnacnactgnaaaaantggtgaccantcgntcctnggccnnaccctaactaanacntctactatncttcgnanaaaaanncntncttttntattangnnttntagatnntatgaacctncncccttggntagnctntnacntaaataantntattgtgccangcnccntncngntgnaangccantnanantanaaaaccantgtctnaantcagagacacnattttgngcccnnngctgaagnaaanaanncttnattngntttcacnnggatantagttntttttataataanaccncnagaancttntntgcctaatttaacntntactntnanataaangnnntacaccgntatnancttgnganatataaaannacaancnntggnatntatnctnancnccctagctcataaaacnctanntancgntgnggatnatantanaacnngnggctctcnccntanattggaaaaaccantggtnangcttttggaantcttatttatagtnncgtacgnanatgtntaccnnatgncncttnncnaaaanaactatagtnncttcntcttnntnganatnang

SEQ ID NO: 8566 - DNA, 782 bp, Homo sapiens
  misc_feature 10, 19, 447, 522, 530, 536, 542, 560, 581, 588, 606, 613,617, 624, 628, 641, 652, 661, 693, 703, 708, 713, 733, 738,754, 782: n = A,T,C or G
tattttaacncctttcganttccgttgctgtcggatagggcaatccaagagacatagtcctaaccccagagtagcatgtaatcccttcttagcatccctctttgaaaactgaagatagtacagctgagggaactgaacaggttcccaggatcatagagaatcattaagctgaagcaaacaaacaaacaaacaaaaggcaaactagaagaaaagcaggattcaatgggttctgcaccttcttagtctatcattgctttgtaaacattctccggttttacattactacagaatatggtccagatataaagttctactgtgtcataagacagctgattttcagaattcgtgactgacagaaaaaacaattttggatttaactggatacagtaatctgaggacaactgcagttgtcaaccttttcttcctttcattcaatgataaaagatncaaaaagtgcaccagatgtttctagctatttgtggaatgaaggacatataaataattttttttttttttaaatanacagattntcactnttgtcncccaggctggactgcagnggcacaatcttggctcactgnaacactnttgccttccaggttcaanaaaattnttgngccttancctncccgagccagctnggggagtacanacccctggncccccataccccgggttaattttttggggccnaaaatacccncattnggccnggcccacctttttatttaanaaaanattggggggcaacctnttgctttaaggacctcttgggatttttn

SEQ ID NO: 8567 - DNA, 748 bp, Homo sapiens
  misc_feature 1, 3, 4, 5, 12, 15, 20, 619, 624, 663, 671, 685, 691, 729: n = A,T,C or G
ntnnnttaccancgntcgantccgttgctgtcgataactttttactcatatcattgtccctatattagtattaagagcattttgtataaaacttcatgtgaggatctcaattctttataattctcttcaaagcaaggaagtatatatagagagacctttattttttagtaattttttcaaatggtttgggagatcttattctagcccaattctattctggcacttaattattttctggtggcttgtaatatggtaaatactggattccagattgcattcctatttccttgggaggtgaggatactcccatttgtacaagaacttaaaacagcccaaaattattggtttactttgatctgataagttttgattgtggtgatgtctcttaataccgaatggggctacaattttaggtctgtgaaattataaatatcagcattctgactaagtatccagaggcagatgaacttttaggatcataattttcctgtgctatatggattttaatttttccctagtcttcactttctgttcagtaattttatagccctttggaagagctttatttgagaggctgtgtcttatgttgaaactgtcttcatcgtgcaaatatgacccngtttnctgtggagtcttcataggtgactatgacaagtacctttnccatcaancaccttctcaatgnccgaanaactgtagcatcagcttatgtggttgctaccccctggnctttaattccatatttccg

SEQ ID NO: 8568 - DNA, 748 bp, Homo sapiens
  misc_feature 5, 8, 82, 89, 90, 91, 430, 441, 451, 457, 472, 481, 490,493, 500, 516, 532, 546, 558, 600, 608, 632, 643, 652, 658,670, 672, 690, 692, 696, 715, 722, 735, 742, 745: n = A,T,C or G
tgacntancccttccgaatccgttgctgtcgaaggttgcgtagctaataagtggcagaactgacatgcaaaaccagtctgtntgccccnnnagatgcatgttctttaccatcacgtaggtcaggccaggatgtcaaggagagcaaccccgaactagtcctggtgatttagactagagcgtctttcactgctgtgattccttcattggcactttcttccagttgtacaagtgtctgtctttgcttggtctttgcttgttctacccttagtttagcagatatccctctctccatgaacaaggtgagtgagctctttttctgagtacatttggtttttcaaaatccctccaaggaatcatttccttgaccaaatgccctcatctgtggtggcgatcaacatctttgattttacccttttttttttttttaaanttgaaacaaantctccctttntttttnaggctggagtgcagnggggcaatnttggctcantgnacctccncctccagggttaaagnaattttcctgcctcancctccctaaaagcngggactacaggngcctgcccccacacccagctaattttttgttttttaaaaaanaaaaaagngggtttccccattgttaaccaggntgggttaatcncctgacctngggatntgccccccttgncncccaaaagggctgggatnanaggngggggccaccatgcccggncaatttnccctttttttaanggccggnccngct

SEQ ID NO: 8569 - DNA, 1198 bp, Homo sapiens
  misc_feature 1, 2, 3, 6, 9, 10, 11, 14, 15, 16, 21, 27, 28, 29, 30, 32,33, 34, 35, 39, 42, 44, 45, 46, 47, 49, 50, 51, 52, 53,54, 58, 60, 61, 62, 63, 66, 68, 69, 70, 71, 72, 73, 75,78, 79, 80, 81, 82, 83, 87, 88, 91, 92, 97, 99, 100, 101,102: n = A,T,C or G
  misc_feature 103, 107, 109, 110, 112, 116, 127, 130, 131, 132, 133, 137,143, 145, 150, 154, 162, 163, 164, 165, 166, 167, 168, 169,171, 176, 177, 178, 181, 182, 183, 184, 185, 186, 187, 188,189, 190, 191, 192, 193, 198, 199, 202, 212, 218, 221: n = A,T,C or G
  misc_feature 222, 223, 228, 235, 238, 239, 241, 245, 246, 254, 259, 264,269, 274, 280, 290, 298, 304, 306, 309, 311, 319, 328, 330,331, 333, 335, 336, 341, 342, 345, 352, 353, 356, 357, 358,359, 362, 364, 366, 374, 379, 383, 385, 388, 389, 391: n = A,T,C or G
  misc_feature 392, 395, 399, 400, 405, 406, 407, 410, 420, 421, 425, 427,431, 432, 434, 436, 437, 446, 447, 448, 449, 450, 451, 453,457, 458, 459, 460, 463, 464, 465, 466, 467, 469, 471, 474,476, 479, 482, 493, 494, 496, 497, 501, 503, 506, 510: n = A,T,C or G
  misc_feature 511, 521, 525, 527, 528, 532, 533, 534, 538, 540, 544, 546,549, 550, 556, 557, 561, 568, 569, 572, 575, 581, 582, 584,596, 599, 607, 608, 610, 611, 616, 619, 621, 623, 625, 627,628, 635, 640, 642, 648, 649, 664, 665, 670, 671, 672: n = A,T,C or G
  misc_feature 680, 681, 682, 686, 703, 704, 707, 712, 714, 727, 730, 731,733, 734, 735, 737, 739, 744, 745, 752, 753, 760, 761, 763,766, 769, 770, 771, 774, 775, 778, 779, 782, 783, 784, 787,788, 789, 795, 800, 807, 811, 813, 814, 817, 819, 822: n = A,T,C or G
nnnggnagnnntannnttatncgcgannnngnnnnagancgngnnnngnnnnnntggnannnnagngnnnnnnanggnnnnnnggcnnggnntgggnannnnnacgngnngngtgngctcgggaggngannnngcancgcggngntggtnagangatggtannnnnnnnangcaannnctnnnnnnnnnnnnntagannttngccctttggngaaagncgnnncaacntaggagnaanngnacanngaccccgntgganggctncgggngacgnaggggngctttttttntttttctncggagnanccncngggggggntggagcagngnnangnnctcgnnagnttggatnngannnnggngngngaccggangggtnaggngntgnnanncgntganntgtgnnnctnacaagggagnngagnanaggnngngnncacgacacnnnnnngngagnnnnggnnnnnangnganangcnggncgcggggaccnngnngagncngcngagnngatagaagantgcngnnaagnnntggngnccgngnggnnacgcgnngggnaaggcgnnggnggngcgcgnntngtggggagtagnaanccgagatnngnncgacngcnancncnannggaatgngcagngnggtggnnaggcgagtgcaggcnncggannntacggggnnngggngcacgccacgacgagannatngccangncgaacaggaactngtnnannncngngacgnngaagcgnnagtaganngnggnggnnnatnnggnntgnnnagnnnggaggngcgcngtggcangatngnnacngncgnacncgggatggggntgtngtggncctcgaagancgcgagngngnggtnagnnganntngacgcgnngagnngcnntnncggagnangngcagcncggacnnccncgcnaggacnntngatcgntcncnnggnngaangcgnngaaggcncncgantntganaggcganangnncnggatggnnnnnaaccgtgccggnngggnagggangnnagtagngacgnnaaaggaanggngagganannacgagagcgaatgngaatgnnctggtngatgaggggnagggagngnannngnggacgagtgntntggngacgcgcaagctgnnngacnncagagggganngntngggccaatncgcgnngcagcgtgangcc

SEQ ID NO: 8570 - DNA, 767 bp, Homo sapiens
  misc_feature 22, 89, 90, 328, 352, 369, 389, 413, 450, 481, 491, 494,513, 565, 570, 580, 609, 615, 733, 765: n = A,T,C or G
ttctgaccctttgcgaagccgntgctgtcgaaagaccacaagtttcagagcatggagacattcctgctgaatcgccttctcacctcctnngcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgctttttttttttaccagaactagttacattggaatgcttactgtcctacanagtggcagcaaataaaaccttgcnttccatcaagccaaaanagcacactctgttagagganatacatgtttaagatagaattggngggaaggacaaaaacagaaaaatgtttggcttttaanccattgggtagtattgttttgatgatcttanaggagggaanaanaaaagaaaagacccaatgntagaaccagaatcagggagatgactgacctactgaaaaacaggtcccttgtntttangatctttaangggtataaaaagcaaacatgacttttgcncctaanaaaaattctgcatttctcatagttggggcccaattaaccaaaaaagttgttttttaaaaaaaaatactggtcccattctaaaccatgattttttgggggaaactaatttttttccccnttttgccaaaaaccagtcctttccaaaattanct

SEQ ID NO: 8571 - DNA, 1000 bp, Homo sapiens
  misc_feature 1, 3, 4, 5, 6, 7, 10, 12, 17, 18, 19, 20, 21, 22, 23, 25,26, 27, 28, 29, 30, 31, 33, 37, 38, 40, 41, 42, 43, 44,45, 46, 48, 49, 52, 58, 61, 63, 64, 65, 66, 70, 72, 73,74, 76, 77, 78, 82, 83, 84, 85, 86, 89, 91, 93, 94, 95,97, 98: n = A,T,C or G
  misc_feature 99, 101, 102, 103, 105, 106, 107, 108, 109, 110, 111, 112,113, 114, 115, 116, 117, 118, 119, 120, 121, 122, 123, 124,125, 126, 127, 130, 133, 134, 135, 138, 148, 151, 156, 157,158, 159, 160, 161, 162, 165, 169, 170, 174, 176, 178: n = A,T,C or G
  misc_feature 179, 181, 184, 185, 186, 187, 210, 211, 218, 222, 223, 224,225, 226, 227, 229, 232, 245, 247, 248, 251, 253, 256, 257,259, 260, 261, 265, 267, 270, 283, 284, 286, 290, 291, 296,304, 309, 319, 330, 335, 341, 343, 345, 346, 348, 350: n = A,T,C or G
  misc_feature 351, 352, 355, 357, 366, 373, 375, 378, 384, 385, 386, 388,389, 402, 403, 404, 405, 407, 410, 413, 420, 427, 430, 431,434, 441, 449, 450, 454, 456, 464, 470, 473, 474, 478, 480,481, 485, 489, 495, 496, 500, 503, 508, 514, 516, 517: n = A,T,C or G
  misc_feature 522, 528, 531, 533, 538, 541, 545, 551, 553, 554, 557, 559,561, 564, 566, 571, 573, 576, 579, 581, 585, 587, 588, 590,593, 597, 603, 607, 610, 613, 615, 616, 619, 623, 624, 626,627, 632, 648, 650, 651, 656, 660, 664, 666, 667, 673: n = A,T,C or G
  misc_feature 677, 686, 688, 707, 709, 710, 712, 715, 718, 720, 724, 733,744, 746, 749, 756, 757, 762, 767, 775, 779, 781, 786, 787,800, 807, 814, 820, 822, 823, 831, 841, 842, 843, 844, 845,846, 847, 854, 858, 859, 869, 870, 871, 873, 878, 879: n = A,T,C or G
ngnnnnnggngnggggnnnnnnngnnnnnnngngggnngnnnnnnngnnggngggggnggngnnnngggngnnngnnngggnnnnnggngngnnngnnngnnngnnnnnnnnnnnnnnnnnnnnnnnatnttnnngcncttgggaagncgnggggnnnnnnnggngggnngggngngnntnggnnnngggggggggggggggctgtttgnntgttttnctcnnnnnngnggngggggggaggggncnngcngngtnncnnnttcncnggngtcggggggccgnngngggnnggggngggggggnggggngggggggggngggggggcagnggggngggcgngngnngngnnnggnanggggggggnggggggngnggngggggnnngnngggggggggaggnnnngnggnggnggggggnggggggngcnnggnggggggngggggggnngggngnggaggcgngggggncgnngggngnnaggncgcngggggnngggnggnggcgngggggngnnggggngggggnggngnggggnggngggngggggngnnggngngncgngnggggngnggnggngngggngnngnggncggngaggangggnggnggngnnggngggnngnnggggnggggggggggggggangnnagggngggngggngnnggcgangggnggggggggngngccgggggggggggggggngnncnggnggngncggnggggggganggggggggggngnggnggggggnncgggngaggnggggggangggngncccgnnggggggggggggnaggggcnggggggngggggncnncgggcggnccccgggggnnnnnnnggggggngggnnggcggggggnnncnggggnnngggggggggggnncggggggggggggccggggnggggnngnnggcnggagnnntnnggggngcnnngggggnngncggggnganancggggnnggnnngggggngcgcgtggnngnnngc

SEQ ID NO: 8572 - DNA, 882 bp, Homo sapiens
  misc_feature 5, 94, 95, 438, 518, 616, 627, 636, 653, 679, 684, 698, 750,760, 761, 768, 792, 810, 822, 825, 830, 834, 835, 840, 851,858: n = A,T,C or G
ttatnttaaccccttttcgaattccgttgctgtcgaaagaatccacactgcccaggtcggggagcagtggtggccagcagccctcagggatganngagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcanggttgcaggcccagattctccacttgctacccgagatcgccccgcatgaagtgcttgcttgtgctcggaccttggtcaangcattaccaacccttgcgtgaagcgcccgccccacaaagggcttgaaggaaccaaaacattcaatttcccttgcccttggccaatggactttgggaanccccttgaaanaaagggganccaattcattggggaanccacaaacccacttgtggccccttgncccgntttttccttgcttnggggccccccttgccattattgcccccccttgaaaccccttgggggccttgncccaccgttnnttttaanggaaaaaccaaaaagtttttgccnccttaccttgttcttggnaaaaacccaaanttnaaagncccnnattgnccccttttggntttttcnaaaaaaaaaaaaaaaaaaaaaaat

SEQ ID NO: 8573 - DNA, 769 bp, Homo sapiens
  misc_feature 21, 436, 523, 555, 567, 573, 577, 598, 646, 670, 674, 704,705, 706, 713, 714, 715, 716, 717, 718, 719, 720, 721, 722,723, 724, 725, 726, 727, 728, 729, 730, 731, 732, 733, 734,735, 736, 737, 738, 739, 740, 741, 742, 743, 744, 754: n = A,T,C or G
  misc_feature 769: n = A,T,C or G
ttacttttaaaccctttcgantccgttgctgtcggaactgtttatcttatcctcctcagtgatacatcatgaagttgtgtgctttgcctaaaatgcccagttacctgaaattgtataaattcttgccaaaagtgtttgaacttaatacaaacttcccatctcttacctcttagcactgtgctcatcttgaggggacatagtcccaattttgtattttatataatactgttagtgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgccggtggctcacacctgtaatcccagcactttggcaggctgangcgggccggatcatttgaggtcaggagtttgaaaccagcctggccaacgtggtgaagccctgtctctgctggggatacaaaaattanccaggcatggtggcacatggctgtggtcccancttcttggggangctgangcangaaaatcctttgaactgaaantcaaggcggaggtcgcggtaagcccaaaatccaccatttgcactgcancctgggtgaaaaaaaacaagcctncctntcaaaaattaattaattaattaattttttnnnaaaaaannnnnnnnnnnnnnnnnnnnnnnnnnnnnnnnaaaaattttnccggcccctttttcn

SEQ ID NO: 8574 - DNA, 780 bp, Homo sapiens
  misc_feature 9, 12, 95, 350, 428, 495, 501, 502, 505, 512, 525, 543, 544,547, 551, 560, 567, 573, 583, 594, 614, 620, 627, 644, 646,654, 657, 675, 684, 693, 703, 708, 723, 728, 733, 742, 759,767, 774, 779, 780: n = A,T,C or G
cttactttnaancccttttcgaatccttgctgtcggcagtagggggagtggggaagggacttctgcatcagggcatagcatatgtttctgagatnactggaagaagctagcagtgccaggagcctaaagccagctcactgtttggtcgtccagtggagcaggtacagctcacagtccctaagccagggaaacctggctgacttccactaaagtcaagcaagcctggtcggcctcgattagccaaggtgtggactcttcctccaaagcccacctcagcccacctctgccagggcagagaagccaaaatggtcacattgcagccaaaatggtcacacccttttgctccagancagaatactgcctctcagtcttccaggtgcttgaggataactgggggcttcatttaagtgcatattctgattctgtangtgggggtgggaactagattcagcatttctttcttttctttctttcttttttttttttttttgaaanagggtnnaantttttcncccagggtggagnggaggggcccaattttannttnaaanaaaccttcnccttttngggttnaaaaaaattnttcccccccanccttcccaaataatttgggnaaaaangggtttncccccccccttccccancngaattttnggnttttttggggaaaaaacnggggttttncccattttnaccaagggtngtttnaaaactctgggcccnaaaanaattngcttccttnggcctttcaaaaaagcngggattanccggggngaatnn

SEQ ID NO: 8575 - DNA, 1218 bp, Homo sapiens
  misc_feature 1, 2, 3, 4, 5, 7, 9, 10, 11, 12, 13, 15, 16, 17, 18, 19,20, 21, 22, 23, 24, 25, 26, 27, 28, 29, 30, 31, 32, 33,34, 35, 36, 37, 38, 39, 40, 41, 42, 43, 44, 45, 46, 47,48, 49, 50, 51, 52, 53, 54, 55, 56, 59, 60, 61, 62, 63,65, 66: n = A,T,C or G
  misc_feature 67, 68, 69, 70, 71, 72, 73, 74, 77, 78, 79, 81, 82, 83, 84,85, 86, 87, 88, 89, 90, 92, 93, 94, 95, 96, 97, 99, 100,101, 102, 103, 104, 105, 107, 108, 109, 110, 111, 112, 113,114, 115, 116, 117, 118, 119, 120, 121, 122, 123, 124: n = A,T,C or G
  misc_feature 125, 126, 127, 128, 129, 130, 131, 132, 133, 134, 135, 136,137, 138, 139, 142, 146, 149, 150, 152, 156, 158, 167, 171,172, 174, 175, 177, 178, 179, 182, 183, 184, 185, 187, 189,191, 192, 193, 194, 195, 198, 199, 200, 202, 206, 208: n = A,T,C or G
  misc_feature 211, 214, 223, 233, 254, 256, 257, 258, 259, 260, 261, 263,264, 265, 267, 268, 269, 270, 271, 278, 291, 293, 294, 295,296, 301, 302, 313, 314, 318, 320, 321, 323, 324, 326, 327,328, 329, 330, 331, 332, 333, 334, 337, 338, 340, 342: n = A,T,C or G
  misc_feature 343, 344, 345, 346, 347, 350, 351, 354, 355, 357, 360, 362,363, 367, 369, 370, 371, 375, 377, 378, 384, 385, 386, 390,391, 392, 396, 397, 398, 399, 400, 401, 405, 406, 407, 408,409, 410, 411, 412, 413, 414, 417, 418, 420, 425, 430: n = A,T,C or G
  misc_feature 433, 439, 440, 441, 442, 443, 444, 445, 446, 449, 450, 451,452, 453, 454, 455, 457, 458, 459, 460, 461, 462, 463, 472,475, 479, 485, 487, 488, 489, 490, 491, 495, 496, 499, 502,503, 505, 507, 508, 510, 512, 513, 514, 515, 518, 520: n = A,T,C or G
nnnnngngnnnnngnnnnnnnnnnnnnnnnnnnnnnnnnnnnnnnnnnnnnnnnnnggnnnnngnnnnnnnnnnggnnngnnnnnnnnnngnnnnnngnnnnnnngnnnnnnnnnnnnnnnnnnnnnnnnnnnnnnnnnagntggnttnntnggcncntcgggaaancccnngnngnnnggnnnngnangnnnnnttnnngncttntntgnggnggggggggngggggggggngtttttttttttttttttttngnnnnnngnnncnnnnnggggggngggtgggggcgcncnnnnggggnngtgtgttgccnngggncnncnngnnnnnnnnnggnngngnnnnnnggnntgnngnggngnngggngnnngggncnngggggnnngggnnngggnnnnnngggnnnnnnnnnnggnngnggggnggggngcngggggnnnnnnnnggnnnnnnngnnnnnnnggggggggnggngggngggggngnnnnngggnnggnggnngngnncngnnnnggncnnnnnngggggggnncnncgnngntnnnggggnngngnnnnngngnnnnggnngggngggggggggnnnnngnngggnnnnnnnngnnnnnnnggggngggnggggggnngggngnaannnnnnnggnnnncngggngggggnngnggggnnggnnggnnggnggggcnggngannngggccnnnnngggnnngnnnnnnnncnggggggggggcnggngggggggggnnnnnnnggggnnnnnnnngnnnnggnngnnngnnggnnnnnnnnnggggggnnnnnggannggggggggcnnggggggggggnngnngggggggnnnnnnngggggnnnnngnggnngnnnnngggnngnnnnnnngngnnngngggngnnnggnnnnnngggggggggggggggggnnnnnnnnnnngggnggggnnnggggggggggggnnnnnnnngngngnnnnnnnggggngnngggggggggggnnnnggggnnnngnnnggggggggggggggnnnnnnnnnnnngnnnnggngnnggngnggngnngnnngnngnnnngnnngngnngnnnnnggggggggnnnnnnnggggggggnngnggggggggggggnnngggggggnggnnnnnnnnnnnggngnnnnnnnnnnnnnnnnnnggnngggggggcnnngnnggggggnnnnnnngggnggggggcgc

SEQ ID NO: 8576 - DNA, 1186 bp, Homo sapiens
  misc_feature 4, 6, 7, 8, 10, 11, 12, 13, 14, 15, 16, 18, 19, 20, 21, 23,24, 25, 26, 27, 28, 29, 31, 32, 33, 34, 35, 36, 39, 40,41, 42, 44, 45, 46, 47, 48, 49, 50, 51, 52, 53, 54, 55,56, 57, 58, 59, 60, 61, 63, 65, 66, 67, 68, 69, 70, 71,72: n = A,T,C or G
  misc_feature 73, 74, 75, 76, 77, 78, 79, 83, 84, 91, 94, 95, 97, 98, 100,101, 102, 103, 104, 107, 108, 110, 114, 115, 116, 118, 119,120, 122, 123, 125, 126, 127, 128, 129, 130, 131, 133, 134,135, 136, 137, 138, 139, 140, 141, 142, 143, 144: n = A,T,C or G
  misc_feature 145, 147, 161, 173, 216, 223, 227, 229, 237, 243, 244, 250,264, 277, 278, 280, 303, 324, 330, 341, 346, 353, 354, 358,375, 383, 390, 396, 401, 405, 409, 431, 459, 471, 505, 515,526, 531, 548, 551, 569, 587, 598, 604, 611, 619, 621: n = A,T,C or G
  misc_feature 635, 645, 669, 682, 691, 697, 730, 736, 739, 751, 780, 800,816, 850, 882, 884, 888, 905, 907, 911, 916, 927, 942, 967,980, 1000, 1001, 1003, 1010, 1015, 1022, 1023, 1025, 1037,1068, 1069, 1087, 1112, 1118, 1124, 1131, 1148, 1158: n = A,T,C or G
  misc_feature 1160, 1165, 1173, 1185, 1186: n = A,T,C or G
cccntnnntnnnnnnnannnntnnnnnnntnnnnnntannnnannnnnnnnnnnnnnnnnngntnnnnnnnnnnnnnnntganntatcgantanntnncnnnnncanntngtannnannntnntnnnnnnnannnnnnnnnnnnnanaaaaccttcgaccnttctcagcgggngacgaaacagtatatgtaggtagaaaaagaaaaagaagggtanggtcttnagcncnggtggacnggggannttaaangcttagggggatanggaataggattannangggagacccaaggggccaggaanggtaggaaaagctaccaaggnttggtnatcctaggaangaaanaaaaggnntttnaaggaggatgtgatggnctggggcnaaaggtngttggnccagncaantaanttgaagattgagaaatgatccnttgggtgtagtggatgaaggcaatagtngaactttgggantaaaacctgttttcaagtgggaggtaatgggganggaaatgccntgttggggaantgagnttcaaggtaaccaaccnganggaggagaaaacttggangaatagccaagatggtangaattaagaanttcccnaaggggngttttttngnttggtccaaagggnaaaaggaatngaatttggaagaaatggggaaacntccgaaagggggnggaggaggnaaaatntgaggaattttttttaaaaaaaaaataaattanatttanagntttggggggagnaaaaaggggggcaatttgggttggggaanttctttaatttggggcgatnccaccttccacccacnaaggaaaggggaaaaaaaatgggggattgggatnggaatttccaaagggaacaaagttggggaaangnaagnaacacgcaagcaaggtngngtcnggggnttcaaggattnggccttaaagccctncttaaaaaaataggaaaattgggtnttaaaaaaattancaaggtgggggaactttcanngnccctggncaaanctggggnncnatgggtgccccntttaccttggggaacccccctttccccattnntttgggccgggtatatgnttttttggaccttaaaccaagaatngggggngaccanttttttnttggagaaaaaatgggnaaaaaaaagnangggcnccccctanaatttccaaaann

SEQ ID NO: 8577 - DNA, 1101 bp, Homo sapiens
  misc_feature 1, 3, 9, 11, 19, 44, 51, 53, 84, 97, 106, 109, 123, 125,131, 132, 140, 147, 152, 157, 161, 169, 171, 181, 188, 198,199, 201, 218, 220, 222, 224, 236, 244, 245, 256, 263, 265,266, 268, 272, 291, 294, 299, 300, 304, 308, 313, 315: n = A,T,C or G
  misc_feature 322, 326, 327, 328, 335, 338, 355, 366, 367, 381, 385, 395,398, 403, 404, 410, 415, 421, 424, 427, 429, 439, 440, 441,447, 454, 461, 471, 489, 490, 496, 502, 503, 511, 522, 524,525, 527, 529, 534, 536, 540, 550, 561, 572, 576, 582: n = A,T,C or G
  misc_feature 591, 594, 597, 606, 611, 639, 640, 642, 646, 648, 650, 653,661, 662, 664, 666, 675, 678, 680, 681, 683, 688, 691, 693,707, 709, 724, 725, 730, 735, 738, 742, 747, 754, 757, 763,764, 765, 782, 784, 789, 791, 811, 812, 815, 820, 839: n = A,T,C or G
  misc_feature 848, 852, 857, 873, 878, 887, 895, 902, 903, 905, 910, 912,915, 919, 941, 942, 945, 959, 962, 967, 971, 980, 981, 996,1001, 1013, 1015, 1019, 1020, 1022, 1026, 1032, 1041, 1052,1070, 1075, 1082, 1084, 1085, 1088, 1095, 1096, 1098: n = A,T,C or G
  misc_feature 1101: n = A,T,C or G
ngnattttntnaaaaaccnccttttttgcggaaaatcccgtttngccttgntnctcctaaaaactaacttctcccccttttggntcacccccccccntaaaagggncanaaagagagattggngngggtanngggatttnttttttntattnaaccntttnttttgggncnaaggggccanagccccnccaaaaaagnnangggggggggggaaaaangngngnggtgaaaagcgnttctcatnnaggccaatcgnggggggnannanagtntcacccccacctgtgggtnctntcttnngggncaanagggngncccttanaaannnttataanctntttttacacttcccccntttcccctttnnggcctaaatggaangaanggacatcatnaanggccnngaaagnggggnaccaanggnggncnttcctggctnnnccttanttggggngaagggnttccctaggncaccaagactcaaccttnntttctngcaccnncctttttnccttttgaaanannanancaacntnctgnaacaaaatcnactgcttggtnctgcttttgangggngtaatnattctttanccnaanctctggaanttggncaattctattttttaaaaacctctaaannangggnananaanccttggtnntnanaattgatanacntnngnttccnctnanggtacatggttggntncaagaaccctatttnntaccntatgnaanacangtctntgatttnctngcaaannnaaaaaataccctttttngnggaanantaaaggaaaggaggcttagnngtncccantgcccctctttggcccttnaacaggatngtcncccanaggggccccccatttntggcntttccttgncccccctnccctggnntnacctngnttngatngcacttcttcctttttccctgnnaanacccctgggttttnccnaagtncttncttcctggnncccctttctaaaaantcctnttggaaaatccncncttnncnccancctctntgggttcgnaacacttgggnacccaattgggcccaatnctctnggctggntnnctntaccccnnanccn

SEQ ID NO: 8578 - DNA, 1093 bp, Homo sapiens
  misc_feature 1, 9, 12, 14, 66, 86, 92, 93, 99, 100, 103, 107, 113, 126,139, 148, 155, 169, 178, 184, 218, 229, 276, 290, 303, 385,466, 491, 534, 546, 595, 616, 638, 667, 691, 774, 795, 820,843, 870, 876, 882, 884, 899, 904, 910, 920, 923, 935: n = A,T,C or G
  misc_feature 948, 958, 993, 1002, 1023, 1024, 1052, 1054, 1074, 1082,1091: n = A,T,C or G
ncttacgcnttngngctgtcggtgatttgtttctattaaaaataattttcaagtgggtttcttgtnctttagtattgaaaactttngtggtnnttttannaancttnggaccngttttaagagaantcagtaccctttngttcccctntttggantcctaaaaaaaaangtcaagttntcatgnccaggcccgaatagttcaggcctggtaaccttanccctttggggnggccaaggcagaacagaatgaacctcgtggaattgggcccacctcanccctcccaaaagtngctgggtatttancaagaatggtggaagccccccggcacccccaagccctggaagttttcctccttttcctcttcttttttttaaaccttttaantttttttttggaaaaaaaaccccccgggtaaggaacttttttggttggggggggaagccatttttttttgggtttggaatnaaatttttttaacctgggaatcctnaaaaaagccctggaagtgggaatttttttttttaaaaaaaagnaaaatttttggnaaattttttggggcctttttccctttcaaccccaaggttaaaattaatnggttccttccccctttggccnttttccttttttggaatgggtnggaataaaggttttttttggaaaaaaatnggggggttgggaaaaaaaaattcnttaaaattaaggaaattccttgggtggggggtttgggaaaatttttgggccttgggggggtttggggtttaattggaaaaagnttccccaaccccccttgggtnggggggcccccccaaattaaacccntttaaaccctgggtttgggggtnaaggggaaggtttgggtttttggaagnccttanttttcntnggggaagaaatttanttttnggggtnaaaagggtanttnccttaaaaaagncccctttaaaaancccatggttnttgtggcccccttggttttggaacccagttaaagnccccctttnttttggccatttggaaagacnntttgaaagaaaataatccagcccttgcntnaaacttatgggtggaaagtnttccttcncaatttttntt

SEQ ID NO: 8579 - DNA, 894 bp, Homo sapiens
  misc_feature 3, 4, 19, 59, 62, 65, 73, 76, 78, 80, 82, 86, 87, 89, 92,96, 99, 100, 114, 116, 125, 128, 130, 133, 136, 137, 139,142, 151, 153, 154, 155, 157, 161, 162, 167, 169, 175, 177,181, 191, 192, 193, 197, 201, 214, 217, 218, 220, 226: n = A,T,C or G
  misc_feature 227, 230, 234, 238, 244, 245, 255, 261, 265, 267, 273, 312,319, 324, 333, 337, 353, 357, 362, 422, 428, 454, 458, 484,494, 530, 534, 632, 635, 649, 652, 663, 669, 698, 716, 719,731, 814, 829, 837, 846, 848, 860, 874, 877, 883: n = A,T,C or G
ttnnctaagccctttgggntgccccaggtactattagaaataagacaaaaacttttgcntcnaanaacctccnaancntntngganntnttntttngannggggccaaccaaantnccccaaccnttngnccnccnnanccnagggctttnannnangccnngccanantgggcntngcangaaacacttnnngccntttnggaaaggggcccnttnntntaaaannctnaatngccnatgccnngaataaaganggtgtncctntngcaaangaatatcccaagtgctaaggtccaacccaaaaaggcctngtaagangggantcaagtgtnggtnaccaagccaaaggatngaanggaanggccagtgatttgaccaatggggcaaagaatgaaggggacccaagcttgtgaagggcccnatttgntaacctgatgaaattggatttttctnaaanaaaatgggggaccaagtataactgtngctatttgancccttgaaatgtggcttgttccgaatttgagatttncttnaattccaaaaattcacccctggatttttaaaagaattttaaataagggaaaggcttgggcccccggtgggcttcaccgttcttgttaaattccccaancanctttttgggggaanggnccaaaaaaccngggttngggaattcccccaaagggtccaagggganaaatccaaattaccccanttnccttgggccttnaaacaatcttctttacctttaaaaaaaatttccccaaaaaaaaaaaattttaaacccttggggcccctttgggtttgggcccngggtttgcccccttnttaaattnccccccaancnttacctttttgnggaaaggccttttnaanggcccngggaaaaaaaa

SEQ ID NO: 8580 - DNA, 935 bp, Homo sapiens
  misc_feature 7, 9, 10, 11, 12, 13, 14, 16, 17, 18, 19, 20, 21, 22, 23,24, 25, 26, 28, 29, 30, 31, 34, 35, 37, 38, 40, 41, 43,44, 45, 46, 47, 49, 51, 53, 54, 55, 60, 61, 66, 68, 69,70, 72, 73, 74, 75, 76, 78, 79, 81, 82, 83, 84, 86, 88,90, 91: n = A,T,C or G
  misc_feature 92, 93, 94, 95, 96, 98, 100, 101, 102, 103, 104, 105, 106,107, 109, 110, 111, 112, 113, 114, 116, 117, 118, 119, 120,124, 148, 150, 160, 161, 190, 195, 225, 233, 242, 251, 263,264, 266, 269, 270, 308, 318, 322, 329, 358, 359, 366: n = A,T,C or G
  misc_feature 367, 382, 400, 403, 413, 421, 436, 474, 490, 494, 525, 536,560, 576, 583, 608, 609, 613, 637, 702, 717, 789, 800, 812,852, 863, 865, 879, 893, 902, 903, 917, 922, 925: n = A,T,C or G
ccccccncnnnnnncnnnnnnnnnnnannnnaanngnncnnannnnntncncnnncaacnnaccanannncnnnnnanncnnnnancncnnnnnnnanannnnnnnncnnnnnncnnnnntatnggaacccctagcgcaaacatggananccctaactcnntcaacctgggacggcaaaggggagggganggaanctaaccaaagggtaatggactttagaatcnacatatanccaacaaanccccgcaancctttgggccannancannctatttgggggagcagctgggggctggtaccataaaanagaagagccncccnaaaattntaaggccttttatccctggcttctaaccnnaaaaaanncagggagaagtcaangaagctagggttcaaggntgnccccccctcnaaaagggntttgggccaagcggnctaaaacaagttttccaacaactgggaaacaaaactgnttaagcccccaccccnaacntggttcactggggggacttttgctaacccgntcctggggggngacccttttcccggggattttccnttggtctttatcaaancaagaanttaaaccaccatggcctaaaaccgnncttncattttgacttctctactccgggngtctcagacaagtgtcttcccagaaaaaccaccaccctctacccaaagatgaaacatgctcatgncatttttctcatggncacatttaaacagttttgacatgttatacttggcgcatagaatccaacgtttcttggggaacctgacctttngagtgtttaanaaagccggaagngggggttgcccctgaaccaacagaatttcacctggggtcngggctcccggngnttaaacactggganacaatctttgatgngccgaaagnngagtcaatctttcngaacncantttgggaccg

SEQ ID NO: 8581 - DNA, 914 bp, Homo sapiens
  misc_feature 13, 15, 26, 63, 69, 71, 72, 79, 90, 92, 101, 111, 112, 116,119, 122, 130, 131, 134, 138, 139, 140, 144, 145, 146, 149,159, 166, 169, 174, 176, 179, 184, 190, 192, 200, 207, 210,214, 231, 245, 253, 260, 268, 305, 321, 340, 354, 362: n = A,T,C or G
  misc_feature 377, 379, 421, 423, 444, 457, 460, 475, 484, 486, 488, 522,524, 536, 539, 548, 560, 567, 575, 606, 623, 626, 627, 629,635, 638, 641, 656, 661, 672, 680, 684, 688, 692, 702, 714,725, 734, 738, 751, 752, 755, 756, 758, 763, 773, 776: n = A,T,C or G
  misc_feature 792, 794, 799, 802, 807, 811, 817, 818, 823, 827, 829, 830,845, 850, 851, 855, 860, 862, 868, 869, 872, 875, 876, 880,888, 900, 901, 906, 911, 912, 913, 914: n = A,T,C or G
ttatcttacgctntngtgatgccggncctgtcgcttgacgcttggcctggctttttttgtganatatgngnnactttcnttctttattangnccctaaccnccccttcccnncccnaanaanggccattnnctncctnnngggnnnttncctaaaaaanaaattanaanggatngnaangaaanaaaggnanaaaccagnatttaanggnggtnggcttaacttggggccncctaacccacctgnttcaattnagggctngaacaaanctgaagcccctttgaaaagccaaggcttggccaggancaggggtgggggcccnaattacaactttccccatnaaaaccaaattttnttgaaagnaaattgtcccaaaantngcagttatttttcttttgccaagggaggggggaattcctggnangatggggtttcaatgttcttnttgattcccccanttnccttttttggggaanggcttgaangntnggggaaggggaattttgcctttggaagccccccngngaaagttttccntangaacccaangcccccttgggnccaaacnaattgggncggaagaaccccccattctttcttaccaagnaaaattttaaaaaaatntanntncatctnttnttntttttctttgggggncccgnttttttttacntttaaatncccnaacntttnttaaaaaaanctttttgtttanatttttggacnaaaaccccnaatnttttaattttttnnttnntnaactnctaataattnttnttttctcctatattcntntctcnttntttantctntttttnntactntttncnnctttattttactacncttcnntttntcttntntctctnntanttnnacgnacctactnctcttttttttnnctttnttcannnn

SEQ ID NO: 8582 - DNA, 1288 bp, Homo sapiens
  misc_feature 1, 2, 3, 4, 5, 6, 7, 8, 9, 10, 11, 12, 13, 14, 15, 16, 17,18, 19, 20, 21, 23, 24, 25, 26, 28, 30, 31, 32, 33, 35,36, 37, 38, 39, 40, 41, 42, 43, 44, 45, 46, 47, 48, 49,50, 51, 52, 53, 54, 55, 56, 57, 58, 59, 60, 61, 62, 63,64: n = A,T,C or G
  misc_feature 65, 66, 67, 68, 69, 70, 71, 72, 73, 74, 75, 76, 77, 78, 79,80, 81, 82, 89, 91, 103, 109, 110, 111, 115, 116, 119, 120,124, 125, 127, 128, 130, 131, 133, 136, 141, 144, 147, 151,164, 168, 174, 178, 183, 192, 196, 207, 209, 217, 223: n = A,T,C or G
  misc_feature 232, 243, 245, 247, 254, 258, 262, 263, 271, 275, 277, 280,284, 285, 296, 298, 300, 303, 312, 314, 320, 334, 335, 351,360, 361, 372, 391, 398, 400, 408, 416, 428, 432, 433, 434,435, 438, 444, 445, 449, 455, 456, 463, 465, 474, 477: n = A,T,C or G
  misc_feature 478, 479, 480, 483, 527, 535, 536, 543, 544, 545, 546, 552,559, 561, 562, 567, 582, 583, 594, 601, 602, 604, 606, 607,614, 615, 617, 621, 629, 636, 637, 642, 643, 656, 673, 679,709, 714, 725, 741, 745, 762, 770, 775, 776, 783, 799: n = A,T,C or G
  misc_feature 812, 836, 850, 854, 879, 887, 894, 902, 909, 910, 912, 915,926, 927, 929, 933, 938, 939, 944, 948, 949, 955, 956, 963,981, 983, 985, 986, 990, 991, 1001, 1003, 1004, 1005, 1011,1049, 1057, 1066, 1071, 1079, 1105, 1107, 1108, 1113: n = A,T,C or G
  misc_feature 1117, 1140, 1156, 1168, 1181, 1209, 1210, 1226, 1238, 1242,1249, 1254, 1258, 1269, 1270, 1271, 1272, 1273, 1282, 1283: n = A,T,C or G
nnnnnnnnnnnnnnnnnnnnngnnnngngnnnngnnnnnnnnnnnnnnnnnnnnnnnnnnnnnnnnnnnnnnnnnnnnnnnnacggacncntagggcccttcnccaaannncccnnaannagcnncnncnnanccnccggnccnggncccncctagcaggaacncggngggggnggcnggaanttttttttnggtntccgggggaancngggcaggnagaggnccatgggcnccccggcaccncncnaggcggngggncggnnggcgggancccnancantccnnaagggccgcancncnaanaccgggccngnggaccnggcccggggggggnngggaagggccaccccngcagaaaannaaggaagggcncccccgggcacccctcccnaaaacantnaaaagggncctggggnaaaaggccccanaaannnnaanaccaannggcngggaannaaacccnanaccaggaanatnnnncanggcctgggaggggggggggaggaggaaaggggggaaaaaggggngggggaannagggggnnnncccaancccccangnnaccanggggggggagggaanncccccaggggnacccggnnantnnggggagnnanaaanagggaacnaaaaatnnggggnngggcccggggaangggcccggggggggggncccaanggccccggggaaaatccccccaaaccaccnttttnggggggggganggggcctggaaggggnccanggggccccccccaaggncccaaagnggaannccacctntgggaggggggccccngggggggggtttnccggaggggacccccgggcccccnggggggccccaaancaangggggggggggaaaaaacccccccnaaaccccncttgccnctaaaaanaaaaagnnangtnagaaaaaaaanncnaagnccccnnggggngggnngggggnnggggggnggccaaaaaaaccccccnanannaaannccccccaggncnnncccttnggggggggaagggggccccgaagggggcccagggggangaaaaaancgggcctcnggggnaccccccngggaaaaagggggcggggaagggggntnnggccngggncggaaaggccccccaaggaaaangggggggggcccaccnggggggaccctncccaagggccccnggggggggggggggcccagggaggcccnnggggacccccccccanatctgggggggngaanaagaaanaaaanaaanggggcgccccnnnnngggggggannggcgc

SEQ ID NO: 8583 - DNA, 749 bp, Homo sapiens
  misc_feature 4, 16, 22, 27, 28, 31, 33, 40, 44, 49, 56, 66, 71, 82, 85,86, 91, 93, 111, 118, 127, 128, 137, 148, 150, 165, 169,170, 176, 186, 187, 191, 206, 214, 216, 218, 228, 235, 242,249, 266, 293, 303, 354, 377, 428, 438, 460, 491, 501: n = A,T,C or G
  misc_feature 515, 580, 590, 652, 654, 703, 706, 714, 726, 743, 749: n = A,T,C or G
tttnaccctttcgatnccgtgntgctnnctntngctcagngctnctggnaaacacntggaggagancaaancccgccaggcntgnngctgntnttactgtttctgtggggnggggaanggggaagtnntgaaaattnccaggtgtgtntnaaactaaagggtttnaaannactgtnctgaaccagnncgtnttgaggtaaaaggcncaggattntncntgtggttggnaaaaatntcctgtntccaaantttgaggcaggaaatanaggttttgctggtgggattgtgggganactcctaganctggaaccaggaaagggggatccactgttttgtgaaaagggcattttcacntgaacaaggttggacagcagganccccttagggacccctgtgagcaggcgtcttgacttgttttttgaaaacanttaagacgancaatgtgatgtgaagcattcanagtaagggtaagtggactggattaaatagangggcaagttntatcatctttcttntgccccgtgcctcctgtttcttccttcatttgttcattaaacaaatgtttatttgatgggttatnaatgtgccanacttgcctaggtgcatgggaccgcaacaataaagtgagaccaagaagggcccagttctcacngngcttatatctaataagacagtgaataaataaacttgccaatcaaatctntgncatagctntcatcctttcanacataatttaaaacatntgaaan

SEQ ID NO: 8584 - DNA, 800 bp, Homo sapiens
  misc_feature 1, 4, 15, 73, 90, 146, 155, 162, 165, 171, 180, 182, 188,221, 242, 328, 334, 476, 543, 545, 554, 574, 594, 604, 629,673, 689, 692, 701, 702, 703, 704, 705, 715, 716, 717, 718,719, 720, 721, 722, 723, 724, 725, 726, 727, 728, 729: n = A,T,C or G
  misc_feature 730, 731, 732, 733, 734, 735, 736, 737, 738, 739, 740, 741,742, 743, 744, 745, 746, 747, 748, 749, 750, 751, 752, 753,754, 755, 756, 757, 758, 759, 760, 761, 767, 783, 800: n = A,T,C or G
nacngaccctttggngctgtcggaaataacttcgaagtcctcttcctttacaatatttgaattcatatttgtnccttctcaaaatagtgnttcatttttcctagaattacaggagggagctcttttactaatgttgttttggttgncaccttggngggctantantaggangttttctantngtaaanaaaactctttagagacttttgactgggtcagtntactgaggggtggagatttgnttcatgatgaaaaagcctatagattgccaaaaaattaattctccaaaccacctttcactctcagaaaatgagaccccaaaggagtntgcctntaaatcaaatttgccaaccaattatgtagatattactcattctaggactaatgatgatggtaaagaagttgccagtgttatggcaatgaaaatttcagaaaggaggaggtggatgatcttctagatgtatatgaacacctgnctatatctgcatgtatatgttttgacctgccagtggtttgcaatgttgatatgtgttccaagaatantnctgtctacnaaactggaaggcccatgtcnaaattggtcctttattgggngggttttatnggcaccgtgggaacaattttcttanctaaacctaccaaaagggtcttctttggatggaacaatttttantttattattttacctnaanccttttttnnnnnaaaaaaaaannnnnnnnnnnnnnnnnnnnnnnnnnnnnnnnnnnnnnnnnnnnnnnaaaaantcttgggggggggggntttttaaaaaaaaaaan

SEQ ID NO: 8585 - DNA, 1043 bp, Homo sapiens
  misc_feature 2, 4, 6, 12, 21, 22, 28, 36, 40, 41, 51, 53, 61, 63, 70,76, 81, 85, 105, 116, 121, 125, 127, 131, 145, 162, 183,194, 204, 209, 211, 215, 217, 239, 293, 302, 334, 342, 372,378, 381, 390, 405, 406, 409, 411, 428, 429, 436, 464, 482: n = A,T,C or G
  misc_feature 492, 508, 516, 542, 554, 558, 596, 603, 621, 622, 638, 652,674, 677, 678, 682, 688, 689, 696, 715, 721, 739, 741, 770,788, 808, 822, 857, 879, 896, 934, 954, 974, 991, 1003,1006, 1012, 1015, 1028, 1042, 1043: n = A,T,C or G
cnancnataccncttttcgannccgagnccggcganaaanngaatggcctntntgttcagnanggatccncctccngctgnttgnttcatgtttttgttcctggnccaacgctttnccatntgtngnatcntaatccggaattanttggctttttggggttntttaattttttgaaagggagnttccctttgtngcccaggctngaatngnattngngccaacccaacctcgttgaaancttctgcttccaaggacaagggaaaatcctccaaccttaagcctttccacgtancctggggantaccaaggcaatgcacccacaaggcattgcanccaacccnccccaacctaaatttttttggtattttttnggtaanaanaacaagggngtgggcaattaaatnnttngnccccaagcctttgggtnnttttggnaaatggccccttggaagccttcaaaaanccaaatttttaaattttngccccctttngggcccccttcccccnaaaaaagnggcctttggggggaaattaaaccaangggcccattggnaaancccaaccccaaccggggccccaagcccccttttccttnaaatttntgggattttttttttttnnaataaaaggggaaaangccctaatcctccntttcttttccccctttcccccnaannttangggggnnatttccnttttttcccccttttccgnccaacntttggctccaatgttacntnggaatttcccttcaaactttcatttaatngaaattcccattttgggnaaacccaattggaaaaaaanggccaaccttccanaaaaagccttaaataaaagaaaattggttttgggngggaaatatccttcctaaaaancttattcttggaaatanattttcccttttaaaatttggggaaaaccctctttttngggagaccttttgaaaaacnttgggaaaaaaaacccccangggaagtttgtattttnggaaaaaaaaanaanaacttngancctttggtaaaanaaaaaccaagggann

SEQ ID NO: 8586 - DNA, 1196 bp, Homo sapiens
  misc_feature 2, 3, 4, 5, 6, 7, 8, 9, 10, 11, 12, 13, 14, 15, 16, 17, 18,19, 20, 21, 22, 23, 24, 25, 26, 27, 28, 29, 30, 31, 32,33, 34, 36, 37, 38, 40, 41, 42, 43, 44, 45, 46, 47, 48,49, 50, 51, 52, 53, 54, 55, 56, 57, 58, 59, 60, 61, 62,63: n = A,T,C or G
  misc_feature 64, 65, 66, 67, 68, 69, 70, 71, 72, 73, 74, 75, 76, 77, 78,81, 82, 83, 84, 85, 87, 88, 89, 90, 93, 94, 95, 96, 97,98, 99, 101, 102, 104, 107, 108, 109, 112, 113, 114, 115,116, 120, 121, 123, 124, 126, 129, 130, 131, 132, 134, 135: n = A,T,C or G
  misc_feature 137, 138, 139, 141, 142, 144, 146, 147, 148, 151, 154, 155,156, 157, 158, 159, 161, 162, 163, 164, 165, 167, 168, 170,171, 172, 175, 177, 178, 181, 182, 183, 184, 185, 187, 189,190, 191, 193, 194, 195, 198, 199, 200, 201, 204, 205: n = A,T,C or G
  misc_feature 206, 207, 208, 209, 210, 211, 212, 213, 214, 215, 216, 217,218, 219, 220, 221, 222, 224, 225, 226, 227, 229, 232, 250,260, 263, 264, 279, 281, 290, 299, 306, 308, 328, 329, 330,333, 369, 370, 378, 379, 383, 384, 395, 396, 397, 411: n = A,T,C or G
  misc_feature 413, 418, 421, 431, 440, 443, 447, 449, 452, 456, 457, 460,461, 464, 467, 475, 479, 491, 492, 512, 513, 515, 518, 521,522, 530, 539, 541, 546, 547, 556, 557, 558, 561, 563, 570,573, 585, 593, 594, 600, 601, 606, 615, 619, 621, 645: n = A,T,C or G
  misc_feature 646, 648, 656, 657, 663, 666, 675, 678, 680, 681, 689, 694,695, 697, 700, 732, 739, 743, 744, 746, 748, 755, 761, 766,768, 769, 775, 776, 791, 797, 826, 844, 847, 880, 896, 897,898, 899, 904, 918, 920, 931, 933, 950, 951, 956, 957: n = A,T,C or G
cnnnnnnnnnnnnnnnnnnnnnnnnnnnnnnnnnannnannnnnnnnnnnnnnnnnnnnnnnnnnnnnnnnnnnnnnngcnnnnngnnnnaannnnnnncnnangcnnnacnnnnncganngnngnagnnnncnngnnngnngngnnnggnacnnnnnnannnnncnngnnnccncnnggnnnnnancnnncnnngcnnnnacnnnnnnnnnnnnnnnnnnncnnnngntcngatccgggaaaacccttngcgcgcaagnccnncgcgggggcggaagngnagcccaccncgccacgcnacggggnanggggggggccgcccgccccnnnggnccgttggacgggcccggccacccggggccggggacnngacccggnngcannaggcgacccannnccgggccagcgaangnggccnganggcaacccgngccaggganggnaccncnggnaggnnggnngancanaacgggangggnggccgcccgggnnggccaggaaagcaagggccnngnacnacnnggcccccnggaaacccngngccannaaggcggannngangnagagaanccnaaaccggccccncagcaagnnaaaaanngacgnggggaccanccancngccgggacaccggggggaaaaacnncngaaggagnngggggnaancgggccacnaangnnccaaggcnggggnnanaancgacccggccccaaagggggcccaaagggggnaccaggnccgnncngnggggccncccccnggggncnngggaannaccagggccccgggncccaanggggggcccggggcgaacccccccccccnagcgggggggggggacanacngccccccggggggggggggcccagggaggagancccccccggggggaannnnccccncaaggggggggccnanaaagggggccngnggggggggcccgcccgnnccaannnacgcgccaccaaggacnacggaggggggggccnacgccnggggganangnggncgnnaaacccacggggaagccccacnngggccgnggccngaaaaagaccccccccaancccccngaaagaancagggggnnggacnnaanntnccnnaggggggggncnncacccnggngannnccaacgaaccgggcggaaanaaaaaaaggnggacggangnancccccagcccccccgggcg

SEQ ID NO: 8587 - DNA, 855 bp, Homo sapiens
  misc_feature 1, 6, 7, 24, 82, 83, 85, 86, 88, 91, 109, 114, 118, 130,141, 168, 174, 186, 291, 299, 411, 428, 540, 548, 561, 565,570, 599, 605, 607, 617, 634, 643, 652, 663, 672, 697, 711,718, 732, 745, 759, 765, 782, 786, 793, 798, 800, 823: n = A,T,C or G
  misc_feature 832, 838, 842: n = A,T,C or G
naaaannaagccctttgaaaactncgttggaaaaccaccaagggtttagtccactctgcccccaaatcctgagtctgctganntnncnccnttccttcggggtgggttnaggangtgnccctggctggtngggagggtgancctctgaaataagggtggggagtcatncagggnggcctgggcccntggggggggggttaaacctcaaaaaaaggggagggaaggcttgggcactgcctgaaccatttcctctacagccagacccaccaggtggcggacccatcatcccanctctgcantataatgggattgcatcataatcaagccctgaaaataactgggaccacctgcttcccccttcttgataaacaacacatgtgaatgcaacctgtcagtcgttggaaagttgcngcatggaaaggcaattnccaaatgactttttaaaaagtatgagaaatttgcctggcttgaaccgtttttttaaattaatgcccggggaggtttaaccatttaataacctatttcattaacctttaattngaagcctngggccttttgaangggnggggnttttaaagggaaaaacaatttttgggggnattctntnttgggccaangggggaaccaaaaaatngtttgtaanccctggggnccccgggtccnggccaaacnttttttttaccaaaaacccctaaangggaccctttcaanggggttncccgggtttggccnccatttaaaaggnaccccggggggaangggacnaaaaaaccttttttttngccnaaaaaanggggngnggggggcctttttttatataaanccattttgngggganaccnattttttcccccg

SEQ ID NO: 8588 - DNA, 673 bp, Homo sapiens
  misc_feature 13, 15, 31, 42, 51, 56, 60, 64, 66, 68, 71, 74, 77, 85, 89,93, 96, 99, 111, 112, 117, 119, 120, 134, 135, 141, 142,143, 145, 150, 156, 159, 160, 165, 167, 169, 173, 175, 186,190, 196, 200, 203, 204, 206, 210, 211, 224, 232, 235: n = A,T,C or G
  misc_feature 241, 244, 246, 249, 258, 263, 264, 288, 292, 298, 313, 325,340, 403, 549, 564, 571, 611, 619, 625, 626, 638, 640, 646,647, 650, 653, 663, 665, 668, 669, 673: n = A,T,C or G
ttaaactttacancnttcgtgtccgtggaantctgggtgttnggcccgccnttcgntggnctcncncnttngcngancctttttncgcncttnccnganaaaaaaaaaggnnggccnannccgaccttttttcnngccagnnngnttttngggggnccnntaaangncntggntnaaggccaaggncccnttgggncctnggnnancaanncccgtgaaggatnttcggggnagntcattngancnganggccacctnaactnnccgatgtgcaacatcacaagcacnttcnaaaatngcccgatggcacaanttgagcaaggtntccttccgggcaccnaaatccgctttttgaatttgcctgactgctgaaaaacccccctgttaaaagcatgaaaataanaccaaagctcagggctggccgaggaaacttgcattctcaggccaatggcccaaaagaaaagacgtggatgggacgtggaaacattttcaaagcgagatatttctagttgacagaacttgtcttttcttaggtattgagtcttgagnggtgcttggctattntaggatnttgctctttcttaacagggaatgttactaataattggggnttttgtcnaaaccnnagaagagagctntngaaatnnggnccnacatctaccntnttnnccan

SEQ ID NO: 8589 - DNA, 837 bp, Homo sapiens
  misc_feature 17, 18, 46, 48, 65, 69, 70, 74, 75, 86, 87, 94, 120, 123,132, 137, 149, 162, 166, 174, 183, 190, 193, 213, 215, 218,222, 223, 235, 253, 274, 287, 325, 328, 329, 382, 398, 418,434, 443, 452, 464, 507, 565, 577, 585, 591, 699, 718: n = A,T,C or G
  misc_feature 722, 723, 743, 751, 755, 768, 822, 830, 836: n = A,T,C or G
cgaactctttagacctnncgaatccgtgctggcgccagacactggntnacccagagcttccgcangcannaccnnatgggtttttnnccttttngtaaaaaatccaaaagaagaattttngantaaaaaaancaaantcctgtttttgngcctggaaccacnttgnccaggcangttataaancagggtnganctgggttagccccacccagnancgnaggnnggcctcattggngaccctcctagcccagcntaaaagggcatcaccctgcgngtgctcacaaagnaatatggaattttcccttgcggggccttcaattgtggnatnnaaagaaccctctcttgtgatcctgtgtcctgggtgctctgttggcctccttcntgccacccgaaggaanaacatggaggcttagagaangggctcactgaacaancgaaaatgnttgggaacnccaaaggagctnccaaacacaaaggagccatgaatggggcctaggctcttccccnagggctggggtggcctcaaccgtcttgttgggcaaaaatcctgcttcccttgacacancgggggcttaanaaaccaanccctgnggtcacacaccctggtggaattaacaatgcctggctggacccctcactgggagaaaagggctacaccgttttgtggaaccaaaagccaaaaaaaaggtgttttatttnggaaaaccaaaatccaaanctgnncattttaccttttaattaanaaaattcntttngggaatttggctnatgccctataaatccccaccaccttttgggaaggctgaaggtggggaaaaaaanaccccgancccaant

SEQ ID NO: 8590 - DNA, 744 bp, Homo sapiens
  misc_feature 11, 57, 568, 612, 614, 617, 648, 661, 666, 674, 680, 690,703, 727, 729, 736: n = A,T,C or G
tacccttcacntactcagcgggaagataggcaatgccatttttttcagatgtacacntgccacacacctaaacataggtttaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacggggtatcactgtcacccagactggagtgcagtggtgggatcttggcttactgtgacctctgcctccgggttcaagtggtcctccctcctcagtctcctgagtggctggggcggcangcgcgtgccaccatgcccagctggtttggtctatttttctgtananacngggttttgccatgttgccgggcttggctcanactcctggctcangcgancatttcgncttcgnctcccaaggngctgaaattatangtgtgaaccccagcatctggccanantgagganaaataatg

SEQ ID NO: 8591 - DNA, 1593 bp, Homo sapiens
  misc_feature 1, 3, 4, 6, 7, 8, 9, 11, 12, 13, 15, 17, 18, 20, 21, 22,24, 25, 26, 27, 28, 30, 31, 32, 33, 35, 36, 37, 38, 39,40, 41, 42, 43, 44, 45, 46, 47, 50, 52, 53, 54, 57, 59,60, 61, 62, 63, 64, 69, 70, 71, 72, 75, 77, 81, 84, 87,90, 93: n = A,T,C or G
  misc_feature 94, 95, 96, 97, 98, 100, 101, 102, 103, 104, 105, 106, 107,108, 109, 110, 111, 112, 113, 114, 115, 116, 117, 118, 119,120, 121, 122, 125, 128, 129, 135, 145, 149, 150, 151, 152,153, 154, 157, 158, 159, 160, 161, 162, 163, 168, 173: n = A,T,C or G
  misc_feature 176, 181, 185, 190, 193, 195, 196, 198, 200, 202, 203, 204,208, 209, 211, 213, 218, 221, 224, 226, 227, 228, 229, 230,232, 235, 243, 244, 245, 246, 261, 264, 267, 269, 271, 274,277, 278, 286, 288, 289, 291, 294, 297, 298, 300, 301: n = A,T,C or G
  misc_feature 302, 303, 305, 313, 319, 320, 322, 326, 330, 334, 336, 337,340, 342, 352, 353, 356, 357, 358, 359, 360, 361, 364, 367,374, 376, 379, 381, 386, 388, 390, 391, 395, 396, 399, 400,404, 408, 410, 411, 414, 415, 418, 419, 422, 423, 431: n = A,T,C or G
  misc_feature 433, 434, 436, 442, 444, 450, 452, 453, 456, 457, 458, 470,471, 475, 478, 482, 483, 484, 485, 486, 495, 502, 503, 511,513, 514, 515, 516, 519, 521, 525, 526, 528, 532, 534, 536,539, 540, 544, 553, 555, 556, 557, 561, 562, 563, 566: n = A,T,C or G
  misc_feature 567, 568, 569, 577, 582, 583, 586, 588, 590, 593, 596, 598,599, 603, 605, 606, 607, 608, 612, 613, 614, 618, 622, 626,628, 631, 635, 637, 641, 644, 645, 653, 654, 658, 662, 663,667, 668, 670, 674, 675, 680, 681, 682, 686, 692, 696: n = A,T,C or G
ngnngnnnngnnngngnngnnngnnnnngnnnngnnnnnnnnnnnnnggngnnnggngnnnnnnggggnnnnggngngggnggnggnggnggnnnnnngnnnnnnnnnnnnnnnnnnnnnnnatnaanntaaacncttgggaaancccnnnnnntgnnnnnnnaaggnggggnggntgggnaagngaggnggngnngngngnnngttnnantnttttnttntcngnnnnncnggngggggggnnnngggggggggggtggnggnggngngngtnganntttttttngnngncgnggnngnnnngngggggagngggggnngngagngggncggngnngangngggggggggnnggnnnnnnggnagnggggggngngangnggggnangnngggnnggnngggngggngnnggnnggnngannggggggananncnggggangngggggngnnggnnnggaaaggagaanngggnggngggnnnnnggggggggntgggggnnaagggaangnnnnggnangggnngngggngngnggnngggnggggggggngnnngcgnnngannnngtgggggnggggnntgngngngcnggngnnagcnannnngggnnngggnggangggnanggngganangggnaanngcgggggnngagngggnngggnnanggtnnggggnnngggnagaggngcgnaanngggangggggggganggggggaaggggangngnggnncncngngngggnngggggganggnnngnnngggggggggggcgnngnngnnntnggnngggnngggggggngnncnngnngngnnanngnnngnnangggggggagngggggnggngnnggngnggngnncgnnggcnngnnggggggggggnnnaagncnnangttggggggnnnnnngngnggnngggngggggcnnnnngnnnanggangaggngnnngangcnnngggnngnnggggaggggggggangacncctgnngggggggggggggggggggagtnngagggnngancgngnngannnncggnntnaaggnnngggggnngaagangnnnnnnnnangngggggggggnggngggggggggtggcggnnngggggagggtggggggcncaanggggnggnnnnncgggggggggnananggggggggggggnngnggganaanagnaaagggnanggggggggtnatgggggggnacgcggngggngggngggggnnnggaanaggggggggggggggggggngggggtngggggtnnnnccgggggggggggngaagngngngnggnaagggggnggganngggnnagggnaangangncngngnggggaggggaaanggnggggggnggggganngnnngggnngnnnnngggcngggggggngcangannaggggggngggtgggggangnngggggngngggncgtaggggggggggagaagnggggggcanngntcgcgnncggngggggntanaannnganggggngngtgtggggngggggcnntgggggannnaggggnaggggnacggggggngnaagnnnngggnngctaggggcgg

SEQ ID NO: 8592 - DNA, 730 bp, Homo sapiens
  misc_feature 9, 94, 104, 113, 117, 124, 128, 130, 151, 157, 189, 203,205, 214, 230, 262, 267, 270, 347, 465, 524, 529, 552, 585,610, 621, 637, 648, 653, 674, 686, 687, 688, 689, 690, 691,692, 693, 694, 695, 696, 697, 698, 699, 700, 701, 702: n = A,T,C or G
  misc_feature 703, 704, 705, 706, 707, 708, 709, 710, 711, 712, 713, 714,715, 716, 717, 718, 719, 720, 721, 722, 723, 724, 725, 726,727, 728: n = A,T,C or G
tattgaccnctttcgattccgtgctgtcgcaaactttcttttgtttcaccagtgggaaggaaaaaataaatgtgaaccaaagcaactccctacntttagctcantggggtggntccnttccttnttgncngggtcttggccctttggttgncggccnaggaaactattggtgatcccacctttgggctnagatgtgatgggangngggatgtangggcccaaggagaaanggttgcagccagcggtcaagcttggaacaaanacctncangcgggtccctggtgttctgggcagtcacgcccaactgccaaccgctttgcttgcactttcactggggttaaaagaanattcttcccttccaagaatcccaaaaacccgctctctgccagggggactttggaattccacacggatcaagaacaaggacacctttgcctgggaacaatttggatgggagctctcctnctcgtgtccactggaaagacatttaggaatcaaattcaaggaagaaagaccccgaaaanggganttgggaatgggtgtgtgtgagancatatgttggttttgtgtgtgtgtgtgtgtgcntgcctgtgtattttcacttatatanaaaaatattgnttttttaacaaacatntatccaatttnttgtntaaaaaaatatcccttcgcgngttctatcaaannnnnnnnnnnnnnnnnnnnnnnnnnnnnnnnnnnnnnnnnnntt

SEQ ID NO: 8593 - DNA, 754 bp, Homo sapiens
  misc_feature 2, 4, 91, 641, 675, 681, 683, 694, 736, 738, 754: n = A,T,C or G
tnanttaccccttttcgaatccgttgctgtcgcagaaccagccacaggtttcatcgacggtgacttgattgagagtttcctggatattagncgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattggcctctttttatttaaattggcagtgtagggagttgtgggtagtggggaaanaaggttaagaaggtttcattgtctgtgaagtganaacctncntttacttttcntttattgcctctgaaaacattaaggcctaaaggcctgactgncnaaccatgggtagcccn

SEQ ID NO: 8594 - DNA, 752 bp, Homo sapiens
  misc_feature 4, 9, 91, 618, 652, 674, 709, 738, 744, 749: n = A,T,C or G
tgtntgacncctttcgaattccgttgctgtcgcacacagcccctctgcaaaggttgggaaacttgcaaggaatttaaggaaatctctgttnagtcattagccagccactaaactaactgagcagatccttcagtgatcacacacaacaaagaatacagactttacagacttagtcctagaaaatcactacacaaacagcacaacaatgcacctgggactaagggagaggagatgagttccagagttggtatattatttaaatgtctagttttcaataaaaacaattataagacacagagcaaaactagaaagtatggcccatacccagggaaaaacaagcaaccaatagaagctgtccttgaggaagttaatatcttggacttactagaaaatgactttaacactagttattataaatatgttcaaaaaactaaaagaggccaggtgcggaggctcacgcctataatcccagcactttgggaggctgaagcaggtgggtcacctgaggtcaggagtttgagaccagcctgaccaatatggcaaaaccctatctctactaataatacaaaaattagccaggcgttgtggcgcacacctgtaatcccagctacttgggangcttgaagcaggagaactgctttgaaactgggangaagaagttgcagtaagctganatcacccactgtcttcacctgggccacaagagtgnaacttcatcttccaaaaaaaaaaaaaaancccttnatttncct

SEQ ID NO: 8595 - DNA, 759 bp, Homo sapiens
  misc_feature 3, 19, 713, 755: n = A,T,C or G
ttntttgacccctttcgantccgttgctgtcgatgctcccaggtctccagtgtcacctctcggtacagtgtcctctgggccaggtccagctgttcccactcctcctgtgtgaatgccatagccacatcctcgaagcacacagatgcctgaaacagggcacttgttactgctcagagaccccaggtcctcatgccctcacggaggtacctgttaaggcctaaatgttggtgtccccccgtaaaattcatacattggaacctaatacccagtgagatagtgttaagaggtggggtctttacaaggcaattaatgtcctcataaaagaggcttgagggagcctgtgttcaccttctaccatatgaggacatgtaagaggtgccatctatgagacagcaggccccaaccagaccaactctgttgacacattgatcttggacttaccagcctccagaactatgagcagtcaattctgttgtttgtaaattgctcactctaaggtatcttattatagcaacccaaacggactgggacagctccatgtatgtggtctgtaccattccttttcttgggcatctcacctcttgccagtcacagcaagtggtcctgatttctagactggaaatgacaggaacttcactaggagatccttacccctttcttttttacaaaaatcacaagattcgaaatgaggtaagaaagaaacttttaaatcnggggtgggaaaactgcagcctgtaggacaaatcagggcttgngggg

SEQ ID NO: 8596 - DNA, 773 bp, Homo sapiens
  misc_feature 11, 20, 555, 561, 597, 628, 636, 638, 642, 669, 696, 703,705, 711, 720, 722, 726, 734, 757, 762: n = A,T,C or G
ttattttaacncctttcgantccgttgctgtcgcttgacgcttggcctggctttttttgtggagatggggtcttgccgtgttgcccaggctggtctcaaactcctatgctcaggcgatccaccctcctcggcctcccatagtgctagggttataggcaagagccactatacccagactggattagatttcttcacatgacatccgtagagtgcctgtgtgtatgctctgtggatgtaaaatgaacaggcaagagtacagaagtagaatctctagccatgcagtcagacagatggctccaaaattagttacttggttatggagacgatcaagttacttgactttgagcctcagttatgtgccaaatgaggatactaatagtatctatctcaaatgcatatatgggtgttcactgtctctgggagacattttccaaagaaaccaagactaacttgttaagggaatagatttctctcactgatacaggatgtgctctaactggccccacgatactgcattgaattacaagtgtttcctaagtatctgtgggggatcanttcaanacctctcttgaataccaaaattgaggaagtcaagtncctgatttaaaatggcaatagtatttgcatntaatctantngcantcctgtattaattttggcattctctanaattccttgtaataccctaatacaaangtaaatngnttggtnagtagttantnctgntatttcangggattaatgaccaaaaaaaaanaaatntctatacattt

SEQ ID NO: 8597 - DNA, 1156 bp, Homo sapiens
  misc_feature 2, 3, 4, 5, 7, 8, 9, 10, 11, 12, 13, 14, 15, 16, 18, 19,20, 21, 22, 23, 24, 25, 26, 27, 28, 29, 31, 36, 37, 38,39, 40, 41, 42, 43, 44, 45, 47, 48, 49, 50, 51, 52, 53,54, 55, 56, 57, 58, 59, 60, 61, 62, 63, 64, 65, 66, 68,69, 70: n = A,T,C or G
  misc_feature 71, 72, 73, 76, 77, 78, 79, 80, 81, 82, 83, 86, 87, 89, 90,91, 92, 93, 95, 96, 98, 99, 101, 102, 105, 106, 108, 110,111, 113, 114, 115, 116, 117, 119, 120, 121, 122, 123, 124,126, 127, 128, 129, 130, 132, 133, 134, 135, 136, 137: n = A,T,C or G
  misc_feature 138, 139, 141, 142, 143, 144, 145, 146, 147, 148, 149, 150,151, 152, 153, 154, 155, 156, 157, 158, 159, 160, 161, 168,181, 183, 184, 188, 192, 194, 195, 198, 202, 208, 210, 218,221, 224, 229, 242, 253, 278, 280, 285, 286, 287, 292: n = A,T,C or G
  misc_feature 293, 297, 302, 305, 306, 307, 314, 316, 328, 329, 331, 357,360, 362, 363, 368, 375, 377, 379, 384, 387, 389, 390, 394,399, 404, 407, 412, 414, 418, 432, 451, 457, 458, 459, 467,473, 475, 485, 487, 492, 496, 506, 513, 529, 537, 547: n = A,T,C or G
  misc_feature 556, 558, 571, 587, 590, 612, 614, 617, 619, 624, 627, 634,635, 640, 647, 656, 663, 666, 675, 677, 681, 692, 715, 732,742, 743, 761, 770, 777, 786, 831, 832, 833, 840, 841, 850,862, 863, 864, 882, 883, 886, 924, 949, 952, 957, 958: n = A,T,C or G
  misc_feature 968, 974, 980, 992, 1010, 1022, 1039, 1041, 1047, 1048, 1060,1076, 1077, 1088, 1094, 1100, 1133, 1145, 1146, 1147: n = A,T,C or G
gnnnngnnnnnnnnnnannnnnnnnnnnnangggannnnnnnnnngnnnnnnnnnnnnnnnnnnnngnnnnnngannnnnnnngannannnnngnnanngnngannananncnnnnngnnnnnngnnnnngnnnnnnnngnnnnnnnnnnnnnnnnnnnnncaaaaangaaaacccttttngnnaaancccncnngcngggncggcangnaacacccnggnccnagcanaagccccaccggnggcagggaagncacctgtctcccttcagcaacagcncngcacnnnaccgnnggangcgcnccnnncaggacnanggtcagcagacnncnaagacgggccccaaagaaggccaccnggnanncaagngcaccgngnancaccnccncnngaangagcnggccnagngacgncnaagngcacaagaaacggnggggaaaggggacgggganaacaannnccagaaanaagggnanaaaagacacngngggcngggngcggggggcncacgccnggaaacccagcaccangggaggcngaggcggggnagacacccngnacggcagggaggncgagaccaggcccggncangaaggggggaaaacccccgccncnacnanaaaanagnaaaaaannagccngggccanggggggcanggagccnggnaaacccagncnaccnaggggagggcnggagggcagggagaaaaccgccnggaacccgggggaaggncgggaggggnnggcagccgaagccaagangaaaccacngcccaancggcaacancccaagccccgggggggggggaccaaaggaaggcgggaggaaccnnngggggcnnccaaaaaanaaaaaaaaaaannnggggggaaaaaaaaaaannaangcccgggggggccaaaggggggggggggccaaggggangccccgggggaaaaaaacccccaangcnaaccnnggggggggangggccngggaangggccagggggnaaaaaaaaaccggggcanggggaaaacccngggggaaaggggccggnanaggganngggcaaaaccgngagcccgaaaggaaanncaccgccccanacgggnaacccncccaaagcccgggggggggggggacaaagggangcggagggaaannngggggcccc

SEQ ID NO: 8598 - DNA, 796 bp, Homo sapiens
  misc_feature 1, 10, 18, 34, 630, 742, 743, 757, 760, 762, 768, 774, 796: n = A,T,C or G
ntttgacgcnttcgcggntgccggagctggcggnaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgagctcctaaggggtcagctgccccactcctgacttttttatttttaatggtctataccttctgcaacatttttgtttatggccattttgaatagttgggactttgactcctcacttgtgaataataggaatatatttttgcagaatctaacataatacccttaaaattcatactggacaaccatcaagtgtgatgtataagtatctggtgtaaacaaattttattcagcatattaaattattctgtggttttgcttttncttgataatgtaggaaggtgcaccaagtacccaggttttttcttctttggtgggtgggctttaaaaccgcctggaattggccatttttggcatttggtcttacttgaaaaanncttgtgggcaagcngantngggtanttattngacccatggttgtttcttcatn

SEQ ID NO: 8599 - DNA, 723 bp, Homo sapiens
  misc_feature 6, 9, 15, 17, 500, 517, 612, 619, 645, 654, 655, 656, 657,658, 659, 660, 661, 662, 663, 664, 665, 666, 667, 668, 669,670, 671, 672, 673, 674, 675, 676, 677, 678, 679, 680, 681,682, 683, 684, 685, 686, 687, 688, 689, 690, 691, 692: n = A,T,C or G
  misc_feature 693, 694, 695, 696, 697, 698, 699, 700, 701, 702, 703, 704,705, 714, 715, 717, 721, 722, 723: n = A,T,C or G
tgtttnaancccttncnaatccgtgctgtcgataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacangtttaatgctagatgangatgtctcaagccgtgagtgtgcttgtgtaaaatggtggcaccatcatctcgttggaggaattttacttgaatggtattttgggaaaatgtacanattcttntgataaagaaataaatgggttgtgtnaaaaaaaannnnnnnnnnnnnnnnnnnnnnnnnnnnnnnnnnnnnnnnnnnnnnnnnnnnaaaaattcnncncccnnn

SEQ ID NO: 8600 - DNA, 843 bp, Homo sapiens
  misc_feature 5, 10, 94, 95, 96, 445, 473, 531, 545, 637, 663, 686, 688,695, 722, 725, 727, 732, 750, 767, 778, 782, 797, 832, 838: n = A,T,C or G
ttatnttaancccttttcgaattccgttgctgtccgagcaaataccaaggcctaaaaaagaatgaattatttgctgtttgggaaatggaagccnnngctgagtgctgaagcacagggactctgcgcaggaagaggaggggaagcaagaaatgaatttgggtccttgtgatggcagtggctgctgccatcacgctgtgtggctagggctgcacacttcatggagccggtggaagccccgtccctcatgagttgggactggagccgcaaaccgctgctgcagacccaggccttctgctctatggagcaggcaggagccccaccctcttgggcagggctacagccacccaaactgcagctgtggatccgagcctctctgctcctgggggagccgggaacaggcagaatttgcccttccagatgcagctgcagcccgcgcaggcagganccagggacaaagtgggagcccttgcctntttccaaagttggcggggtggggagctcccaagtgcagcttgtggcttgcccccccangcacaaggaacganggcattttttgcaaccctgcacccatcgggccattcccaaggaaaggacaagccccccttttaacccttccattcccttgcaaggtttcaanggggtggttttggttttccaacttgncttgggccttttttttcaaattncnaacaaanttggttttgatttttgggaaggggganatncnggaancccaaaaaacctttgaancccattaaaatggccanccagggaaggnaaanggggggtgggggttnccccaattaaagggccccccccctttaaggcccangggaanggcct

SEQ ID NO: 8601 - DNA, 1448 bp, Homo sapiens
  misc_feature 1, 4, 5, 6, 8, 9, 10, 11, 13, 14, 15, 16, 17, 18, 21, 22,25, 26, 27, 28, 29, 32, 33, 34, 35, 37, 38, 40, 41, 43,44, 45, 46, 47, 48, 49, 50, 51, 52, 53, 54, 62, 64, 67,68, 69, 70, 72, 73, 74, 76, 78, 79, 80, 84, 86, 88, 89,94, 95: n = A,T,C or G
  misc_feature 97, 99, 100, 102, 103, 104, 105, 106, 107, 110, 112, 116,119, 120, 121, 124, 125, 126, 129, 130, 133, 136, 137, 139,144, 146, 150, 154, 156, 157, 159, 160, 161, 162, 163, 164,166, 167, 168, 169, 170, 172, 173, 174, 175, 176, 177: n = A,T,C or G
  misc_feature 178, 179, 180, 181, 182, 183, 184, 185, 186, 187, 188, 189,191, 194, 200, 201, 204, 220, 225, 226, 227, 228, 229, 230,231, 232, 234, 235, 238, 239, 240, 241, 249, 250, 252, 256,258, 261, 262, 264, 272, 277, 292, 298, 299, 300, 309: n = A,T,C or G
  misc_feature 310, 312, 314, 315, 318, 321, 324, 325, 331, 332, 347, 349,351, 353, 356, 357, 358, 361, 365, 367, 368, 371, 373, 380,382, 384, 388, 390, 395, 397, 401, 405, 409, 410, 414, 421,425, 430, 434, 437, 438, 441, 446, 447, 448, 449, 465: n = A,T,C or G
  misc_feature 466, 476, 477, 489, 491, 501, 506, 520, 521, 522, 523, 524,529, 533, 535, 543, 546, 548, 550, 562, 563, 564, 566, 568,570, 571, 582, 591, 592, 594, 598, 606, 608, 610, 611, 614,624, 628, 629, 630, 632, 635, 637, 641, 644, 646, 647: n = A,T,C or G
  misc_feature 651, 654, 656, 658, 661, 667, 670, 671, 675, 678, 679, 683,684, 686, 688, 690, 692, 695, 698, 702, 705, 707, 717, 719,720, 722, 724, 730, 732, 734, 736, 738, 741, 745, 746, 747,750, 753, 754, 758, 759, 761, 763, 765, 766, 768, 769: n = A,T,C or G
nacnnngnnnngnnnnnngannggnnnnnggnnnngnngnngnnnnnnnnnnnngtgggaangngannnnannngnannngtgngnannggggnngntnngnnnnnnagngngganggnnnggnnnggnnggnganngnaaggngngggngggncnntnnnnnnannnnnannnnnnnnnnnnnnnnnngnttntgattnntanaaccctttgggaaaantcccnnnnnnnnannaannnngggggggnngngggngnggnngntgagtggngaggngggaagggggggggntttttnnntttttttcnngngnnggnagnagnnaggggnntgggggggaggtacngngngncgnnnttngccntnntgngngagggcngngngggnanggagngnggangggnggcnngacnggggggngggncggcngggnganntgngagannnnggggcgaggagtgagnntgccgcgganngggaagcgggtngnggacgaagtngggangaggagcagaggannnnnggggngggngnggggacgnggnangnggagggcggggnnnangngnngcgacggggangggcggggnnangaantagggggngngnnggngctgaggtgngatnnngntgncncgtntangnngganggnananggngagganggnngganganncganngngngnanagngangganganangggagggagngnngngnagcgananantngncgngggnnntanggnngcgnngngngnngnngnganntgagtnagagnggntgngnngganntggggngcggggnngganggggaggnanaggatacgnatgcngcnngtggangnnancgangnacganggggngngtnggggggngggacgcggcanggagggtacggctnngcgagnatntggtnngggnncgcnacggcagatgcggnnaagnangggacngatgntngtgnnnggggcgnnggnngcgaacnnggcngngannnnngggnggaagnagggtnnangantcgngtgatgagngcggctgagnngaggnnntgnagngcgngncagggannngatgacgtnggggnngagacgangncgctcggcngagcncngcggcnngtntgntgtngggnggaanggcgngagcnnggagngngtgnggngtangngaggagngagngtgnntanggcgnntnnganngcgnagngnangntngngcanggaggngcgccgagntgcganggagngngangnnggaggaanngtggagaggcgngnngngcggagcgggagnnaccgnngcggcgggagggcgggcgnggtnaaganggtcgcgagaggtacggngggngggnggngntgaaggtgnggaggngnggnagngcanannncgcgggnnncgngagaggggncgcgtngngcgtgaggggnaacg

SEQ ID NO: 8602 - DNA, 673 bp, Homo sapiens
  misc_feature 13, 15, 20, 70, 75, 149, 182, 289, 291, 308, 398, 406, 412,427, 443, 467, 486, 487, 508, 513, 529, 533, 543, 596, 601,617, 637, 645, 647, 657, 673: n = A,T,C or G
tagctttaaaccntntcgantccgtgctgtcgggcgatgggctcttagtatcggaggattggagccatcngattnttacctgaaattccttagtctctcctgtgttggggaaatggtaagtaagacagattttcccaacagagagcgtntctatctcttctctactcctcccttttaaaatngagattctgacagtgtaaaggagttaggacccccttttggggatcgggcatggttttgtggctttaaaatgctttaaaattgctgaagtttcttggtttggaactgnantctcctaagtaacattntatcatcgcacgtgaaatactgtaactctcggtgccaaatccaggaaaaatgggcggttaggagaagtccagggaaagccgactgagcangttgtganggtaancaccctgttaaatgncacaaaaatgtcactntgcttctctaactaggaaaactgnaggacttttgaataagggnngatattagatttaaaaattanatagncatccctccaaaaccnttgntgttactggngagtgcagactgtataatattagaatagatgcgcgcgcggtactagctgagtnaacancagcacatgcaacctnttctaaatcaaatactgagnggctactngntcacctcganggagggatatctgacn

SEQ ID NO: 8603 - DNA, 772 bp, Homo sapiens
  misc_feature 1, 11, 17, 19, 20, 22, 87, 471, 564, 572, 604, 612, 617,646, 653, 676, 680, 681, 682, 689, 690, 691, 692, 693, 694,695, 696, 697, 698, 699, 700, 701, 702, 703, 704, 705, 706,707, 708, 709, 721, 722, 724, 729, 738, 739, 740, 748: n = A,T,C or G
  misc_feature 763, 765, 771: n = A,T,C or G
nataacctttnaacctncnnantccttgctgtcgcccagagactggctcccagtgagctaagcccagcccgcgacccttggatgttnccagctgatttaatactcatgataaacccagtaggtcagtgccagtattatgagagaagtggaggcacagaatgtcacatccacctccccaaagtcaacagctaggagtgacagagccaggattctgccaggcaggttggcctcagaggccacacttcttatcccaataataaaagtgaacaagaacaggatgaagttagagtgagagagcgagagtggtaacactcatgcaatcagagaacaagagaaagctcaatggaaacatgtattcactgacaggattaaaacacaaaacaacaaaaagagagacggccgggcgcggtggctcacgcctgtggtcccagcgctttgggaggccaaggcaggcagatcccctgagctcangagtttgagaccagcctgggcaacatggtgaaaccctgactctactagagatacaaagattagctgggcatggtggggcatgctttgtactcnggaagctnaagtgggaaggatcgctttgggacccccggangcaaaagntgcanttgagttcaaaatcgcaccactggacttntaacctnggtgatagaatgagaatcctttntttnnnaaaaaannnnnnnnnnnnnnnnnnnnnaaaaaaatttcnngnggccnttttttttnnntccccaantttaaaaaacttttntngtttgnc

SEQ ID NO: 8604 - DNA, 758 bp, Homo sapiens
  misc_feature 2, 3, 10, 15, 36, 41, 43, 59, 75, 88, 93, 95, 105, 109, 112,118, 121, 124, 126, 130, 142, 145, 163, 172, 175, 178, 181,185, 192, 206, 209, 213, 328, 601, 616, 644, 654, 663, 693,730, 739, 752, 758: n = A,T,C or G
tnncctttanacccngtgctgcgggaagataggcantgccntnttttcagatgtacacntccacccccccaatangaatggtttttantaatncnttttcccttntttncanggcttntcntgncngtanctattctttaantantaggaggggggagggtanttttagganttnctnccnccancagaaantaatggctggtggnttncccnttaaaagggtccagtagtatcattgtctgttggacatatagatcagttttttcttctaaatgctattcaactctctattattaacatatatatgtatgtgtatatatatgtatgnggtgtatattttattagaaaaaataatctattattcaactagataaaataagaggtaagagataacatagtagaactcaattatctactaaataaatattactcccattctctgtggaacacccaacaatattctcttcagggaagtgacactgactattgtagaaagaacaagttaatgtgaaaaataatgtttcaaggccttattattttattttcttaaagagtaatcatagagggggaagcataatacttcattaccatgtctgtagangaatggaagagcctnttatgccaataagaaatacaaggcattnctttggaccnttagtcatncttcaaaagaagtgggaatgtgtctcaagntctggttttatgaagaaatcaccatttttgaaaaatntggggatgnaaaaatgcccccntaaaan

SEQ ID NO: 8605 - DNA, 1581 bp, Homo sapiens
  misc_feature 5, 6, 8, 9, 10, 11, 12, 13, 15, 28, 39, 46, 47, 56, 58, 59,60, 61, 62, 63, 64, 65, 66, 67, 68, 69, 70, 71, 72, 73,74, 75, 76, 77, 78, 79, 80, 81, 82, 83, 84, 85, 86, 87,88, 89, 90, 91, 92, 93, 94, 95, 96, 97, 98, 99, 100, 101,102: n = A,T,C or G
  misc_feature 103, 104, 105, 106, 107, 108, 109, 110, 111, 112, 113, 114,115, 116, 117, 118, 119, 120, 121, 122, 123, 124, 125, 126,127, 128, 129, 130, 131, 132, 133, 134, 135, 138, 139, 140,142, 143, 144, 145, 146, 147, 148, 149, 150, 151, 152: n = A,T,C or G
  misc_feature 153, 154, 155, 156, 157, 158, 159, 160, 161, 162, 163, 164,165, 166, 167, 168, 169, 176, 177, 178, 179, 180, 181, 182,183, 184, 204, 205, 206, 208, 209, 210, 211, 212, 213, 214,215, 216, 217, 218, 219, 220, 221, 222, 223, 224, 225: n = A,T,C or G
  misc_feature 226, 227, 228, 229, 230, 231, 232, 233, 234, 235, 236, 237,238, 239, 240, 241, 242, 243, 244, 245, 246, 247, 248, 249,254, 255, 256, 257, 258, 259, 260, 262, 263, 264, 265, 266,267, 268, 269, 270, 271, 272, 273, 274, 275, 276, 277: n = A,T,C or G
  misc_feature 278, 279, 280, 281, 282, 283, 284, 285, 286, 287, 288, 289,290, 291, 292, 293, 294, 295, 296, 297, 298, 299, 300, 311,312, 313, 314, 315, 316, 317, 318, 319, 320, 321, 323, 324,325, 326, 327, 328, 329, 330, 331, 332, 333, 334, 335: n = A,T,C or G
  misc_feature 336, 337, 338, 339, 340, 341, 342, 343, 344, 345, 346, 347,348, 349, 350, 351, 352, 353, 354, 355, 356, 357, 358, 359,360, 361, 362, 363, 364, 365, 366, 367, 368, 369, 371, 372,373, 374, 375, 376, 377, 378, 379, 380, 381, 382, 383: n = A,T,C or G
cgttnnannnnnntngaaaaaccccccntttttgggggnaaaaaannccccccccncnnnnnnnnnnnnnnnnnnnnnnnnnnnnnnnnnnnnnnnnnnnnnnnnnnnnnnnnnnnnnnnnnnnnnnnnnnnnnnggnnngnnnnnnnnnnnnnnnnnnnnnnnnnnnnttttttnnnnnnnnntttttttttttttttttttnnngnnnnnnnnnnnnnnnnnnnnnnnnnnnnnnnnnnnnnnnnnnggggnnnnnnngnnnnnnnnnnnnnnnnnnnnnnnnnnnnnnnnnnnnnnnttttttttttnnnnnnnnnnngnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnngnnnnnnnnnnnnnnnnnnnnnnnnnnnnnnngnnnnnnnnnnnnnnnnnnnnnnnnnnnnnnnnnngnnnnnnnnnnnnnnnnnnnnnnnnnnnnnnnnnngnnnnnnnnngnngnnnnnnnnnnnnnnnnnnnngnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnngnnnnnnnnnnnnnnnngnnnnnnnnnngnnnnnnnnnnnnnnnnngnnnnnnnnnnnnnnnnnnnnnnnnnnnnnnnnnnnnnnnnnnnnnnnnnnnnnnnnnnnnnnnnnnnnnngnnngnnnnnnnnnnnnnnnnnnnnnnnnngnnnnnnnnnnnnnngnnnnnnnnnnnnnnnnnnnngngngnnnnnnnnnnnnnnnnnnnnnnnnnnnnnnnnnnnnnnngnnnnnnnnnnnnnnnnnnnngnngnnnnnnnnnnnnnnnnnnnnnnngnnnnnnnnnnnnnnnnnnngnnnnngnnnnnnnnnnnnnnnnnnnnnnnnnnnngnnnnnnnnnnnnnnnnnnnnngnnnnnnngnnnnnnnnnnnnnnnnnnngggnnnnnnnnnnnnnnnnngngnnnnngngnnnnnnnnnnnnnnnnnnnnnnnnnngnnnnngnnnngngnnnnnnnnnnnnnnnnnnnnnnnnnnnnnnnngnnnnnnnnnnnnnnngnnnnnnnnngnnnnnnnnnnnnnnnnnnnnnnnnnnnnnnnnnnnnnnnnnngnnnnnnnnnnnngnnnnnnnnnnnnnnnnnnnnnnnnnnngnnngngnnnnnnnnnnnnnnnnnnnnnnngnnnnnnnnnngnnnnnnnnnnnnngnnnnnnngnnnnnnnnnnnnnnnnnnngnnnnnccgn

SEQ ID NO: 8606 - DNA, 786 bp, Homo sapiens
  misc_feature 1, 2, 12, 89, 90, 114, 123, 135, 196, 412, 526, 535, 573,592, 599, 604, 608, 610, 656, 657, 673, 681, 685, 704, 722,725, 733, 743, 747, 770, 771, 784: n = A,T,C or G
nntttacacctngtgctgtcggccaggggaggtcaaggctgcagtggactgagattgcaccactgcactccagcctggataacagagtnnaatcttgtctttaaaaaaaaaagnatgactcancagatggaggancctcccatttggtctttcctttccgtttggtttgtcttccaaatctcctccagcctgctgngtattcctcagcaactcacttcaagcaccaccctgatcctgtagatgaaccctgcataactttctccgtcaacaaacacctgaggatctgctgtgtccccagtactaggggtgattataaaacatatatgcagtctctgcactcatgtttcccacagagaaagtactcattcagcaaagttttctaagtacctgtaatgtgcaaggcactgtgccnagtctgaagtcatggagactgtcatggtcactgcccatagagcacttaccttatattgagggagggggcagaacttaagctaataattcaatacttatttgcttcataatcatnagctgctgngaggggaaaagtcacatgacaagtgacctagtgcagangatgtaacctgggtctaanggggatnattanaaangntttccttaacgggagtttcgaaaaccagcctggggccaacacgggnngaaacccccgtttttnagttaaantccnaaaaaaaaaaaaaaatttnccccgggggggggggggnggnccccctgnaattcccaantccnccaagaagggttaaggcaaagannaaattttttcaanct

SEQ ID NO: 8607 - DNA, 1526 bp, Homo sapiens
  misc_feature 6, 22, 31, 33, 35, 37, 38, 40, 44, 50, 53, 54, 57, 60, 62,63, 64, 65, 66, 69, 70, 72, 75, 79, 90, 91, 93, 98, 105,112, 123, 126, 128, 134, 136, 137, 138, 144, 148, 165, 166,168, 170, 173, 177, 183, 185, 192, 195, 198, 203, 204: n = A,T,C or G
  misc_feature 207, 216, 218, 221, 224, 226, 233, 242, 244, 247, 252, 262,263, 267, 279, 281, 284, 288, 289, 290, 294, 295, 296, 297,301, 302, 305, 316, 319, 325, 328, 329, 332, 336, 337, 342,354, 366, 375, 378, 379, 389, 391, 399, 404, 408, 412: n = A,T,C or G
  misc_feature 418, 419, 422, 436, 439, 440, 443, 444, 446, 448, 454, 466,468, 478, 480, 482, 488, 490, 493, 498, 499, 501, 521, 522,523, 527, 530, 531, 541, 543, 544, 551, 552, 554, 559, 561,564, 565, 578, 581, 583, 587, 594, 596, 603, 604, 605: n = A,T,C or G
  misc_feature 613, 618, 620, 630, 635, 640, 643, 646, 652, 653, 656, 659,665, 669, 676, 677, 679, 687, 688, 694, 701, 704, 708, 728,732, 734, 736, 743, 744, 746, 764, 776, 781, 784, 785, 788,792, 800, 803, 805, 807, 813, 817, 833, 838, 839, 840: n = A,T,C or G
  misc_feature 854, 860, 864, 865, 868, 870, 884, 890, 892, 896, 903, 921,923, 925, 931, 939, 943, 950, 951, 953, 961, 964, 968, 988,995, 999, 1002, 1006, 1007, 1011, 1013, 1015, 1017, 1019,1020, 1023, 1026, 1027, 1028, 1030, 1031, 1035, 1040: n = A,T,C or G
  misc_feature 1041, 1043, 1050, 1051, 1057, 1067, 1070, 1073, 1076, 1081,1083, 1085, 1090, 1091, 1103, 1113, 1119, 1121, 1138, 1155,1179, 1180, 1182, 1193, 1203, 1205, 1213, 1218, 1252, 1253,1260, 1263, 1279, 1283, 1285, 1286, 1287, 1288, 1294: n = A,T,C or G
cccccncccccccccacacacncacacggangnananngnaaangaaagncannacnccnannnnnacnnangcngaancagcctcgaanncngagangaaaganacacagnccagagacgtnagngnagaagngnnntttacntttngcgacaccgcacacgcnngngncgngggnaagacncngcgcacnacncgncatcnngcnaacgcacgngncgnagngnacgcggnccgacgacngngcnacganggagcacganngaangacggaggacgncngangacnnnagannnnacgnnggngccgcagcacnccnccaccngcnncangaannacggnaccgcacgacangacgcgacgggnacacagcanacnngcggaacgcncngagaacgnaacgncacntacngacgannacnagccaagcgacgangannacnngnangcccancacgacaggggngncgcgaaaggnanancacaancncgnaaganngncccgaaaccaaaaacgcgcnnncggncgnngacgcgaggnanncacggcnnanggcgnangcnnggagacgagcganagngnaaanagaacgngnaaaaaannnacgcgcgngagcnangcaacagacngcggntaaanagncgncgcgcnngangcnaacggncganaccgacnnancagccgcnngcgacncagcacngancccnccagggcctccgcgaccganacanangnaaacgannangagacgagacacatacancgccgagctacnccgcncanncgnacanagaggccncangncncacacnagcngagatgccagcgccgnagccnnngcttcgaggagagncgccgnacgnngcngnagagcaaggcacgnagacanangcgncgaccanagacgacgcgcatacgangnanggaggnccgagggnaganggaaatnnangagcaacncgngcangggcgagggacgcaccgganggcaaanagangangagnnacgncncnananncgnatnnncnnatcncagannancgcaccnncgacanacataggacnggnacnacngcccngncncgagnncacagagaatgnacccagcgantagcangnaaaaacctcaatgcaanacacgacacgcgacgtngcgcgcgaacaaacgcgcgacagnncnacgaacgaganaggagagaanancacgcganaccgngagatgcggaacgcgcagagacgatcatacacgnncggaggnctngcaacgtaaccgcacncgangnnnncggcanncgnncnananannngngcggntnnaagnnncgnacgcnncngnganccncggncgcgtagngacgcgnaatnannnaangacncgcaggancaanganacgcancacaancaancagacgngagcncgcannagagcacaganacgnanngagggnagaacaaggagcgacacgnagnganntaanggacanaanacaangaacgtancgacgcnaggnnnaggnnnnccg

SEQ ID NO: 8608 - DNA, 864 bp, Homo sapiens
  misc_feature 1, 4, 15, 99, 103, 110, 118, 145, 171, 177, 195, 240, 281,301, 353, 362, 380, 512, 527, 529, 619, 679, 694, 717, 740,751, 760, 762, 768, 784, 787, 807, 816, 821, 840, 848, 860: n = A,T,C or G
ntantcctttcgaantccgttgctgtcggcccgctctctgtaaagtgtttgcttgtgccaaaagggaaataagtggccgtgggagggtggtggtggttntccntgggcantccggganccgaaggccgaactggtccctggcgtngggtaagccccttcggcccgggggangtggangggcccaccaacccaaangtcaagtttccctttcccaccctggtggttttcttggtttccggnttttttttttccttttttttcctaatataatatttttgggngggaattctattttattttnaattctctttttctcctccaaacacaatggcactgcttatctccgaaatggngtgatcgtntcctcattgagcaacggntgccaccgccctgtgggtagtgtgtgaccgtggctgtactgtatagtgaacatagttggcatatctttgtttgaagtttgttggtgactccccaaactggtgtgaaaaaagaaaaaagctcaaaaaaatccncaaaaagacaaaacncncaaaaaaatcctgcctatattttactcagtttcaaactttattaagtctatttttaattataaaacccagaaagctacaattttcttttntttcccctccaccccccccccacccatttggtgggcttttttggttttttaaatggccanaaactgttggaggtngggttttttttggggtttggggnttttgggtttttgggttttgggnttttttacccngaaaaaaangnaagggncccaaggggattaaanggnggggaaacccgggccccctnggggggccnccccncaaaacttaaaggggcagnaaaacttnccccttaccctngggg

SEQ ID NO: 8609 - DNA, 1484 bp, Homo sapiens
  misc_feature 3, 4, 6, 10, 12, 19, 21, 22, 25, 28, 30, 31, 32, 34, 38,42, 44, 45, 48, 56, 63, 70, 71, 72, 73, 78, 80, 83, 84,86, 89, 90, 91, 92, 93, 94, 95, 96, 97, 98, 104, 109, 119,120, 123, 128, 130, 140, 141, 144, 152, 153, 156, 157, 161: n = A,T,C or G
  misc_feature 164, 177, 190, 192, 194, 198, 199, 200, 201, 204, 211, 214,215, 224, 228, 234, 237, 247, 250, 251, 262, 269, 272, 273,276, 277, 278, 279, 282, 283, 285, 291, 292, 293, 306, 311,315, 319, 326, 330, 332, 339, 341, 343, 350, 366, 378: n = A,T,C or G
  misc_feature 382, 384, 386, 401, 410, 415, 420, 421, 429, 430, 432, 439,444, 447, 452, 456, 458, 467, 468, 478, 482, 489, 490, 498,503, 504, 505, 517, 536, 540, 544, 546, 547, 548, 549, 550,551, 556, 566, 569, 575, 576, 579, 584, 585, 586, 590: n = A,T,C or G
  misc_feature 593, 594, 601, 624, 627, 631, 634, 655, 661, 664, 665, 669,670, 674, 678, 682, 690, 699, 704, 705, 710, 713, 723, 730,741, 745, 748, 749, 760, 764, 772, 775, 781, 787, 791, 792,794, 796, 798, 800, 801, 802, 805, 807, 818, 824, 827: n = A,T,C or G
  misc_feature 831, 833, 837, 839, 840, 842, 843, 845, 850, 853, 858, 867,873, 876, 886, 887, 888, 892, 896, 907, 909, 912, 914, 917,921, 925, 940, 942, 943, 944, 948, 950, 960, 964, 972, 977,997, 999, 1004, 1009, 1012, 1018, 1026, 1030, 1034: n = A,T,C or G
  misc_feature 1036, 1047, 1053, 1075, 1080, 1082, 1083, 1089, 1091, 1104,1106, 1107, 1115, 1123, 1128, 1133, 1136, 1140, 1143, 1144,1153, 1156, 1159, 1166, 1175, 1182, 1188, 1190, 1191, 1196,1203, 1204, 1207, 1208, 1216, 1217, 1222, 1231, 1232: n = A,T,C or G
ccnncngcgncnatgccancnnagnaanannncnatangggncnnganaaggaggncgcgggncgacggnnnnggcgngncanngnatnnnnnnnnnnagaatnaccgngccttccaannccngctgnanaaagcaaccnnggngcccccannacnngggnggnggggggggggggntttttcccttttnancncacnnnnccngcgaagnggnngggggggangtanaaaggnacngacaactatnggnngcgattggtangaggaanagnngcnnnnggnncngggagnnnggcggcgagagcngcggnaggnaggncgcgcgnaagngnggacgangnanggaaggnaggagggaaggcacgnacgggaggacgngcgngngngaggtacggaacgcnacgtggcgnggcgncgcanngggatggnntnggaaggnaaagntanggaangganangaagggatnngatggagggngcgngcaccgnnagagagangtcgnnnacggaaaagacncgtaacgagggacacgganaggngacngnnnnnnagggntcggaaaggnaangaacgnncancacgnnnacgnaanngaagcgnagggaacgtgaagggacgggcanggnagtnagnggaagggagacggagacgaangcacgnacnngcgnnggancggnaggntaacgtancgcacgtanatggnnggganggnaagtgtaggnaaaggcnggcgagtatangagnggnnagggtgaggancganaggtaggnaangatagnacggcngggnngngngncnnngangntatgacgcggnggaagngangcancnaagncnngnnanggaanganggagngaagggacngcggcnagngcggcaaggnnncacnaggngcggaggtacngnagngngantgcnacgnagtgtacggatgacngnnnggangnagtggaaggnaggnaggaggcnaggcngtgagagggaagcgagcacngngggtnggaanggngcggangaaggctngcanggangngagcgtaggcnggcaanggagggccggacgcaagcgcangaatngnngaggancntgcgtgccactgngnngcgcgtangggagagngatgnacggnagnaaangtnngcagggaanggnacngaatggncagcatggnatgaaangagcgnanncgagngcagcannggnncgatgcgnncggancgacgaganngagnctgcgnagcgnngnncggnggaggngnggnnggagagnagggaaggnatgggnggaangnanggtacgacangnacggaggcacggtgcgataggacggntnggacngaacggtacgantgcagggcgggtgnggacgnctgagcgaagggatcgcngtagncgangcacngacancangcgggggagngacggntnnantncgngangcacgggacgatngnaggaagganacgacgcgaggncccg

SEQ ID NO: 8610 - DNA, 768 bp, Homo sapiens
  misc_feature 5, 6, 11, 565, 648, 653, 678, 679, 680, 681, 682, 683, 688,689, 690, 691, 692, 693, 694, 695, 696, 697, 698, 699, 700,701, 702, 703, 704, 705, 706, 707, 708, 709, 710, 711, 712,713, 714, 715, 716, 717, 718, 719, 720, 721, 722, 723: n = A,T,C or G
  misc_feature 724, 725, 726, 727, 728, 729, 730, 731, 732, 733, 734, 735,736, 737, 738, 739, 741, 746, 751, 767, 768: n = A,T,C or G
tctcnntcgantccgtgctgtcggaaaattgggactgagctagagaaagaagggatcttaaaaccttgctagagaaagagacctgattccatcttcaagacatttgaaaccaaagacatttgaactggaactaaaaggttcaactcagataaactcctagttagattgaagagatatattcttcactctactcttggcaggaaacaaagcactttctctgggagaaaatattttcttctttagtatccttttatattcaatgtttagcaaaaataaaaattttgagagacttgaggagaggaaaatgggatccgtaatcaagagaaacaatagtgtaaataaactcatcaataacccagatgtttgaattaacagacaaaaaaaaaacttatgttaaagaatttagaagaaaagatggtcaaaactggtaagaaggtagcaaatttcagcagagaaatggaaactaaaaaactaaatgaaaattctagaacaaaaagtctatgaagaattaattggttggacttattggagtcaggtcagtaaaaataatatgcaaacagaagcncggaagtagaatgagaaaagagcctcagagacctgtggggcacattaaatggtctaacatgcctgtgactggaatctcagganaaaanaaatggggccaaaacaaaatctggnnnnnnaaaannnnnnnnnnnnnnnnnnnnnnnnnnnnnnnnnnnnnnnnnnnnnnnnnnnntnatttnggggnggggttttttttaaann

SEQ ID NO: 8611 - DNA, 759 bp, Homo sapiens
  misc_feature 6, 607, 649, 660, 679, 692, 695, 719, 736, 744, 750, 757: n = A,T,C or G
tctctncgcgccaggattttccagtcaaaagcatattcgagggactaaaaggacatcaagagggatacttcagtcaaatgataatcagctatgaaaaaataccttcttacagaaaaagtaaatctcttactccacatcaaagaattcataatacagagaaatcctatgtttgtaaggaatgtgggaaggcttgcagtcatggctcaaaacttgttcaacatgagagaactcatacagctgaaaaacactttgaatgtaaagaatgtgggaagaattatttaagtgcctatcaactcaatgtgcatcagagatttcatactggtgagaaaccctatgagtgtaaggaatgtgggaagacctttagctggggatcaagccttgttaaacatgagagaattcacactggtgagaaaccctatgaatgtaaagaatgtgggaaggcctttagtcgtggctatcaccttacccaacatcagaaaattcatattggtgtgaaatcttataaatgtaaggaatgtgggaaggccttttttggggctcaagccttgctaaacatgagataattcatacaggtgagaaaccttataaatgtaaagaatgtgggaangccttcagtcgtggctatcaacttactcagcatcagaaaatncatacttggtnagaaacccttatgaatgtnaaatattgttggnaangctttttgtttggggctttcaacnttactcgacatcagatntttcattnctgggngagaaancc

SEQ ID NO: 8612 - DNA, 746 bp, Homo sapiens
  misc_feature 5, 6, 7, 11, 22, 89, 303, 610, 614, 682, 684, 704, 727, 740: n = A,T,C or G
tgtannnagcncttgggatgcnatgaaattcagtataaaattgaatagaagtaatgttaatggataatcttgtcttattcctggtctcntagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggntgatttgttaatgataaaccaatcttgcattcttggaataaactcaggttgcttatgatgtataatccttctttatatcattagacttagtttcctaacattttctttacagtttttaaatatatgtttatgatagaaacgccgtttctacagaaaaaaataattatttttaaaggcataagttattgggtctagacttagtacctgaatgatgaaataatcggtccacaaacccctgtgacatgagtttgcgttataacaaacctgcccatgtcccctgaacttaaaaggtaagaagccacacacncccncacagatgccccaccccacacacgcccaaagaaattggcttttaactttccattcttataagctctancngagttggcatcaaggctatnctggctttatatagaaggtaaanaaggggtactttntttatt

SEQ ID NO: 8613 - DNA, 727 bp, Homo sapiens
  misc_feature 8, 12, 524, 530, 553, 619, 644, 671, 694, 696, 708, 712,723, 727: n = A,T,C or G
ttactttncgantttcgttgctgtcgcgcagaccatggcagcccgcccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaataccggtcttaaaaatgtctagtatgaccagtgttcagaagcaaagtattcctgtgttgctggaangcaganatgctctcgtgagatcccagacnggctcaggtaaaactcttgcctattgcatcctgtggtccagtccttcaacatggatcaaaaatcangtttactgtatcacatttacaaganacagagcttaggaagtaataccaagcntgcccagtatggaggactggttntnctagtctgttgntganaacaactcttntttn

SEQ ID NO: 8614 - DNA, 1451 bp, Homo sapiens
  misc_feature 3, 5, 7, 12, 13, 17, 22, 24, 25, 26, 27, 28, 29, 30, 31,33, 35, 36, 38, 40, 42, 43, 45, 48, 49, 54, 70, 79, 85,87, 89, 91, 92, 93, 94, 104, 107, 113, 114, 117, 118, 119,120, 121, 122, 123, 124, 125, 126, 127, 128, 129, 130, 131: n = A,T,C or G
  misc_feature 132, 139, 141, 145, 147, 148, 154, 155, 161, 162, 163, 166,169, 181, 187, 226, 231, 233, 235, 238, 243, 244, 246, 251,253, 254, 255, 263, 267, 272, 275, 277, 279, 280, 292, 298,303, 307, 320, 324, 325, 329, 330, 332, 335, 336, 338: n = A,T,C or G
  misc_feature 342, 343, 346, 352, 354, 355, 365, 367, 373, 374, 379, 380,382, 384, 396, 397, 399, 405, 407, 408, 411, 417, 432, 433,435, 439, 441, 445, 446, 451, 456, 457, 459, 472, 478, 485,486, 491, 501, 502, 506, 512, 513, 520, 529, 534, 536: n = A,T,C or G
  misc_feature 538, 541, 553, 556, 560, 562, 564, 567, 572, 577, 578, 580,586, 592, 594, 600, 602, 619, 629, 635, 637, 638, 647, 648,654, 663, 667, 671, 673, 674, 675, 677, 678, 680, 690, 697,702, 704, 708, 710, 713, 715, 717, 720, 726, 734, 736: n = A,T,C or G
  misc_feature 738, 743, 749, 755, 759, 760, 762, 768, 773, 774, 781, 797,802, 812, 815, 817, 818, 824, 835, 845, 847, 859, 862, 872,876, 882, 887, 896, 897, 906, 907, 916, 918, 919, 926, 928,932, 935, 941, 943, 945, 947, 949, 950, 958, 960, 972: n = A,T,C or G
  misc_feature 985, 992, 994, 995, 997, 1006, 1007, 1022, 1028, 1030, 1034,1035, 1039, 1043, 1045, 1048, 1049, 1052, 1053, 1054, 1058,1061, 1064, 1074, 1076, 1078, 1085, 1089, 1090, 1095, 1105,1107, 1113, 1114, 1115, 1118, 1124, 1127, 1142, 1148: n = A,T,C or G
acnancngcggnngcgngggcngnnnnnnnngncnnancnanncncanncgcgncggcggagcggcacgngggccgcanggccgngngngnnnnagcgacgccnagncggaannacnnnnnnnnnnnnnnnnggtcgcngnccgngnnccccgnntcgaannncgngangacgggcgacgncgcctnggcccccccgcccgcgagggggcggggggggggtttttncaggngncncgnggccnngnggggngnnncgggggangcgngggangcnangnngagcggggacancagggnaggcngagngcggggcggacgnggcnnccgnngncgnncngganncgnaggggngnnggggacaacncnccccgnnggggnnancnccggggcgccgnnanccacgnanncgncagggngggcgccccggggcnngngccngngggnnggggncgcgnngnggagcgggcgaangcgggncgcccgnncggcnccgggcgagnncccnccgggnncccccgngagagccgncgccnancncgnccgacgagcggncgncggnangnacncgcgngcagnngngacganaacccngngcggcncncaggcggcgccgcggcncccgggcgangcgggngnngcccggacnncggcanggagcgcgncgcncggnannncnncngacggggcgncgcgccnggcgngnagcnanacncngngtnggcaangcgcgcgngngnccgcncaaganggcgcncagnngngcgcgncgganngcggcgngcagggacggacgcgncagcncggcgacgcngtncnncacccncggcgcggggngcgcgcacgngnctagaacgcacncgngggacggggngggngcgccnacggncgccccgtnncgacgcacnncccgccgancnnaccggcngnggcncgncgcagnanangngnngccgcgangnacagggggagangacggcggccggnaaggccntnncngaggacganngcacacgcacggganagggangngcgnngcgncggngnggnngcnnngggnggnacnccgcgcccgnanangggaagngcgnncccgncgcgaggctnancgacgnnncgngggggnggntcgacgcgcgggggnggcatnggncccgcnnatngaagcncgngnnagcgccgcccaggcgnacgggnangggnaacngncgngggcaacgaatggngngcgggaannggcnacgnacnnctgtgcgcnagcgnggngccgccncnagcntnagccgggggacgngacnnagggcacgggngacccgggacantnangaagngncgcnggncggncaggcacnggggngcgcngnggncgaagnngngcgaaanggnacggacgngcgagggacangggtcngcggnaaagnngggnagcggncggnncngggcggnggcnccg

SEQ ID NO: 8615 - DNA, 1459 bp, Homo sapiens
  misc_feature 4, 5, 6, 7, 9, 13, 14, 15, 18, 22, 23, 28, 29, 30, 31, 32,34, 35, 38, 39, 46, 53, 54, 55, 56, 59, 60, 61, 62, 63,64, 66, 67, 68, 69, 70, 73, 74, 76, 77, 79, 80, 81, 82,83, 85, 87, 88, 90, 91, 92, 94, 95, 96, 97, 98, 99, 102,103: n = A,T,C or G
  misc_feature 104, 105, 106, 107, 109, 110, 115, 119, 121, 123, 124, 126,127, 129, 130, 131, 133, 135, 136, 138, 139, 140, 146, 148,150, 152, 154, 155, 157, 159, 160, 161, 163, 164, 165, 166,169, 170, 171, 173, 175, 177, 179, 180, 181, 184, 185: n = A,T,C or G
  misc_feature 188, 189, 192, 195, 196, 198, 199, 200, 201, 202, 203, 204,205, 208, 209, 210, 212, 213, 214, 215, 216, 217, 218, 219,220, 221, 222, 223, 224, 231, 232, 246, 250, 254, 255, 256,258, 259, 260, 263, 264, 270, 273, 275, 278, 280, 286: n = A,T,C or G
  misc_feature 290, 296, 298, 300, 301, 302, 321, 322, 329, 333, 339, 340,345, 348, 349, 350, 351, 358, 359, 367, 374, 375, 384, 391,395, 396, 400, 404, 405, 413, 415, 421, 430, 436, 440, 452,457, 458, 461, 465, 468, 475, 476, 478, 480, 481, 486: n = A,T,C or G
  misc_feature 491, 494, 497, 514, 517, 519, 531, 533, 537, 538, 539, 541,544, 549, 550, 556, 558, 559, 560, 567, 575, 582, 588, 592,594, 601, 603, 607, 618, 625, 628, 640, 645, 647, 650, 651,655, 664, 666, 667, 683, 685, 687, 691, 694, 697, 698: n = A,T,C or G
  misc_feature 699, 700, 702, 703, 707, 712, 716, 720, 722, 726, 732, 733,737, 739, 741, 742, 743, 744, 746, 749, 750, 751, 761, 763,768, 769, 771, 773, 776, 781, 782, 785, 790, 797, 799, 800,801, 802, 806, 808, 809, 827, 831, 832, 843, 848, 850: n = A,T,C or G
cggnnnngngggnnnggngggnnggggnnnnngnnggnnggggggnggggggnnnnggnnnnnngnnnnnggnngnngnnnnngngnngnnngnnnnnnggnnnnnngnncgggngggngngnngnncnnngngnngnnngggggngngngngnngngnnngnnnngcnnngngngngnnnggnnggnnggngcnngnnnnnnnnggnnngnnnnnnnnnnnnnggggcgnntgaaccctttgggnaacncccnnnannnccnnggtggngcncnggngnccggcncccnccgagntngnnnggggggggggggggggggnnttttttngttncgggcnnccggnccnnnnggggggnntgggggcnggggggnnggggggggnctttttncctnngggngggnngggggggngngcggcnggcggaggngcgggncgangacggctgtggnggggnnggngctnggnggcgagnngntnnggggnggggnggngcngggacggcgtgcgggcnggncnaggggggggggngnggannngnggncgtcnnggcggntnnnggggggngggggggnggggtcnctcganggcngncgggggngntgcncgggggctggncgggggnggntgggggggggcnggcgngnggnnggangggggggtntnnggccgggggggggggngnangggncgntcnnnngnngggnccgangggngaangntggngggggnnccgngngnnnngnggnnngggggggggngnggggnngnanacngggannggngcacnggggggncnnnncgcngnncgcggggtgagaggggtncggnnacggggggggngggangngtgggggngcagcnnncggngngtnggngncgccgcnnngggcnnnngngngngggggggncggacncgncggcggcgaanggngnggggagatgngngggtgncggncnggggnggnncggcgnnnnngnggngngncccccnggggngnggngggggaggtgagcgaaangtgggggncgctggggggngcnnatacgggggggggggggggggggnngggggggggnntgnnggggcnncgnncgnggnggggnnggggggncnggncnggggnnggcgggggnnggnnngacnggggngctngggagggggggnnggcnnggggngggnnngtagggnncggggtgcgnagnaggggcgncgnnngctagggggngncgnnaaggggggcggggagngacngngagggatgnggggggggnggngngnggnngngcggacngnggggngccngggaggagcggacataggnaagggggggacgtngcgcggnagngntgggncggggggnggtgggaacgngggggcgncnnccggtgggggggggganggctcggngngacgtgcgggatgcgggcgcnggancaacgngngnggtgcngnncg

SEQ ID NO: 8616 - DNA, 757 bp, Homo sapiens
  misc_feature 3, 4, 6, 8, 14, 16, 21, 26, 34, 35, 36, 37, 42, 44, 54, 60,63, 64, 70, 71, 74, 75, 77, 78, 84, 87, 90, 93, 113, 118,128, 131, 133, 533, 588, 630, 745: n = A,T,C or G
agnntntncgaccntntcgantccgngctgtcgnnnntgtgnangctacctgtnggaacntgnncaatgnncanncnnacatgngtnggntgnctaccgcacaggaaatgacnttctncgatgcatgnttnanccatgcgcggtggattctgctagatttccctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaaagtgtggcttgatcttattgaatccatgttgaaaaatctatccaggattcatcccgtgtcaacaatggtaaaggggatgtatggcattgagaatgaagtcttcctgaccttccatgtatnctcaatgcccggggattaaccagccgttatcaaccagaagctaaaggatgatgangttgctcaactcaagaaaagtgcagataccctgtgggacatncagaaggacctaaaaaacctgtgactaagtgagctctagcttgtagaaatttaaaaactacaatgtgattaactcgagcctttaattttcatccatgtacatggatcacagttgnttttgatctttt

SEQ ID NO: 8617 - DNA, 1178 bp, Homo sapiens
  misc_feature 1, 2, 3, 4, 5, 6, 7, 8, 9, 10, 11, 12, 14, 15, 16, 17, 18,19, 20, 21, 22, 23, 24, 25, 26, 27, 28, 29, 30, 31, 32,33, 34, 35, 36, 37, 38, 39, 40, 41, 42, 43, 44, 46, 47,48, 49, 50, 51, 52, 53, 54, 55, 56, 57, 58, 59, 60, 61,62: n = A,T,C or G
  misc_feature 63, 64, 65, 66, 67, 68, 69, 70, 71, 72, 73, 74, 75, 76, 77,78, 79, 80, 81, 82, 83, 84, 85, 86, 87, 88, 89, 90, 91,92, 93, 94, 95, 96, 97, 98, 99, 100, 101, 102, 103, 104,105, 106, 113, 114, 116, 120, 123, 127, 146, 147, 148, 149: n = A,T,C or G
  misc_feature 150, 151, 152, 153, 154, 155, 156, 157, 158, 159, 160, 161,162, 163, 164, 165, 166, 167, 168, 169, 170, 171, 172, 173,174, 175, 176, 178, 179, 180, 181, 182, 183, 184, 185, 186,187, 189, 190, 191, 192, 194, 195, 197, 200, 201, 203: n = A,T,C or G
  misc_feature 206, 207, 209, 217, 218, 219, 220, 221, 222, 235, 236, 237,238, 239, 240, 241, 242, 243, 244, 245, 246, 247, 249, 250,252, 253, 254, 255, 256, 257, 258, 261, 265, 266, 267, 270,273, 274, 278, 279, 280, 281, 282, 283, 284, 285, 286: n = A,T,C or G
  misc_feature 287, 288, 289, 297, 298, 299, 300, 302, 303, 304, 305, 306,307, 308, 309, 310, 311, 312, 314, 315, 316, 317, 318, 319,320, 321, 322, 323, 324, 325, 326, 327, 329, 330, 331, 332,334, 335, 337, 338, 339, 340, 341, 342, 343, 344, 345: n = A,T,C or G
  misc_feature 346, 347, 348, 350, 351, 352, 353, 355, 356, 357, 359, 360,361, 362, 363, 364, 365, 366, 367, 370, 371, 372, 373, 375,376, 377, 381, 384, 386, 387, 388, 389, 390, 391, 392, 394,395, 396, 398, 399, 401, 402, 403, 404, 405, 406, 408: n = A,T,C or G
nnnnnnnnnnnngnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnncctatcnncntagnacncccnttttttgggaaaccccccnnnnnnnnnnnnnnnnnnnnnnnnnnnnnnngnnnnnnnnnntnnnngnngnggnngncgnngngggttttnnnnnnttttttttttttnnnnnnnnnnnnngnngnnnnnnnggngggnnnggnttnngggnnnnnnnnnnnntttttttnnnngnnnnnnnnnnngnnnnnnnnnnnnnngnnnngnngnnnnnnnnnnnnannnngnnngnnnnnnnnnagnnnngnnngganggngnnnnnnngnnngnngnnnnnngnncggnnnnnnnngnnnnnnnngngnnnnnnngnnnnngngnnnnngngnnngnngnnnnnggnnnnngnnnnnngcggnagnnnngnnggnnnnnannnnnnnngngnnnannngnnnnnnnnngngnngnnnnnnnnnngangnngnnnngnncngnnnnngangggnngngnnnngagnngcannnnnnangannngnnnnnnnngnnnngannnngnggnnnnngnngnnnnnnnnnngnanannnnnnnnnnnngngannnngnnnnnnnnnnnnngnngnngnaagnnnnnnnnnncnnnnnnnnnngnnnagnnngnnnnnnngncngngnnnnnnnnnngnnnnnnannnnnngnngngannnggnngcnnnnnggnnnnnnngnnngnnannnnnngnngngtgngnnngnngngnnnnnnnnnnnnnnnnngnnnannnangngangngnngnnngngnnngnnnnngngannngagnnannanncnngnanagcnnnnngnnngnnnnnnnngnngnnnnnnnnnnngnnnnncnnnnnnnnnnnnnnnanngnggngnnnnnnggnnnngnnngnngnngngnnnnngngnnnnnnangnnannnnnnnnnnnannnnnnnnnnannnncnnnnngngnnagannnggnnngnnnnnngnnannnnngnnannnnnnnannnnnnnnnnngnnngnnnggganggngtnnnnnangnnnncnnnnnngcnngngnnngnnnntcagnnnnnnnncncgg

SEQ ID NO: 8618 - DNA, 813 bp, Homo sapiens
  misc_feature 3, 5, 19, 91, 434, 467, 537, 562, 567, 593, 666, 691, 743,769, 793, 795, 801: n = A,T,C or G
atntnttacccctttcgantccgttgctgtcggtttatatccaggatccgtgcctttccaccgggtgtggtgggcccagaggcagcccaangagtggtgctcttctgtccagatgagccttggtgcccagaatggaaaagaaatcaggcatcggcctaagaggaactgaaagcacccccaactctttccagggccctcattttgaatagaattctctctgggtggcagcagactcagctctgggacattttgcctccacctggaccttggaggctgacagtggggagggctgggcctagaggaagagcagaaatggggaatatttggaagcggaggctgctggacacagagacctcctgttgggggtagtacgtggagacagaaccctgcttctgggcatcctggggtagtactcacaggggcagggggcccangcatcttgccagagccaaaaataatgagccaangctcacatccctgcagttggcttctcaatcaccgttcagtaccttctatgacccccaagtacaaggtggnccttaaccatttgtcaaatgcattncactnttcttcctttttcccaatttctaaangggttctttgggaagttccatcttgaacctgtggttttcaactttggaaccgaaaatgttttaaggaaatttngggccaaggaaaaaaactacttccnttcattgggtaagccctttgaatgggaaagggttttttcttgaaaccaagtngattttaaaaatccccattggggggnggggtttccccaaaaaaacccttncntttttnatttaaaccttt

SEQ ID NO: 8619 - DNA, 1619 bp, Homo sapiens
  misc_feature 2, 13, 17, 24, 25, 28, 29, 31, 36, 37, 39, 40, 41, 42, 45,46, 47, 48, 49, 50, 51, 52, 54, 55, 57, 59, 60, 61, 63,64, 65, 66, 70, 71, 74, 75, 76, 77, 78, 80, 84, 86, 88,94, 95, 96, 98, 100, 101, 103, 104, 105, 106, 107, 108,109: n = A,T,C or G
  misc_feature 110, 112, 113, 114, 115, 118, 120, 124, 127, 135, 141, 143,147, 148, 150, 153, 154, 155, 156, 159, 161, 167, 180, 181,183, 188, 189, 192, 193, 197, 198, 205, 210, 215, 217, 223,226, 229, 230, 232, 234, 235, 240, 245, 247, 249, 250: n = A,T,C or G
  misc_feature 251, 252, 254, 256, 257, 259, 260, 270, 283, 285, 292, 296,297, 301, 303, 304, 305, 317, 319, 327, 335, 336, 337, 342,344, 347, 350, 352, 358, 360, 362, 373, 379, 382, 385, 392,398, 405, 406, 408, 413, 417, 421, 426, 428, 433, 437: n = A,T,C or G
  misc_feature 438, 443, 448, 449, 451, 458, 467, 468, 471, 475, 476, 477,483, 485, 486, 488, 494, 500, 505, 506, 510, 512, 513, 519,527, 534, 547, 557, 563, 571, 592, 595, 600, 601, 603, 605,608, 609, 613, 615, 617, 625, 629, 630, 633, 635, 637: n = A,T,C or G
  misc_feature 641, 645, 648, 650, 657, 665, 671, 672, 677, 680, 681, 682,689, 691, 692, 697, 702, 704, 708, 710, 718, 722, 726, 733,738, 739, 741, 744, 747, 761, 766, 771, 777, 778, 788, 796,797, 801, 802, 807, 808, 811, 813, 829, 835, 839, 841: n = A,T,C or G
  misc_feature 851, 854, 855, 862, 866, 867, 871, 873, 880, 881, 886, 887,902, 910, 911, 912, 928, 933, 936, 943, 947, 949, 951, 952,953, 955, 956, 957, 978, 983, 995, 999, 1006, 1022, 1026,1028, 1029, 1033, 1036, 1038, 1042, 1046, 1059, 1060: n = A,T,C or G
cnccccccacccncccngaccccnnacnnangggannannnnaannnnnnnncnncngnnngnnnncgcnnaannnnncnaacnangnaaccgnnnancnngnnnnnnnncnnnnagnanaggnaanaggaggangccggncngcanncncgnnnnccngnagcgcngcgcagccggacnngngaggnnccnngcgnngcggaanccacngcgcnangcggancgnacnngngnngaacncaccncncnnnncncnncnntcgggatacnggaaaaccctttngngaaaaancccnnccangnnngacacaagaagncncacaccangacccccnnncccancngcngcnancagcgngngngggccaattcnaccccntcnccnaagagcncaacgncgccagnncncaacnggcncagnacccngnaggancaannacganaaaanngnacgccgngcacagcanncgnacgnnncacgcncnngncgaccncccgcnggggnngganannccacgncgcgacgnaagccgnccgcgacggcacnacgaccgccnccacgncccgacgnaggcggaagcacgccgcccgngangacanncngnagnngcgngncngagcgcanacgnnacncnangcanaccngancngagcacnacgcggcncacccnncccgnagnnncaaaacncnncaccnaggancncgcnancccgcgcncccngcgnccgacgncgcanngnagnacnccgcgaccaagcgnccgcngcgangaacgnnagcaacgaangcggcgcnngcgnncgcgnngancnaacggacgcacgcgcnacagcngcgngnagacggaccnggnngacaccncagnncgcncncgagacnncgccnngccggcgaacgaccncgcccggnnngggcacgccacaacgngcgcnccnacgaccnggcncnannnannnaagcaggaccgcagagaacgnaacgncagacacgacanacancgagggngaccacgcacagccgngcancnnagcnacngngcgncaancacacgcggacgnncgncgcgaggcnacgctngngnacngaacnaaacgggaccgcggggacgncannacacgannncgcacgcgngcgncgacncggcncggnangcgagacaacgaaagcgncgnnanngcaacncnacgcncccaaagcacacgnaanggcncaggagnggccnanaaannganacctgcgcacgngngcgcaccgagacgagcacgcgagacggccngcngagggnaagcgagacgccaacaggcgcgccgacgagcggnccncagncggaaccgnagnaacccggggacgnncgncgncgcgangcgcacgcnnnaccgagacgcaccgaancacaccgacgacgcatcgcgnagccaaaacganaagggngggcnaccggacaggnaanggancgaacagcnacgccaccgnacgnnacgcaccgcacgggcaggcncgggacganacannnnaangnagncanncgcgcgacgggaaacgcncgcgtacgcagnngnaaancgnnancgcacngcgnccgggnacacgncccgcaacgnanacggacgngncgccn

SEQ ID NO: 8620 - DNA, 756 bp, Homo sapiens
  misc_feature 1, 9, 13, 19, 707, 738: n = A,T,C or G
nttttaccntcgnttcganccgttgctgtcgaatctgtaaacctttatgacattaggaactaagaaaacttagtcccttcgttagggggataatgaaatgtatttagtgtttgtgaaacatagatgggtatgtatttgggacaattctgtaactttgctttttttatttttatttttccatagcttattggggaacagggtggtgtttgggttacatgattaaagttctttagtgggtgatttgtgggattttggtggacccatcacccaagcagtgtacactgcaccctatttgtaatcttttatccctcgcccccctcccaccatgcctcccgtctaccatgatgatcctgttttaaataagaaaataccatttcgcaggctccagatgttctggcatcctccctgtggatttcccagtgcctgcagctcacaggacaacaggggctgtggtagagtcacctatgagatcctggagtagtggatggaggagatggaacagtgaagacggaaactgagctcagtatccgggtgccaggagacaaaggccctttgctttttttcatttaatattctgatctacccctgttgacacatgttaaagtatagtcattttgactgctatgtattatgttccattggggggaacatactggaattgtcacttcaatctatactggatctcctgggtgtatttaaaaggtttngtttttttaagtagttgggtatttccaactnaaacctcaaaaaactttt

SEQ ID NO: 8621 - DNA, 740 bp, Homo sapiens
  misc_feature 2, 4, 6, 12, 20, 631: n = A,T,C or G
tntntncgcctntcgcgatnccgttgctgtcggagaaaccaaacaggtaaaagcaagtggtgaagccacatggattaatgagatgatagaaagtacaaaatcactatgtaagtcagattaaaaagccagcttgcactctctgctttcatctttttgaagcaataactattacataaatcagtgaatacagtatttctacagtatttgaaacggtgttcacacccagcaattccacttctagacatatatccaagagaatggaaaacatgtgcacacaggcacttgtacatgaatatttatggaagcattattcacaatagccaaaaagtggaaacagtccaaatggccatcaagatgaatgaataaataaaatgtagtgtgtgcatgcagtggaatattatttgcccataaaaagaaatgaagcactgatgcaggctgcaacatggatgaacttgaaagctttatgctacgtgaaagaagccagtcataaaaggtcacctactgttattcctttcataggaaatatccagataggcaagtccatagagacagagaggagaggagtggttgccaggggctgggcaaggagaatgagagtgaccgctatgggtgtggcatttctttgtgaggnaatgaaaatgtctgtttagatagtggtgatcattgcacactctgtgatgtctaaaatcattgattgtcacttgaagaatatttagttgtattattctagttaaaaaaat

SEQ ID NO: 8622 - DNA, 722 bp, Homo sapiens
  misc_feature 20, 29, 89, 176, 349, 383, 435, 455, 469, 500, 545, 598,621, 631, 640, 649, 672, 673, 679, 682, 712: n = A,T,C or G
gagggctatgtccatgcggncctcaaacnacgtaacatattgtggagtgcagagaatgaatgttttaaactcattgactttggacttancttcaaagaaggcaatcaggatgtaaagtatattcagacagacgggtatcgggctccagaacagaattgcaaaattgcttggcccangctggcctgcagagtgatacagaatgtacctcagctgttgatctgtggagcctaggaatcattttactggaaatgttctcaggaatgaaactgaaacatacagtcagatctcaggaatggaaggcaaacagtttctgctattatttgatcacatatttgccagtaaaagcaantggtgaatgccgcaattccagcctatcacctaanagaccttatcaaaagcatgcttcatgatgatcccaagcaggaagaatttctnctgaaatggcattggtgcancccattctttagcnattccttttgcccctcatattgaagatctgntcatgctttccactccagtggctaagactgctgaatgtgctgggntgatgattatcttgagaatgaaagaaggattatgaagatgttgttgaagatgntaaaagaagaagtggcaaaaatnttggaccagngggattctntacttggtnccaaaaggaaaaatccttggcannaagganaangtctttggttgagtattgccaaatgctggnggatttccct

SEQ ID NO: 8623 - DNA, 1163 bp, Homo sapiens
  misc_feature 4, 5, 10, 11, 12, 15, 20, 22, 23, 24, 25, 28, 29, 30, 34,35, 37, 39, 41, 43, 44, 45, 46, 47, 48, 49, 51, 52, 53,54, 55, 56, 58, 61, 64, 67, 68, 74, 78, 81, 87, 88, 89,90, 91, 92, 93, 96, 97, 100, 103, 104, 117, 119, 120, 121,122: n = A,T,C or G
  misc_feature 123, 124, 126, 131, 133, 134, 138, 139, 142, 144, 148, 150,153, 155, 158, 159, 163, 164, 165, 166, 170, 174, 176, 178,182, 183, 184, 189, 194, 196, 202, 203, 208, 213, 214, 215,216, 220, 221, 222, 223, 224, 225, 226, 230, 231, 232: n = A,T,C or G
  misc_feature 235, 242, 243, 246, 247, 248, 249, 252, 256, 257, 258, 259,260, 261, 262, 263, 264, 266, 267, 268, 269, 270, 274, 275,277, 280, 281, 292, 297, 302, 303, 305, 317, 325, 337, 356,359, 366, 367, 388, 389, 391, 392, 393, 400, 403, 413: n = A,T,C or G
  misc_feature 418, 423, 424, 430, 441, 443, 447, 450, 451, 454, 455, 459,463, 465, 466, 473, 476, 477, 479, 494, 501, 503, 509, 512,527, 537, 558, 566, 567, 573, 585, 588, 600, 601, 608, 613,614, 617, 618, 620, 621, 622, 624, 626, 629, 631, 638: n = A,T,C or G
  misc_feature 641, 645, 646, 651, 654, 657, 668, 669, 680, 681, 684, 686,687, 693, 694, 698, 710, 716, 718, 731, 737, 739, 740, 746,747, 750, 762, 763, 767, 770, 774, 777, 782, 797, 799, 802,807, 811, 812, 815, 818, 819, 820, 821, 825, 827, 829: n = A,T,C or G
  misc_feature 835, 838, 839, 840, 844, 848, 851, 854, 856, 857, 862, 863,868, 869, 870, 871, 872, 890, 903, 915, 919, 924, 926, 927,932, 933, 945, 951, 954, 956, 962, 971, 979, 982, 983, 987,992, 997, 1003, 1008, 1020, 1021, 1023, 1025, 1027: n = A,T,C or G
gggnnggggnnnggnggggnannnnggnnncaannanangngnnnnnnnannnnnnanggnaanggnngggggngggnaangaaaannnnnnngcnnaanccnnaggggggagaagnannnnnnanggggnannaaanncgncnggancnggnanggnnaaannnngaangggngngnggannncgcanaaggncnacggannggganagggnnnnggannnnnnncaannngangggaganncgnnnnaanccannnnnnnnngnnnnntcgnnanccnnaaagccccttncgggnaaagnncnggggggggggancaaggganggacggaccgcngcacagaggccaccaccanacncgacccnnaggggagggaaggggacgccnntnnnttcccangcnggaagaggancgcgncgcanngggggngggagggggananaggngcnnggnnagcncacngnnagacggngcnngngggaggacgcgaggnagacacngncgaganagncaggcgcgcagagcnaggaagcgcnccggggggggagcaggcgaanaggcagcnnaagggnccatcggagagnggncgccaggcgacnncggcgcncggcnnagnncnnngnangananagccgangancggnncccgncancgncgagcacaggnngagcgggcgannggngnngaacgnngcgnggcacgggggcncaggananggagggaccgcangaccangnnagagcnnggnggcaggggggcnngganaancacnggnaaagncccggcgggaagggnanccnccggngggnnccnccnnnnccgngngngggggngcnnnggcngggnggncgncnncgggnncgccnnnnngcacggaccgccacacgnggacgagagggcnagcgggggccgnaggngccgngnngccannaagacagagcgncgggangananggacancgggagagnaggggcgnggnncgcncacgngcggngacggnggagngagacggggagnngncnanncanagcngaaggggngcgggncganngggnnnacnccggngangagnaancnnnggggcncgnnncgcngngaaannngggagnaccgngnaggcanangancgnannnnaagaaaggngaananaccccccncc

SEQ ID NO: 8624 - DNA, 1347 bp, Homo sapiens
  misc_feature 1, 2, 3, 5, 6, 8, 10, 11, 12, 13, 14, 15, 16, 17, 18, 19,20, 24, 25, 27, 28, 29, 30, 31, 32, 33, 34, 35, 36, 37,38, 40, 41, 42, 43, 44, 45, 46, 47, 48, 49, 50, 51, 52,54, 55, 56, 57, 58, 59, 60, 61, 62, 63, 64, 65, 66, 67,70, 71: n = A,T,C or G
  misc_feature 72, 73, 74, 75, 76, 77, 78, 80, 81, 82, 83, 84, 85, 86, 87,88, 90, 91, 93, 94, 95, 98, 99, 100, 101, 102, 103, 104,105, 107, 108, 109, 110, 112, 113, 114, 115, 116, 117, 119,120, 121, 122, 123, 124, 126, 127, 128, 130, 131, 132: n = A,T,C or G
  misc_feature 135, 136, 137, 139, 141, 142, 143, 145, 146, 148, 149, 151,152, 153, 154, 155, 156, 158, 160, 163, 164, 167, 168, 169,170, 171, 173, 174, 175, 176, 177, 178, 179, 180, 181, 182,183, 184, 187, 188, 189, 191, 192, 194, 195, 196, 198: n = A,T,C or G
  misc_feature 199, 200, 203, 205, 206, 208, 210, 211, 212, 213, 214, 215,216, 217, 218, 219, 220, 221, 222, 224, 225, 226, 227, 228,229, 230, 231, 232, 233, 237, 245, 246, 271, 277, 278, 279,281, 282, 283, 284, 285, 286, 287, 288, 289, 291, 292: n = A,T,C or G
  misc_feature 293, 294, 296, 297, 304, 306, 307, 309, 310, 311, 314, 318,319, 320, 323, 324, 325, 327, 328, 329, 330, 331, 332, 334,336, 341, 342, 345, 346, 348, 349, 350, 354, 355, 356, 357,360, 361, 364, 380, 381, 382, 383, 386, 388, 390, 391: n = A,T,C or G
  misc_feature 392, 395, 397, 399, 400, 411, 412, 413, 414, 423, 424, 426,429, 430, 432, 433, 440, 445, 446, 449, 451, 452, 457, 458,460, 463, 467, 470, 472, 474, 477, 479, 480, 482, 484, 488,490, 493, 495, 497, 501, 502, 504, 506, 509, 511, 515: n = A,T,C or G
nnngnnanannnnnnnnnnnaaanngnnnnnnnnnnnngnnnnnnnnnnnnnannnnnnnnnnnnnngcnnnnnnnnnannnnnnnnnannannnggnnnnnnnncnnnncnnnnnngnnnnnngnnngnnnagnnncngnnnanngnnannnnnngngngannggnnnnngnnnnnnnnnnnncgnnngnnannnannngcnannanannnnnnnnnnnnngnnnnnnnnnntccntaatcctnnaaaaacccctttttggggaaaaaancccccnnnannnnnnnnngnnnngnnagggaancnncnnngcncgcnnnttnnntnnnnnngngngcgcnnatnnannngcgnnnnatnnccncgttttttttttttcnnnncgngnannngangnannaggaggagggnnnngtttagagnngngcnnanngagaacnttttnnacnannccganncncgnacgngcngngnaananngngngacngnacngncnaganngncnganangacncggangacagnnacncannnnggangnncngacngnncnnagnagagancgngcagggacaagcnggggcgcggannanangcgacggnnnnagcncccancanacnancgngnnnnngcagnaanngnncgagacgnnagaganaagagngacngagcnnngtcanncggcgnangnngnacnnggngnggnnaggcgcgacgcgagnangagannncgaangacganggnnnnnngcgaggnnggagacnacgnannnnnnagnnnagcgngcangaannaggnncgngannangaaggaancggcgagnannnnaccgancgannaangannganacgnngcnngncaagnanggtngnanangnnnnggganggcangcanggnnangnaanngganngnanncgnaaggcnngcngnannanngcnangcacnngnacngnnangacaaanganancgnaagggaaacggggagcggnaagcggnaacnaagcggcgngnngcacaangncnnnggcgnngcanangngacgngnncgnnacnagnnnngacgnngaangcangacnaacgngnnnggaaagggnngagnannnnanggcaacgnnnnnggnncgnnnagncanggnancggaacgngaangnanangnagggcaananacgcgnaancnangnnncgcacggcnacgcancgnnngcnnannnnngcgnccnngngaacgnangnanacgcaaanancgnnggggancgangtntcgacngngnagncagnangnagggacngannnatgganngangnacggangganngaancncagacgngcg

SEQ ID NO: 8625 - DNA, 1126 bp, Homo sapiens
  misc_feature 2, 3, 7, 10, 11, 13, 15, 17, 18, 19, 22, 25, 28, 31, 32,35, 37, 38, 39, 41, 42, 43, 44, 46, 47, 48, 49, 51, 53,54, 55, 61, 62, 64, 65, 66, 69, 71, 72, 73, 74, 75, 76,78, 79, 80, 81, 82, 83, 87, 91, 94, 95, 96, 99, 100, 101,102: n = A,T,C or G
  misc_feature 105, 106, 107, 115, 116, 117, 120, 121, 122, 127, 131, 134,135, 136, 138, 139, 142, 146, 148, 152, 155, 157, 158, 159,161, 162, 163, 165, 166, 167, 169, 170, 171, 172, 173, 174,175, 176, 177, 178, 179, 180, 181, 182, 183, 185, 188: n = A,T,C or G
  misc_feature 191, 197, 209, 212, 214, 218, 220, 222, 228, 233, 239, 243,248, 249, 250, 252, 254, 255, 266, 271, 277, 278, 280, 293,299, 302, 303, 317, 321, 326, 329, 333, 342, 346, 354, 358,365, 375, 380, 383, 385, 389, 390, 391, 407, 426, 431: n = A,T,C or G
  misc_feature 433, 436, 441, 443, 444, 451, 459, 464, 477, 480, 481, 489,511, 512, 518, 520, 522, 527, 534, 544, 554, 555, 562, 564,575, 576, 589, 590, 595, 596, 603, 604, 624, 639, 646, 647,650, 651, 656, 658, 662, 669, 670, 671, 673, 677, 680: n = A,T,C or G
  misc_feature 694, 699, 703, 709, 712, 715, 733, 738, 741, 745, 753, 758,774, 776, 782, 783, 785, 787, 788, 791, 800, 801, 803, 804,805, 806, 807, 808, 809, 810, 817, 821, 825, 827, 832, 833,834, 848, 862, 864, 865, 866, 883, 891, 896, 906, 916: n = A,T,C or G
  misc_feature 918, 922, 929, 935, 936, 941, 948, 956, 958, 960, 968, 972,973, 981, 986, 987, 993, 995, 1008, 1010, 1013, 1014, 1015,1020, 1022, 1030, 1035, 1036, 1039, 1042, 1045, 1049, 1051,1053, 1057, 1068, 1069, 1073, 1077, 1082, 1097, 1098: n = A,T,C or G
gnncgcnggnngngngnnnggnggnggnggnnggngnnngnnnngnnnngngnnnaggggnngnnnggnannnnnngnnnnnngcgngggnggnnnggnnnngannncggggggnnngtnnngggcngganggnnngnnggngggngnaggngcngnnngnnngnnngnnnnnnnnnnnnnnngnatntgntttttnggaccttggggnagncnggcngngnggggcnggagnggcgtngggnggcgnnngncnnggggggggcgnggggnactttnntnggggttttaggcngccgcnggnncgcgggggggggangcgnagggnggngggngcggtgggngggngtagccgngggngagaggnggaggcgggnagggnggngngggnnngcgagaggcaaccggntgaagacgaggcaggggantggcngnggncgcgngnngggcgcngcgccgcntgtcnggggggagggggnggnnggcagggnggcgccgggggggggcgggggnnggggangngngggangaaggcncggggggggncgagcttganngggcggngngggaatggcgnnctggggaggccgnngttgnnggagcgnncggggcgaggggggagctgngaggggggggcggangcggcgnngannggagngngggnggggggnnntncgangangggagggcggggangaggncggntagaanggnatngccgggtggggcaggggngggangangggngtcgggtnagggnggtgggggggggaggngngggggnncncnnggntggaggggnngnnnnnnnngaggggngggngacnanggggnnnaggggggagaaggnggggtagccggggnannncgcggcggcggattggncggagganagggngggagggggntggagggggngngggnggcggcnccatgnnggggngggggtngggagggncngngaggaggngggnngggggggntgcannagctangngggagatcggggngncgnnngtgangngacggganggtgnnagnganagngtgngngnggcngagcggggtgnngatngctnagcgnaggagcgcgcgtgtnnagnacggcggaaggnnggcgggggagcg

SEQ ID NO: 8626 - DNA, 989 bp, Homo sapiens
  misc_feature 2, 3, 4, 5, 6, 8, 9, 10, 11, 12, 13, 14, 15, 16, 17, 18,20, 21, 22, 23, 25, 26, 27, 28, 29, 30, 31, 32, 33, 34,35, 36, 37, 38, 39, 40, 41, 43, 44, 45, 46, 47, 52, 53,56, 57, 60, 62, 63, 64, 66, 67, 68, 69, 74, 76, 80, 81,82, 83: n = A,T,C or G
  misc_feature 84, 85, 86, 87, 89, 90, 91, 93, 94, 95, 99, 100, 101, 104,105, 106, 108, 109, 110, 111, 112, 115, 116, 117, 119, 120,121, 123, 124, 125, 126, 128, 129, 130, 131, 132, 133, 134,135, 136, 137, 138, 139, 140, 141, 142, 143, 144, 145: n = A,T,C or G
  misc_feature 146, 147, 148, 149, 150, 151, 152, 153, 154, 155, 156, 157,158, 159, 163, 164, 166, 170, 180, 185, 187, 188, 196, 198,204, 207, 211, 220, 225, 230, 234, 238, 241, 252, 271, 274,275, 277, 284, 288, 291, 292, 297, 298, 300, 307, 309: n = A,T,C or G
  misc_feature 310, 319, 321, 327, 329, 334, 340, 345, 346, 348, 351, 356,357, 360, 365, 376, 378, 379, 381, 392, 397, 401, 403, 405,406, 408, 413, 414, 421, 430, 434, 438, 439, 445, 452, 457,465, 470, 471, 473, 474, 477, 478, 485, 489, 493, 494: n = A,T,C or G
  misc_feature 496, 502, 507, 512, 515, 520, 533, 544, 549, 563, 567, 568,574, 576, 593, 596, 603, 604, 608, 611, 612, 613, 618, 624,627, 631, 632, 633, 640, 644, 645, 650, 653, 660, 669, 670,672, 674, 675, 676, 680, 684, 687, 688, 696, 699, 703: n = A,T,C or G
  misc_feature 704, 705, 712, 715, 716, 723, 725, 726, 729, 738, 741, 742,743, 747, 759, 761, 765, 766, 770, 776, 777, 788, 789, 790,791, 799, 802, 805, 806, 813, 814, 819, 820, 822, 829, 831,834, 837, 838, 853, 856, 859, 862, 863, 865, 868, 869: n = A,T,C or G
gnnnnngnnnnnnnnnnngnnnngnnnnnnnnnnnnnnnnngnnnnnggggnnggnnggngnnngnnnnggggngngggnnnnnnnngnnngnnngggnnnggnnngnnnnnggnnngnnngnnnngnnnnnnnnnnnnnnnnnnnnnnnnnnnnnnnntggnngntcgngagacccttnggggngnncccgggcngncggccnggngccngcgcgggcnggggnggggngggngcanggncaggcggggcngctgcggggtcctgccccnccnncngaggacncggnccnncgggnncngcggcgngnnccagggcgngnggggcngngaccngggccncgacnncnccngggannccngcgcnagcggcggggncnncnggcgggacagngcgcnggcngncnngnggccnngggacanagagacggngccncggnngccccngcgccgnggggnggagcccnggggnngnnccnncagaccncccngggnngngggacnggggnccccnggnggggnggggaccaaggancccggccggcncgggngggggggccagccncccnncgggcngnggcgcgggggggcccgnggncgggcgnngccnccnnngcccnggcccnggncccnnngcggggncccnngggcnggnggggggnggaagcagnngncnnnccgncgancgnngggggggncgngggnnnagggggnggnngggggcncnnccnggggggggncgnnngggnggggggggggananggcnngggnggcggnnggggcccaggnnnncgggcggnggnccnnggggccnnccccnncngaggggnanggnccnnggggggggagggggnggnggnccnngnggnncgnggngggncgggnggggccncngganacgnnggggggnnggccgggggccccngccngggnggggggnanaagcnnnngnnggggggngggggggggggccncccccncnccccngcg

SEQ ID NO: 8627 - DNA, 751 bp, Homo sapiens
  misc_feature 16, 20, 622, 660, 695, 704, 725, 751: n = A,T,C or G
ttaatcttaccccttncgantccgtgctgtcgcttgtacagtatttctactttttattctaatcaactggactgttgcattatttttatgtagattgctaacaaggtttttgaagaaacactcttaaaagtcataaaagggaaaatcttgacagttctgggatattgccacccttgaccttttggagaaatgtagacagcatctcccaggcatgacgcctagggatcgtgtttatctgtcatcagttggtgactccatgtttattgagcactggctataagccagacttggtgagggactgaaacaattacaagacacagttctgcactggaagaaataggaatcaacctaagatttcctgtcctgctaggtcatcaggttcctgtcccactactttccttcctctaccaaattcacttatagcctccaagtagtgtaactatcaatagcacccctttcactccccaaagtgtcctaatttggagagtaagttgtatgatcaccctacctacagtctgcctgttttccaatgcacactttgtctctcccctgctcttgttacatgtgtgtcctgaggccactttccagatggtcttcctctgtcattactccagcatgtcantgctttgctcaaaaactgctaactggggtcttcattgngggtaaataatccattttcttatatcatgtagccnaaagctctnttccaatttggaaatactaanagtaactcctattcatgaacaggacn

SEQ ID NO: 8628 - DNA, 708 bp, Homo sapiens
  misc_feature 1, 463, 473, 483, 613, 644, 648, 673, 678, 683, 694, 701: n = A,T,C or G
nctccaaaaatttgcttgatcttgggtcttgttcagggcagaaagagataatacaaggctttggtgatgcttagcattttagaagaagtaatgctgggtgggaaatggatttggcagtctcgtttttcgcatcattggaatgggagtccctcacagttggagacaggatgaagtaacagagcgtggggatctggattaacaggtggccattcgcagaaaggaggctgcaaagcaagaggtgggggcttctggctgagcaggaagtgggagaggggcatccttgtgaggagcacctgtagtgctggggtttgggcacaggcaggcagaggactttatctgatcatctcaaataattttgcctctgcttggaagggttctagctacaaaggcaacatagcaggtagtgcttgggtgtgatggtgataggcacagcggtattttaaatactggtggtacattttangaaaaagaangtgacgagtncctggggaaagtcccttgtggtggcccatgactcacccgtggccccaaggggaccagaaccagaaccaagggaagaattccatcaaccgaatgggaaacctttgtcttttttaagggggaccaaggaaanctttttttttgtgttgggttgggccctggtnggcnttattgaaggaagaaggtggaacanttttnaaacnaaaaaccccanggccccnttttttt

SEQ ID NO: 8629 - DNA, 1199 bp, Homo sapiens
  misc_feature 24, 27, 30, 31, 40, 46, 60, 67, 75, 80, 90, 98, 105, 114,121, 132, 134, 145, 150, 155, 156, 160, 161, 170, 175, 178,179, 180, 181, 183, 185, 190, 201, 202, 207, 210, 211, 212,213, 218, 223, 224, 233, 235, 236, 240, 242, 243, 244: n = A,T,C or G
  misc_feature 252, 259, 264, 272, 275, 277, 283, 287, 291, 296, 305, 307,312, 335, 336, 337, 341, 351, 359, 364, 366, 369, 372, 375,376, 377, 384, 393, 400, 401, 402, 406, 420, 426, 436, 440,441, 444, 448, 450, 453, 454, 467, 471, 477, 479, 482: n = A,T,C or G
  misc_feature 505, 513, 517, 520, 525, 526, 528, 529, 534, 535, 543, 549,558, 561, 579, 585, 587, 591, 596, 600, 604, 606, 608, 617,619, 622, 631, 637, 639, 643, 644, 645, 665, 671, 673, 674,681, 682, 685, 689, 691, 695, 697, 698, 700, 708, 710: n = A,T,C or G
  misc_feature 712, 715, 726, 728, 734, 741, 749, 754, 776, 786, 787, 789,800, 802, 803, 807, 813, 821, 825, 826, 828, 839, 842, 853,857, 858, 864, 865, 873, 874, 882, 887, 888, 890, 896, 898,905, 913, 922, 924, 925, 928, 943, 949, 951, 962, 970: n = A,T,C or G
  misc_feature 973, 974, 986, 990, 995, 996, 998, 1000, 1006, 1007, 1012,1015, 1020, 1021, 1023, 1037, 1045, 1047, 1061, 1063, 1065,1068, 1077, 1081, 1092, 1108, 1109, 1129, 1132, 1133, 1138,1139, 1140, 1141, 1155, 1157, 1161, 1163, 1165, 1172: n = A,T,C or G
  misc_feature 1173, 1174, 1179, 1184, 1189, 1192, 1193, 1198: n = A,T,C or G
gaatagtgtaaaaaacccccaaanttnttnnaatttccgngaaaanatttcccccggttnttgggcnttgggttnccganaaaaaaaaantttttccncccaagnttattccanccccccnctttacgagcntnggtgggttttnctttnccaannggannatgggaacnccggnagnnnngngngctantaataaattannatacnatnnnnagttntggannataatatanannaacnannnattacggnggagtanttttnttactatnaanancaaatntgtnacantactnaatattgananatgtnataaattaaatagaacaatattnnnattntaaaaggaanaaaatatnattananatnaanagnnngaagtanaataataanataattnnntatnattctatggaatanaattanaatataactnaatnnttntaananganncttacaatctctntgtntatatnanaanaatcgaaaattattacttactanatataaantatntantcatnntnnaaatnntaatatanatatcnttacaatanatnattattaataacttaaanaaacananctcntatantttnatancnanataatacananaanatttgattnataatnanatannnaattaatttataatatatanttatcnannataaaannatntatnanattntnnanaaatatangnanaantacttatatcnanaaatanttaaaanaaatatcnactantaatagaactacatttatttanatcattcatnnanttttcatagananntatnaaatcntattattnacanntnatttaatttanatntaaacttatantatnntctacnnataactannttaaaatnatatnnanttattnanataatanatatctantataaatananntanataataaatttaatnttactnantatatatattnataagctnttnntatatatagatnatangaacnnantnatattnnattanaanataannanatatgtatatatanatcttacntntttcatatataatntntnttnacatatatnaatntatctatctanttcatcaatactattnnatacaattataaacattatnctnnatttnnnnaaatatatattatnantaantntntctctannntatanataantatanaannttttnt

SEQ ID NO: 8630 - DNA, 709 bp, Homo sapiens
  misc_feature 1, 6, 9, 14, 56, 565, 613, 614, 616, 618, 620, 621, 626,635, 638, 646, 650, 658, 665, 672, 675, 681, 690, 692, 693,695, 696, 697, 698, 699, 700, 701, 702, 703, 704, 705, 706,707, 708, 709: n = A,T,C or G
naaccncgntcgantccttgctgtcgaaaagaacttaaaacgttcccacaggcccntaaaagtcttgtgagttctggcattgtggttcacacatcagatgcccaagttggccctggtccgcagcagaggagggctttgatgggacttagggtatcacaggtgtgctctggctgttgtggggaacagactgtaggcagccagtgtggaagtgcagggacctggaaggggttgactgcactggccctggaaggccctggtaagaggtggtgaggttgaaaataaggttgggggggccgggcgcggtggctcacacctgtaatcccagcactttgggaggccgaggcaggcagatcacgaggtcaggagatggagaccatcctggctaacacggtgaaaccctgactctacaaaaatacaaaaaatttagccaggcgtggtggcgagcatctgtagtcccagttactcgggaggctgaggcaggagaatggcgtgaacccggaaggcggagcttgcagtgacctgagatggcgccactgcattccacctgggcaacaaaatgagactncgtctcaaaaaaaaaaaaaggaaaaaaaaggaaaaaaaaaaaaaaaanntntntnnggccntttttttcntantccccaantttnaaaaaaanttttgtnggatttngcncacccncccctttantnntnnnnnnnnnnnnnnn

SEQ ID NO: 8631 - DNA, 746 bp, Homo sapiens
  misc_feature 1, 14, 700, 708, 735: n = A,T,C or G
naaccacgatcgantccgtgctgtcggtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtatcatacttatagtgtctgaaacataaactgtattgagctagacaaggtatagcctcctcttcaagtagcaaatactatcaaaagctataatgcagtaggagcaaggtggtccttgttccagtttttgtctcagttctgctgctgatgtaccatgatcttgggaaggtggtgtctcagtgtggagatctgacacattgttaccgtgcctcctggctggagggacttggagaacaatgcagttaagtagaatgggttttaaccaatacagagaaaatttattccattttaaaataaaaaatctggattttttaagaaccttttaaaaagcttttggtaccagtggtaaaataagaatttaaatggtattttaaacatgccttttatcaagccnccaaaatnaaagggatttttaaaaatttttgtccnaaaaaaattaa

SEQ ID NO: 8632 - DNA, 708 bp, Homo sapiens
  misc_feature 1, 634, 680, 689, 694, 707: n = A,T,C or G
naccacgatcgaattccgttgctgtcgcaatttctgagtctctttctatttaatgccaccaatttctgaggaactagagtgcagagtggattgcttttcagctttttctattaggattcagatagctttttaattgctgctaatatatttgtcattcatattgcttttttgttttcaaaattcagttaatattttttcttctcattcattttgactttgtaggttcatgccatttgtaaaaccctctttgttgtctttttattggaattttgagagggagttaaatgtctgtttttaatctaccatctttaaaccaaaattccagctatttaatttcagcatgaagaattgcattaaaaacagagcagtgaatcattttatgaataataatgctggattttatttttaaaaattatcctagcctaaaatgtttaggatcatcatagcattaagagagatttatatttggtaagaaatcaaaaacatcgtcagttttcatgcttaaagtatttaggatcataatagcattaagaaagatttatatttggtaaaaaatcaaaaacatggtcagttttctagtggaaatttttcatggcactataaatctttagtaacaagattttctatggttagnctttggatatctttttttttcttaacagtagtttataaaaaggatnaaaagctgncatanggctgggcccagng

SEQ ID NO: 8633 - DNA, 710 bp, Homo sapiens
  misc_feature 7, 12, 661, 680, 689, 707: n = A,T,C or G
tcctcgntcgantccgttgctgtcgcaatttctgagtctctttctatttaatgccaccaatttctgaggaactagagtgcagagtggattgcttttcagctttttctattaggattcagatagctttttaattgctgctaatatatttgtcattcatattgcttttttgttttcaaaattcagttaatattttttcttctcattcattttgactttgtaggttcatgccatttgtaaaaccctctttgttgtctttttattggaattttgagagggagttaaatgtctgtttttaatctaccatctttaaaccaaaattccagctatttaatttcagcatgaagaattgcattaaaaacagagcagtgaatcattttatgaataataatgctggattttatttttaaaaattatcctagcctaaaatgtttaggatcatcatagcattaagagagatttatatttggtaagaaatcaaaaacatcgtcagttttcatgcttaaagtatttaggatcataatagcattaagaaagatttatatttggtaaaaaatcaaaaacatggtcagttttctagtggaaatttttcatggcactataaatctttagtaaccaagattttctatggttaggctttggatatctttttttttcttaaacngtagtttataaaaaggatnaaaagctgncatagggctgtgcacagnggg

SEQ ID NO: 8634 - DNA, 1565 bp, Homo sapiens
  misc_feature 12, 13, 14, 16, 17, 19, 20, 25, 31, 36, 38, 41, 43, 44, 46,47, 49, 52, 64, 68, 70, 74, 75, 79, 85, 87, 94, 98, 110,111, 114, 122, 123, 126, 130, 136, 137, 160, 161, 163, 166,167, 170, 171, 173, 177, 180, 181, 182, 183, 184, 185: n = A,T,C or G
  misc_feature 186, 187, 188, 189, 190, 191, 192, 193, 194, 195, 196, 197,199, 203, 204, 212, 218, 224, 226, 232, 234, 235, 237, 239,240, 242, 255, 267, 274, 279, 280, 324, 325, 327, 328, 334,339, 343, 348, 351, 358, 361, 369, 374, 376, 379, 383: n = A,T,C or G
  misc_feature 386, 387, 388, 389, 396, 402, 403, 405, 407, 408, 412, 413,414, 418, 427, 430, 438, 440, 442, 444, 445, 447, 449, 451,458, 463, 467, 471, 475, 476, 477, 478, 493, 498, 501, 509,511, 516, 525, 526, 528, 532, 538, 539, 541, 547, 549: n = A,T,C or G
  misc_feature 569, 572, 574, 581, 584, 588, 593, 597, 601, 605, 609, 611,615, 629, 634, 635, 639, 642, 644, 655, 659, 662, 675, 682,701, 702, 703, 708, 709, 711, 720, 721, 727, 737, 739, 756,772, 774, 780, 785, 786, 789, 792, 798, 800, 820, 821: n = A,T,C or G
  misc_feature 826, 827, 830, 833, 835, 847, 852, 856, 864, 881, 884, 885,889, 902, 905, 909, 910, 917, 921, 925, 934, 937, 941, 949,959, 961, 970, 971, 978, 990, 991, 999, 1000, 1002, 1003,1009, 1012, 1014, 1022, 1026, 1029, 1034, 1039, 1042: n = A,T,C or G
  misc_feature 1043, 1045, 1046, 1048, 1055, 1057, 1063, 1070, 1071, 1073,1076, 1077, 1086, 1087, 1089, 1108, 1115, 1125, 1128, 1131,1132, 1135, 1136, 1137, 1144, 1147, 1169, 1173, 1194, 1196,1204, 1205, 1208, 1214, 1217, 1226, 1238, 1242, 1252: n = A,T,C or G
caattccataannntnnanntacanatctanatatntntgntnngnnanttnttatatattgantaantntatnnatantctttnanggtgaanactntcatgtcagctnnaanaattttannttntagngggcanntcatatattatggtatctgatannantgnnatnntncctntgnnnnnnnnnnnnnnnnnnanaccnngtatcgantccgtngctgtnantataantnncngnntnccccctcgttgangtgtaaattatnatatagnggttnncactttatattctttttttcattatattctttactcttttctannannactgtnttttntttnttaanatnaatgacntantctcctantatcnanctntaanaannnnatcatantatganntnanntaannnttanttataatanganttttattntnantnntntntnattttantatgnattncatntatnnnnctttttgatgataanccttnaanatatattntntatantacttcaanntntatnatcttnntnttatanantattatatatttgtattatnctntntaactantantttncttantaantatnattnatancncatntaatttatatttcncactnntttntancnatcatagttanattntantagtactatcatntgtaatntatttattattttgatatnnnacttnntntatagtatnntatgtntatatataantnatatactattttttatnagttacattatatatnangtaatnttatnnttnatngtaatntnctaaaatatatttcgatttnntcaannttnatntnacgttatagtanttacnatcntatgtaangatatacgagttaatanaannaaanataaaatcacaantangtanntaatagntaantatnattctatanatntatnaaaatctntatatatatntnattgactanntaatcgnatatattatctnncgctattnnannatcgtnctntnagtctttnaatnttncttanaatancanntnnanaactgtnanctgttnatatatnntntanntctatcatnntnttatctttctcgtataaanttaaatnatatttatcngtntgnntannntataaanttntattaatcataaacttatactnatcntttatactcctattgacattncntaaatatnntanttaatnatnagctacaantatctaagctanattntattgtatanatttanatagtntatttntantctgttataagtttaactattantgtatgtgtctgncacgtcatntcaattnntctaatactntatctntntnaantattatgtgtntgaagntatctttatgtatanntgtatananantnactatnatntntatangtaatatannttantcnaagnaatantgatanttctatntnctntacatnttnantatntatnttnttcttctcnccataangttcatanntttagttacnntatnagtacaatcnttaacgtatacgatcttatctctncacacgnntgatnn

SEQ ID NO: 8635 - DNA, 723 bp, Homo sapiens
  misc_feature 1, 5, 13, 544, 649, 651, 653, 667, 668, 670, 671, 673, 674,675, 676, 677, 678, 679, 680, 681, 682, 683, 684, 685, 686,687, 688, 689, 690, 691, 692, 693, 694, 695, 696, 697, 698,699, 700, 701, 702, 703, 704, 705, 706, 707, 708, 709: n = A,T,C or G
  misc_feature 710, 711, 712, 713, 714, 715, 716, 717, 718, 719, 720, 721: n = A,T,C or G
naccncgatcgantccgtgctgtcggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagccgttggacaccttcatagtgtagtgttttagtgactttttttatacgggtcttgtaaattaaaatcnttgtaatgggtgtttcaaaaatggtttgtttatgcactaattcagacaacttttcctggtacttggtcttgataaagtgaaaactgcaggggaaataaaaaaatncntntcaaaaccttaaannannannnnnnnnnnnnnnnnnnnnnnnnnnnnnnnnnnnnnnnnnnnnnnnnnct

SEQ ID NO: 8636 - DNA, 733 bp, Homo sapiens
  misc_feature 2, 8, 9, 632, 663, 677, 682, 727, 732: n = A,T,C or G
tnaccttnntcgaatccgttgctgtcgggaacactaatggccctccctggaacagacacggcgcccccccacagaatagcctcgatgccccctggaacagcctcggtgccccctggaacagcctcggtgccccctggaacagcctggtgctcctggaacagacacagcccccccagaacagacacagcaccccctggaacagcctggcgcttcctggaatggccacatccccccatcctttctgtgctgctttaggcatctgcccttacgtggttcgtgtccagctctgtcaacaaggccagctccacaagaggccccagctcagccctccccagtgggctcccctactcaggctctgggtcagcttcttcccaggaggtgtcctggcccctgtgctggccccgcctcgctgcctggacacctgtccgtgccaccctggtcactgagcaggacatccgcgtctgtggcccctgggaccctgcccccgacagccaggcctgggtttgtccttttaggtagagtgcctggtccaggtcattggaggagaagtccacatggccacctctggcgtgttctaaaaaggccctcccgcgcttgggtcaggaggccagcatcggggaacaaggaaaaangggggcttgagcttcctggttccttttcttnccttccccgaaggncaaanaaacatttcccattccgaatgtccaatggcgcttaccagaattcnttccnt

SEQ ID NO: 8637 - DNA, 708 bp, Homo sapiens
  misc_feature 1, 13, 19, 586, 675, 704: n = A,T,C or G
naccacgatcgantccgtngctgtcggcctgggaagatatatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagcagtaaaaaggtgattgttgagggcagcaagaggcggtgtaacataccagttcatttttcttttcttagcaagcatgtactaattgccttttaaaactcctgaccataggggataaaacgattacaagaaagataccttccctgctcccatggaatttacattctagcacaacagtggatattaaacaacgtatcatctggttatgtaattacagtaataagaatcatgtaggagaggtcaaggaagcttactgctgtggggttcaggatggcatctncgaaagtatgaataaggaaagtggtgggagaataaaaggagagtggcagagactcaaactgagagattaattgagataatgacaattgngggattcaatgaggtgttaatgtgttagncctg

SEQ ID NO: 8638 - DNA, 718 bp, Homo sapiens
  misc_feature 2, 6, 7, 9, 620, 628, 630, 635, 638, 642, 667, 675, 694,698, 703, 706, 707, 709, 718: n = A,T,C or G
tnaccnntnttcgaattccgttgctgtcgtggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactatttttgaagaataaatgcncacttttntnttttnaanattnttggaaattgagacttttggggccntttttttngggggaatttctaacctgntaanaaacnttnnanaattttgan

SEQ ID NO: 8639 - DNA, 889 bp, Homo sapiens
  misc_feature 2, 3, 7, 8, 9, 11, 12, 15, 16, 17, 18, 21, 23, 25, 28, 29,30, 33, 34, 35, 36, 38, 39, 41, 43, 44, 47, 48, 49, 50,52, 55, 56, 59, 60, 63, 65, 68, 71, 72, 76, 77, 78, 84,89, 90, 92, 94, 96, 102, 103, 107, 114, 115, 117, 120, 122: n = A,T,C or G
  misc_feature 127, 130, 132, 135, 139, 144, 148, 150, 158, 159, 160, 161,162, 163, 165, 168, 170, 173, 174, 175, 176, 177, 178, 179,180, 181, 182, 192, 193, 194, 201, 207, 208, 215, 217, 221,302, 371, 382, 417, 422, 427, 450, 486, 499, 503, 514: n = A,T,C or G
  misc_feature 527, 536, 548, 572, 584, 610, 624, 656, 672, 680, 683, 690,698, 699, 712, 713, 724, 727, 738, 740, 742, 746, 755, 757,760, 761, 764, 769, 772, 783, 786, 790, 795, 796, 810, 814,818, 827, 833, 837, 842, 843, 845, 854, 855, 860, 862: n = A,T,C or G
  misc_feature 874, 879, 880, 885, 889: n = A,T,C or G
annattnnntnnaannnntanananttnnnttnnnnanntntnntannnntnttnnttnntananatnttnntttnnngggganagtanntntntntctatnntctntactatnntntantnctggnggngnttnttgnagatntatntnctatcttnnnnnntnatnantannnnnnnnnngaataaaccnnntatcgantccgtnngctgtcngntggnctgaccaccccactcatccccgttaacattctctctaaagagcctcgttcatttccaaagcagttaaggaatgggaaccanagtgttttaggacctgaagaatctttatgactctctctctttcactctttttttttttgccactaagtnaaaagcgaagngagagtattaacgtttttgttctcctccggccccntgttncaatnaaggggcaaaagtatttgctctnagtctattcctcccttaacttctgtgactaattttnatttcctttctanattngcccaattaanactagggtgcagngtatcctgnataggtagggtnagtgggggaggaatcccttggggnagatattaggantgctctgttgtttacaaactcaggtncccgcagggcctancaaagagacttaaatgactgataaaaaacccntgaaaaacatgtttgnttccaggnttnatttcantttttccnnttttttttttttnnaaaaaaaaatntcnttttgtcaccngntngaangcattgggncnatnntcnctttnttntaacctccctnttngggntaaannaatttcttttgccnatcncccnaaatcttanataaangccnttccnncncccctgttnnttttntntttaaaaaaaantgggnntcccntttn

SEQ ID NO: 8640 - DNA, 746 bp, Homo sapiens
  misc_feature 13, 26, 28, 29, 30, 35, 40, 50, 52, 65, 349, 396, 500, 527,537, 545, 585, 591, 596, 618, 619, 627, 630, 645, 654, 679,681, 690, 697, 711, 720, 725, 733: n = A,T,C or G
gaccacgatcgantccgtggctgtcntnnnaccgnccccncccacctgcntncagctgcctcttncacctgggccctgctctcagatggaagtgtcaccaaacacccagatcgtcgtgctcctgcttctctggagtggacacaacctgaaaaccaactggactgagcatccttctcctaaaatctcagccagaagccacgatggagggtcctgggaagggaagagatgtgaagatttctgtgattctaaaaccttgggtctgcctgcaaacttctctctgatcccagccgagagctgtgcacacgctagctagccctgtcacacaatagcccagtgttcccgtcacaantgcctgggaatgagaggcttttgagccacagagctatgacaagtccncaggttgaattgactctgggaggacaaatttctgagagactcacgggacccttatccaggacaacctcacaaaagatcccttgaaactgagctttctctgcttncgtgcataatttgaggtataaactttncttgtgtctncggtcaanatgaagtgaaaggatgaatattatccccaaggctaaaagntaacgnaaaangtccaataagccatccgatgannagaatatnttnttttggaaagaaagncttgtgaancatttttccattcaaacccctggtnangttttcccnaaagaanttttttccccgaanaatattgtngtttnggcccatnaaaaacactggat

SEQ ID NO: 8641 - DNA, 716 bp, Homo sapiens
  misc_feature 1, 5, 6, 7, 8, 27, 42, 70, 658, 667, 671, 674, 679, 709, 716: n = A,T,C or G
naccnnnntcgaacccgtggctgtcangctgaaaggcctacncattaaaaactaacactgcctcccctgnagggagatagtcctttcattttagctccttgcattgaaatagcattgaggattaaatttgtgtaagccccacaaaattcaaaatttatgtgcttttctgaccacttgccttctagtggaaattttaagcatattagaggatatgtttctgtgggagctgatcagaatggtactaggagtacaaaagaatatctaaaactaaaacacagctatatttcagatcatactgcttcatcacatcgagtgcatctacaaaggtaataaatagtatgtggctgagttagggcttgggaccattttctagaagatttgccctttctgcaattctagtctctataatgattggagtgtaggagttaagttgtggagcgtctcataaatttaactagaatcatcccctcttaaaatctaaatcaaatattgacatattagtcggccattatttgattacatttttattggtttaagcagtgagagatgttttgtgcagaatctggttgttttcacccctaaagtaaggcattgcattatttctaaataatcctataaagcccctaaattaaaaaaatttaaaaccaacccacttttntaaatgaanggcnctnctagntttctatggggccagcctctcattcccggnaatttcn

SEQ ID NO: 8642 - DNA, 717 bp, Homo sapiens
  misc_feature 2, 6, 9, 14, 30, 647, 692: n = A,T,C or G
tnaccncgntcgantccgtgctgtcgctgnctatcagtgtaccggatatttatgtaaactatgactgtgacttaaatgctgccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaaagaagtcttgtntgcattttgtgggaccaaccatgactttttcaggaaaagacttcntttcagcccttcgtatgtttctaga

SEQ ID NO: 8643 - DNA, 680 bp, Homo sapiens
  misc_feature 19, 21, 23, 27, 30, 192, 207, 223, 350, 394, 467, 487, 498,523, 555, 606, 668: n = A,T,C or G
atttcattgccctctttanananttgnttncaaatgtcgagcatctttatttatccaaatctctccacagtgtttgtttaaaggggagcgctggagagtaaactaaatcttacaatgagcatatggatggctataattgctgaggtttgtttttttttttcatatttgctaactcgctatatataaaattgngtttctattttatanatttcacaccctgaanactgctaatttttgcatgcatatgattttcacatgaatggatgaaaatactaaaatctcttccccctggaattgtctaattgccccgaccctactctaacagcagctagtgggtgggggcggtgganactcctgccattctctgtggcaccccacttccctggaagctcantcggcctccgtctgctcacgtattggcacggttgtcttccaaacccattgatgccggaacatgggtcaggaanaacacagtcagctctctggngctttccatancgttcctttttgccaggcttctganatttttaaataacggaagcaacatctgccctntgaattaactgacaatggggaaacacacattgcaaaaattatcttaatgtntagcaaatcaagggaaaacaaactttgcttaaccattggtttcagctttctatccaccaaanccccaacttttt

SEQ ID NO: 8644 - DNA, 721 bp, Homo sapiens
  misc_feature 9, 28, 32, 531, 553, 576, 586, 611, 642, 650, 660, 666, 692,696, 704, 707, 720: n = A,T,C or G
tgaccattnttcgaattccgtgctgtcnaatntgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaagccatctggctgctgtgcacangcgctcgtgaggcttgctttcngaacattaagaccattgcttgantgcctggcanatgaacctcatcaatgcttgccaanggctcctcgaactcctatgccattaaaaaanaaaggacnagcttggaancgtttnggccaaattccaacccgttgattttnccanctggttgnccnaataaaacttttnt

SEQ ID NO: 8645 - DNA, 703 bp, Homo sapiens
  misc_feature 14, 54, 611, 637, 670, 678, 684, 694, 696, 702: n = A,T,C or G
taaccacgatcgantccgtgctgtcggtttggtcttaggctaaaatccatgttntacggagaattcaagaaatttttaaacttcaggtagaactgtgttttttacaaatgtatagaaagcatagtgcctaatgcatggtagaaacatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgggatcgaagtgacaaagtgtgttttcattcacagtggaggctacatcaagcaaggggaggnccaccctcttgcaagtgtggtgagangctctctacaaagacatgggcaccggagtaggnccctgtancatgcnggtgctgtananaaaatnt

SEQ ID NO: 8646 - DNA, 1063 bp, Homo sapiens
  misc_feature 5, 9, 10, 15, 17, 20, 25, 27, 29, 30, 34, 36, 37, 39, 40,41, 46, 57, 59, 62, 70, 72, 77, 78, 86, 92, 93, 97, 99,103, 107, 110, 112, 113, 115, 119, 122, 134, 135, 137, 142,143, 144, 146, 148, 149, 151, 152, 153, 154, 156, 165, 172: n = A,T,C or G
  misc_feature 184, 185, 189, 200, 239, 258, 266, 271, 280, 287, 290, 304,339, 340, 343, 356, 367, 368, 370, 373, 374, 376, 378, 399,408, 424, 427, 430, 431, 432, 443, 444, 447, 451, 452, 460,462, 465, 468, 473, 476, 480, 484, 485, 486, 488, 494: n = A,T,C or G
  misc_feature 496, 501, 509, 523, 541, 545, 552, 557, 560, 565, 566, 568,571, 580, 593, 594, 601, 604, 606, 608, 617, 619, 620, 626,629, 631, 632, 648, 649, 651, 652, 656, 658, 662, 665, 670,671, 673, 681, 685, 687, 688, 694, 695, 696, 701, 709: n = A,T,C or G
  misc_feature 710, 717, 718, 720, 721, 722, 724, 727, 738, 742, 744, 745,748, 749, 750, 754, 755, 759, 760, 763, 767, 773, 777, 779,781, 784, 792, 795, 796, 798, 803, 804, 805, 808, 809, 810,812, 814, 818, 823, 825, 830, 831, 832, 834, 836, 839: n = A,T,C or G
  misc_feature 843, 844, 855, 857, 860, 861, 864, 869, 870, 873, 876, 877,878, 884, 889, 901, 903, 905, 912, 914, 917, 919, 929, 931,935, 939, 940, 946, 963, 976, 981, 984, 989, 990, 992, 996,999, 1005, 1008, 1010, 1011, 1014, 1018, 1022, 1029: n = A,T,C or G
  misc_feature 1034, 1043, 1046, 1048, 1050, 1059, 1061: n = A,T,C or G
ctccntttnnacgtntnacntagtnananntgtngnntnnngttanattgttaggtntntcntgctctcncnagatnnctattacnatatanngttntntatntacnggnanntnctanacnttctatctcttnnanacttnnntntnncnnnnanaagaaccangatcgantccgggctgtcnntctncgcagtgtacnccctgccttggatcccctcccctcaaggagttcatctcngcgggagggagggagacangatagganagggnacttttaantggtctntancccttagcgagggngtgttgaggtcatgcatgggaggaggctgtcttgnngcngaaccgggttcanggaggctcatnngnganngntnccctcctaggcactggagttntggcttganttgtgaggggtagccnaanggnnnggctacaatgnncgngggnnggagagtntnctnttntcggnggnaacnagannntnacgccncncatgnagggggtnttcatgtctttcangttccagggaatattatncatnggttaanacggnggnttgcnngntgnaatcgaatntactcttgctccnntgttttnacntntntttcgagantnngggaantgnanntctcattgcctggggnntnnactncntggntantgganntntcaatcangcangnngctttnnnttggngatggggnncttcttnngnnngnttngactctgatantaancnnggnnntcgnnctgnnttnctgnattacntacncnantgngttggatntgnnanctaannntcnnnantnatgnaaccncnacttnnntntntcnccgnnaaatggaacantncanntgnttgtnncanctnnngtaggnagctngattatagtatncntnttgtgcnanttntnacctttgggntntggnactnntcttcncgattccttatccacanaggggactcccantggtnaanataannanacgnggnagcttnggngnntancatngggngtttttnctctntcaagtacnaantntnacacctctntncg

SEQ ID NO: 8647 - DNA, 715 bp, Homo sapiens
  misc_feature 5, 28, 578, 626, 704, 715: n = A,T,C or G
gaccncgatcgaattccgtgctgtcggnttagcactcacatatttttgttcaatctttacttctcacacaaacagaaaaaggaaattatatattctgtatcaacaaagatttaacaaaacatccatacactacaactgtctacttactaaaattaagaattagtatattatcttttttcttcttatattaaaactatcttttcatacactattttaagtttatgaactgaaagtcttttagagataatttacttcaatgaactattattatttatattttataagcaaattgtcacaacttggtattagctagctctactgttcgcttacagtctctaaagtttctgaaagcatccatgatttctgccacaaagaagatacttaggaacgattctgttttcctactctgtgacctaaaattgactggttcttcaatggaaatgagatccatatcgggcactaagggtatacagaaataattgtgggcaaaagtactaaagctatttttgttgcactatattttgagatctctttaaggctctgtgttcttactgatttattccaatttaatgtattgnactattggcatcctactttttctttttaaatatattattattgactgnttacaagactttgtgttaaactgacaggaaagtttttataaaccaataacagcactcacattttggaaagactgggtnccattggtctn

SEQ ID NO: 8648 - DNA, 713 bp, Homo sapiens
  misc_feature 12, 25, 26, 47, 705, 713: n = A,T,C or G
tgccttatcgantccgtgctgtcgnnctgacgtgaaatgtaaactantaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtacccaattttagatctattttctttatactttttctaatcaattgcttaatagtactttggatgattatcacctttgccactttaaaatatataaatatcctttttacttcatgaggaaggaagaatttttggntaatactn

SEQ ID NO: 8649 - DNA, 1506 bp, Homo sapiens
  misc_feature 3, 12, 17, 26, 28, 29, 30, 33, 43, 44, 46, 49, 53, 57, 58,65, 70, 75, 77, 81, 82, 83, 84, 92, 94, 98, 106, 107, 109,110, 111, 112, 113, 121, 128, 130, 136, 142, 143, 149, 150,151, 159, 160, 161, 171, 172, 176, 179, 180, 183, 186: n = A,T,C or G
  misc_feature 193, 196, 197, 199, 201, 205, 210, 216, 220, 221, 222, 225,227, 228, 230, 235, 243, 244, 248, 257, 262, 264, 272, 275,282, 286, 287, 288, 293, 297, 299, 305, 307, 312, 317, 318,319, 321, 324, 334, 340, 342, 344, 346, 348, 354, 375: n = A,T,C or G
  misc_feature 387, 389, 390, 398, 413, 434, 441, 449, 451, 456, 469, 473,476, 477, 480, 481, 488, 495, 498, 502, 505, 510, 520, 529,535, 537, 538, 539, 551, 560, 561, 562, 567, 569, 571, 573,575, 578, 583, 591, 600, 601, 602, 606, 615, 626, 628: n = A,T,C or G
  misc_feature 635, 642, 648, 650, 651, 661, 662, 663, 666, 672, 673, 675,678, 684, 692, 699, 704, 706, 708, 714, 722, 725, 726, 730,737, 744, 746, 754, 758, 762, 765, 767, 772, 774, 775, 778,782, 792, 796, 797, 799, 806, 818, 819, 825, 827, 830: n = A,T,C or G
  misc_feature 832, 839, 844, 854, 858, 860, 864, 867, 872, 892, 896, 899,902, 903, 904, 919, 926, 940, 942, 956, 959, 964, 967, 970,974, 976, 979, 990, 993, 994, 1011, 1017, 1023, 1027, 1029,1030, 1031, 1034, 1038, 1043, 1047, 1056, 1060, 1063: n = A,T,C or G
  misc_feature 1064, 1067, 1068, 1069, 1074, 1076, 1082, 1084, 1086, 1089,1093, 1096, 1098, 1099, 1102, 1104, 1107, 1108, 1109, 1110,1118, 1121, 1122, 1130, 1143, 1147, 1148, 1158, 1163, 1166,1182, 1183, 1185, 1188, 1199, 1200, 1203, 1205, 1210: n = A,T,C or G
ccncccctcacnctgtnctcaccccnannnggncttgttctanngntgntgantttnnagctttntattnaggantncttnnnntaattctntntctngagtgganntnnnnnacggtacntcaaaancntgggtnaattcnnccttannncccccatnnnggttttcttnntttnatnnctnatnattctantcnntntnctancaatnttcctnatannntcntnngnctctnttttaatnnatanacttacctnactcnanttctctanctngtatatntatnnngaggnatcngntacggntnactanagctnnnanatnactggtaccncctacncntncncngctatntaacgtaatgacctcttaccntactataccatntnnctcttatnaaaacgtataatatnctaacgctatatatggctacngcaacgnacacgcancntatcnctaagctgaactnactntgnntanncgcgtantgtaatngtnagtntangtcanatattaggtnatgcctcgngtattnannnttaatcaattcnattctatannntctgntnantntnctnatatnttatcccnatcatattnnntatnttatcaaanttcatgtgtcntntctactnaacttangtatantnnatgcgacgcnnngtntatcanngncantttctnttaacttngcatatnctctnantntaatgntgtatgcnacnntatntattctnacgaacntnatataatnttcntaanttntnatcantnnatntatngtactacatngtcnntngtcaacncgtatatctctnntttagnanatntnctatatncaatntgaatgctgnttancnctcnctntagcnaaaaaacgctactatatcancgtntcntannnttaccttcgttctcnacgtatntacgatacgtaatntnactaccttagctancancgtcncgntgntacncnaanctaatctctanatnntctgcatgttctgcatntagacnatcacntacntnnntanattntacgntaantatctcatnctcnttnnatnnnaacgngncagctntntnacnttcnacncnngtntntannnnacattatnttnnatctcagnaaaatctattacnttcnntctatacttngtatntantatatctcatcttagnngntanatgaattatcnngtncnctatnaannacacanactantntanntanangaccgtannnacntnnnattcngtacatatnantattntntnttatngatntntnnctcaantgggatanatactacntnttgtatctnncgcatntatnctangntgaatacnntatntnnatacctngaangtacgcncacnanctaatntanctatgcgancnanatnncgctacgttntntcactctagccnantaatantncgtanatatctacntgatnaantantgcncttaacntacntannntgacangaacnnatntncg

SEQ ID NO: 8650 - DNA, 707 bp, Homo sapiens
  misc_feature 12, 597, 645, 669: n = A,T,C or G
gccacgatcgantccgtgctgtcgcactgaatgacttaaggctcgacaaatgatattcttggaaagtttaatcttgaggttttcaaatctttttttttaatgtctcccatgtttctcatttgctgattgattcattagttgctcttagtaagatttgtcagttggaaataatgaaggctgagactcatttctaaactcttccataaccatcaccagaagagcagccactgtgttgtgtgatgtaggctaatgcctcccagatagaggtaaagtcacaaggactattagaattccagtggattgtggaactggttttggattatccttatattttcattctgattactgaggcagttctgaaaactcctaccattgaaatagtggtgtgtcttttccttgtttaaggattttacatcatttttatgcacttgaattccaaaatcagaatctctcttttacctatcaacctttattggctattggcttttggcaatgacctttctgttcaaatgtagtcctgtctctttgtttccttagggagtagaacctgcctttttctcatctttcatttttttgacgtgtcctttctaagaaaangctctctgccgctgttctgggtgataaatgatattttcatctaatcgntatgtgggttgggatgatcatggngaaaaactaggaagacatctctggtggatggacttttt

SEQ ID NO: 8651 - DNA, 1192 bp, Homo sapiens
  misc_feature 3, 4, 5, 7, 8, 9, 10, 12, 15, 17, 18, 23, 25, 26, 32, 36,38, 40, 45, 53, 54, 60, 61, 62, 63, 65, 67, 75, 76, 81,84, 85, 87, 88, 91, 92, 93, 96, 99, 106, 115, 117, 118,119, 120, 121, 122, 123, 124, 126, 129, 137, 150, 151, 153,163: n = A,T,C or G
  misc_feature 167, 173, 176, 183, 205, 230, 247, 252, 254, 257, 259, 260,267, 268, 270, 273, 275, 282, 287, 288, 299, 303, 304, 307,318, 319, 323, 341, 342, 344, 352, 357, 358, 359, 363, 365,366, 372, 375, 376, 377, 382, 399, 401, 404, 406, 412: n = A,T,C or G
  misc_feature 418, 421, 425, 430, 432, 433, 437, 447, 451, 459, 466, 476,479, 482, 483, 488, 489, 492, 497, 498, 506, 508, 510, 514,517, 527, 531, 535, 536, 542, 545, 552, 557, 558, 565, 571,578, 584, 595, 600, 602, 605, 609, 612, 624, 626, 638: n = A,T,C or G
  misc_feature 639, 641, 651, 655, 656, 658, 665, 668, 672, 673, 675, 677,678, 679, 682, 683, 686, 687, 694, 710, 718, 722, 724, 729,735, 736, 737, 740, 741, 746, 751, 752, 753, 755, 757, 762,764, 774, 779, 781, 788, 795, 798, 799, 801, 805, 806: n = A,T,C or G
  misc_feature 813, 814, 816, 817, 819, 822, 826, 831, 834, 840, 841, 842,845, 846, 853, 857, 858, 859, 860, 866, 867, 868, 869, 871,873, 882, 894, 898, 901, 902, 906, 909, 915, 916, 919, 920,921, 925, 926, 932, 946, 947, 949, 951, 952, 954, 960: n = A,T,C or G
  misc_feature 964, 965, 966, 968, 969, 972, 974, 978, 980, 982, 984, 985,986, 989, 991, 996, 997, 1000, 1006, 1012, 1014, 1016, 1019,1021, 1030, 1031, 1033, 1037, 1039, 1041, 1043, 1044, 1050,1052, 1061, 1063, 1067, 1069, 1072, 1077, 1081, 1087: n = A,T,C or G
tcnnncnnnncnagnannaatangnntttatngtantnantatangtagtgtnnaggtgnnnnananagtgatanngttcnagnntnncannngtntgncatgatnatatatagntnnnnnnnngnagncatgatcnaatccgggctgtnntntgcctgtggncccnatgggncanacactgngcccgcccacagaatagcctcnatgccccctggaacagcctcggtgngggcctgttcagtctcngtgcncnctnanncatcctnnantancntttgaanagagnnatttagagtanaaannaantttgtcacttnntttntcattaaaaattactatnngnaaccttangaagnnnatgncnnatcaangcnnntgtcnagctatgaagaattatntntangnggaaanaacatnaantttnacatncnnagtnattcccaatngaanccctaaanaacatgnaatttggtanggnttnnctacnntantgtcnnatggaacncnanactnaanaaaaggtatntttnaatnnctcctnggnggtatcngggannctaaacnttgggngcgcgcntatganaatatagagcntatcntnatngaanacntatgaatgtatncntctgcttatgtnnantcgtattatnactnngnatattanatnaatnntncnnnttnntanntagatcntatgagtcaaacttgntattaagntatnantactnatatannnganncatcnagaannncntncacananaatattcacncgtgncnctatatnatccgangannantaanntaagttnnanncnatntaantcaangtntaattnnnttnnatatttnggtnnnngatttnnnnantngtatgtganttattattacangacngannaatnctntattgnnttnnngaanntttatnaataatatatctannantnntnttatancatnnntnngtntncatntntntnnngtnanagcgnnggnttcatntaagcnantnttntntccaacgannangagntncnannttattnantatacattntntagntnctnacttntaanatctcnnaattgatnangtanatgatnntattntaaatctntnattnntcananttntactctattananncancctannntnatnnantncatntacatcnncngatacg

SEQ ID NO: 8652 - DNA, 710 bp, Homo sapiens
  misc_feature 1, 8, 13, 656, 696: n = A,T,C or G
nacctcgntcgantcttgctgtcgcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaaactgcgtgaggcctttgaaaatgatatgctggctgttaacgtaaagtccctaatgctttcttctncgctgggtttcactaggctaaaaatcttgccattcagctnatgaggaatgcctt

SEQ ID NO: 8653 - DNA, 721 bp, Homo sapiens
  misc_feature 5, 6, 8, 13, 648, 659, 694, 707, 709: n = A,T,C or G
taccnngntcgantccgtgctgtcggaaaatattagctactcaaataagtaggcttctgaaatagttttaactgcaagtgtgttaacttgtgtggtggtttgaagccatttttccaaataaagttattaaacaccactttatgtactgaagcatgaacagaaaaatcaagagctgagcagaccacctcctttatgtaggcaaaacttccatcattttggcttttgttctaaacagaactaaatgacatgcatagcatggtaacttacagatcgcttaattggagtaaaactcagagtaatagagggaaatatgggctcttcagtgcctttttagcttttttgagttgaagacgttcctacagatgtagtttaaacattacaaagtaggcttctttatccaaaaatcccaatgtgtcatagtacacagatagtttaaaatatgtagcccggggaaggggaggcatgtaaatgtcttgaagaggagaaaaagtatgaaagaagatcgatagttaccaataatgtgtatgatgaggacatactttaaaaatgtaattcctctgtacagtaaattaccaaatctttagggatttttttgtaataagaagaatttatatttgtaatgggtctaaagaattttttttgtaatgngggattataanaattttaatttgggaaccactttataaacctggtnaagaaaaaaattntngccttctggaat

SEQ ID NO: 8654 - DNA, 736 bp, Homo sapiens
  misc_feature 3, 10, 15, 683, 699, 701, 715: n = A,T,C or G
tgnacctcgntcgantccgtgctgtcgggactacaggtgcccgccaccacacccggctaatctttgtattacaggatagagttcttggaagcctggcgtggagggagggagagcaggtagcacagttacagaaggatcttcgggatatggaaatgcggtatttgtggacactcattcatctaacacacatttgttgagctcctaatgtgtatagaactgaagggatggagtcatgggcagtggaaaagctgaaattgtgtaaaagagagagaaggatcagtggctatggtctcgaagatgacgtggaagtgtcagccatgacgggtggggagtggcctgctgctcctcctgggaagagaagaaggtgaagactcagggcgcgtctgcagggagacagtgggagctgtggggtcgtggatgacgctgatcctgtcattagcatctgagcgaggtcacaggcatgtggggcctcgttaacaatgcccggcatctcaacgttcggggaggtggagttcaccaacctggagacctacaagcaggtggcagaagtgaacctttggggcacagtgccggattgaccaaaatcctttcttcccctcattccgaaagggccaaaagcccgcgtcgtcaaatattcaaccaaccattgcttggggcccccattgggccaaccccgggcccgntttccccgttacttgnantcaaccaaatttcnggggttaaaaggcttttcttt

SEQ ID NO: 8655 - DNA, 1347 bp, Homo sapiens
  misc_feature 4, 6, 8, 11, 17, 18, 20, 27, 30, 31, 34, 35, 37, 46, 60,66, 67, 68, 84, 89, 90, 91, 96, 101, 102, 113, 114, 115,116, 117, 118, 119, 120, 121, 122, 123, 133, 137, 139, 143,147, 150, 158, 161, 177, 183, 191, 199, 200, 202, 210, 218: n = A,T,C or G
  misc_feature 219, 221, 228, 234, 236, 240, 248, 249, 255, 257, 261, 264,271, 272, 281, 283, 285, 288, 304, 306, 308, 309, 314, 325,326, 329, 330, 332, 339, 342, 343, 345, 348, 353, 355, 356,360, 377, 379, 394, 396, 398, 399, 403, 404, 405, 415: n = A,T,C or G
  misc_feature 418, 419, 423, 433, 434, 436, 447, 450, 454, 455, 461, 468,473, 475, 477, 483, 486, 489, 491, 492, 493, 494, 497, 500,505, 508, 509, 510, 515, 517, 520, 523, 536, 537, 541, 548,561, 562, 564, 573, 576, 577, 584, 590, 591, 594, 596: n = A,T,C or G
  misc_feature 597, 598, 600, 603, 606, 611, 619, 621, 628, 630, 631, 633,638, 639, 641, 645, 647, 655, 656, 667, 675, 693, 695, 704,705, 707, 720, 725, 727, 749, 757, 759, 760, 769, 773, 782,786, 799, 810, 811, 812, 820, 822, 827, 833, 839, 843: n = A,T,C or G
  misc_feature 844, 846, 847, 856, 863, 864, 867, 882, 885, 888, 891, 893,894, 895, 905, 908, 910, 918, 926, 927, 928, 933, 934, 951,958, 960, 965, 966, 967, 982, 984, 988, 1004, 1015, 1016,1017, 1020, 1022, 1023, 1039, 1045, 1046, 1048, 1051: n = A,T,C or G
  misc_feature 1060, 1061, 1063, 1073, 1080, 1089, 1094, 1097, 1111, 1113,1125, 1126, 1128, 1135, 1159, 1161, 1164, 1170, 1188, 1203,1205, 1207, 1210, 1216, 1221, 1226, 1234, 1239, 1240, 1244,1248, 1253, 1256, 1257, 1260, 1262, 1267, 1268, 1272: n = A,T,C or G
cctngncnaantctaannanatttggnagnntgnngnaatttatgnaattggcagattangattannntttttccatttggggnatttnnngggtnttttnnttagcaatatnnnnnnnnnnntaataacacnatcnantcgngtgnttnttagccancangccccccgttgagccnttgtantttaaganatggtccnncnttttattntggaagtnntnccacacntttggntntttntgcaattnnttattntnatantantatatanntcttttttngntnttngagcatctttttacananannctctnctattaatctnnttnnanattattntannanttnaatanannatanttatgattactgtcgantnaatacacctttgtcncntnncttnnnaagctatctntcnnacantgaacactanntnctagtactaanacnttanntcagtntcttttntactngntnatagtnctngantnnnntcnacnagtanatnnnttagncntancantagatctaatganntatnttcgatnttactaggcctanncntatgatgtnttnnactaacnactttnntangnnntnatntangcttntgtaagtncntatctantnncncatanntntatntnattgaaannaatcttatctnatgaaaantatcttatgctattcctngntaacgtgtnngnaatgtatgcgtcnctatnanataggggattttatactatgtnacataatntnntagtactgntatntatataaangtanatctaacgctgtnatattcatacnnntatctatntngtcgngtagcntagcgnaaannanncgtactaanaattcgnngtntacatatatcgtatntantgnttntnnngaaacatatncgnancttaatgnacttcatnnntacgnnatgttgtctgatccttngcgcacngntacgnnnaaatcgattactaantntatnctatagtaaatgtatngtatctatatnnnatnannatctctacacgtaagngtaaanntnacnttactatgnntnttatattacnaaatctnatgcattcntaaancgnctcgtatgggtacntnaagcgatatgtnntngtatatntacgcaaacatagtatatattatncnatntttttnataacattatcatatatnatatatatttaaatncnanatnattatnataanatgtnaatgatanaatanngcanatgnaagancgnnaangnaaagnnagtnntcnctacttatnttcnngntggtatgttatagctanntatatacggcanctangnannanngaanncntgtacg

SEQ ID NO: 8656 - DNA, 759 bp, Homo sapiens
  misc_feature 5, 8, 27, 30, 32, 43, 50, 60, 61, 67, 74, 76, 82, 86, 90,91, 94, 95, 96, 103, 106, 107, 108, 111, 122, 187, 547,548, 586, 597, 602, 620, 632, 635, 642, 644, 653, 663, 674,680, 688, 694, 703, 705, 745, 758: n = A,T,C or G
aaccncgntcgaattccgtgctgtcgntananatgacatcacncgtgtangggtgaagcnnggaganctactcngntatgantaangttnnaannngaaatgngannnaantggaatttgcnaaagtgcctgccctataatgttagaactggaccagaaaataggagttggtataaaactagaccancgagctttttttccttcaagatgcagttcagtttattgcttttgtaaattagagattgtgtttcttgatctttattaaagtagaatacaatgttaacctacttcaaattttaaaaaatatacacacatgtatatgtatgtgtgtgtgtatatacacacaggattttaaggacagttttttgtgtgtgtgttgtgcatgcgcacgcatgccaaggaaattgttaatcttctagtacatcccccataacagaggcagctaccaataagatctagtctttgccttacagaccaggtggctttacctgataggctcacagacattcagtagttcatttgttcctcagatttctttaattattgnngataaagttgatatttaaatttaccaactttaaccatnttttaaatggnattantttatttggccatttaangtggtaatttcncantttgttngnggccagccnttcattggancaatcccatcntcttanggaggttntttccnttccttccntnaaattgggaaatcttttggtgcccccaaaaaacaaattancctaccccctttnt

SEQ ID NO: 8657 - DNA, 1097 bp, Homo sapiens
  misc_feature 13, 14, 17, 34, 37, 48, 50, 54, 84, 99, 107, 109, 113, 116,119, 122, 125, 126, 128, 134, 142, 149, 165, 174, 187, 188,193, 202, 203, 204, 206, 208, 218, 228, 240, 248, 250, 252,257, 258, 262, 263, 274, 277, 287, 289, 291, 294, 295: n = A,T,C or G
  misc_feature 296, 300, 301, 304, 305, 310, 311, 315, 329, 338, 344, 345,347, 353, 354, 366, 380, 382, 385, 389, 391, 395, 403, 406,407, 412, 416, 421, 423, 427, 429, 431, 432, 434, 435, 441,443, 448, 449, 454, 461, 463, 467, 468, 469, 476, 479: n = A,T,C or G
  misc_feature 489, 490, 493, 495, 497, 499, 501, 503, 505, 506, 508, 509,516, 521, 523, 525, 526, 527, 531, 532, 536, 539, 540, 541,543, 547, 548, 549, 550, 552, 553, 554, 555, 559, 565, 568,579, 580, 583, 586, 593, 598, 603, 612, 613, 618, 621: n = A,T,C or G
  misc_feature 625, 635, 637, 641, 642, 643, 648, 652, 654, 655, 659, 661,663, 665, 669, 673, 675, 677, 679, 684, 685, 686, 691, 692,696, 711, 713, 722, 726, 729, 730, 731, 741, 746, 748, 763,765, 767, 771, 775, 783, 784, 787, 789, 795, 800, 801: n = A,T,C or G
  misc_feature 809, 810, 814, 819, 830, 831, 833, 834, 836, 837, 839, 842,843, 844, 852, 856, 857, 858, 859, 870, 872, 873, 902, 903,904, 912, 921, 924, 934, 935, 940, 944, 953, 958, 962, 966,988, 1003, 1005, 1007, 1009, 1021, 1029, 1033, 1036: n = A,T,C or G
  misc_feature 1038, 1051, 1058, 1059, 1062, 1063, 1064, 1066, 1075, 1088,1091, 1095: n = A,T,C or G
atttgaaccccannggnaatccgggaaatttccngtntggccttggtncnagantgacaacctcgtcggggaggtagccccccncgtattgtgagatantaaagacngncttnganacnggnagnncntggctnagggcganaggaaangattgtcatcgagttngcagtccgngaaaatggccgtnntcgtnagggctagnnnantngagagaggangtctattttntttaagagatantaataaanantnttagnnctcnntagatgtctcnatnagtaataaanantnatnnnatcnngtnntatgnnacgngcattctgtataanatagaagcntatatnntngcatannatacacagttantccatatctgtagntnaanaatnanagtnctttggangtnnttatncaanaactngngtcntnanngnnacattnantattnngaagngaacttntntaannnaaatatncanctctcacaannctnananantnananntnnaatatanatctntnannntccnnacanacnnnanatannnncnnnnctanataganaanaatataattanngtngtnactttangacanaattncgatgtcannacatntcnatcnaattattcantnctannnaactnaagnanncgtntncnanagangagnanantnaatannntattnnctangaattcattgtattncnatcactaantatnaannnggtataaaanaaatnanatcactacttattananangatnaaanatataaanngantnatattntatanntatgaaanntatnatacntattcactaannanntnnantannntaaacttntgcnnnntaaacattctnanncatgctatataaactaagatatatgaaannntaaagtanatctacgtnatnacatacacannaatcnaatnttaacttanataantatnctancttatagatctgtaaataactntatatttgcttaacnangnancagttactctanctctctantatntangnctccatattatgnacccaanntcnnnanatgtccaancatttatcttaantantgancc

SEQ ID NO: 8658 - DNA, 691 bp, Homo sapiens
  misc_feature 1, 3, 17, 21, 23, 28, 653: n = A,T,C or G
ncntgctgtcggttgantccnanaaaanccaaacagttgctgtcaatacaactccccttattttctctcaagtcacctggatcgtcctgaccccgggaaccccgtctgcagcaccaggccccctccgtggagaaaagatggagccggattaagcacccagtgctaaggcgactaagacgccactgcccgcaggccctgccggaaaatactcagagagtgcagcaggcgccgcgattccttagaaagtgctggcgtggcctctcctgacacagaaagccggctcctggatgcttacaaaggactggcccgcgcaacaccgttgctcctcaacccgggccacactccaaggacctctactgagcttcagcttgctcaccgaaaacggcgcggccccctctacccgggatgtcggagcccaggagaccctgagagcccccagctctttccgtaattgcaggagaaggggcaagcgggtccgtagccgggggccctccagtggcattatcctgaaccgccacgcccgcacgtggcccggctagagctccctggcgaaggatcacctgttcctacagtgacaactggacctggcccgaacccctggcatctggcaacattattaccttgtcgaaacagaagtagagattgaaatagangatgcagttccatttcttctgctgtctggaaggaatct

SEQ ID NO: 8659 - DNA, 773 bp, Homo sapiens
  misc_feature 9, 18, 19, 23, 24, 26, 35, 44, 51, 98, 99, 102, 113, 114,116, 119, 125, 127, 134, 135, 138, 140, 143, 144, 145, 150,154, 161, 163, 176, 181, 185, 193, 204, 205, 212, 223, 228,235, 247, 260, 264, 276, 280, 288, 314, 317, 321, 337: n = A,T,C or G
  misc_feature 344, 346, 349, 352, 356, 372, 378, 385, 387, 400, 404, 425,431, 435, 446, 447, 460, 477, 482, 491, 495, 498, 510, 518,528, 537, 539, 543, 571, 578, 595, 604, 610, 637, 652, 662,667, 709, 716, 721, 734, 739, 743, 763: n = A,T,C or G
gggctttcnatttcattnncctnntnaaacacttntctctgaanagcgtgntaggactctgcaggaagaggagaggtggtgtgagagcctggagaacnnctntcccaaacttnncnccngctttnanacagggnncancnatnnntgctnacgntcagttntntgatttttcttcnttaancaanatttactnatatgcctttnnttttgcntgggataaacncctanaagcctntgatatttgatnctgctaatctatnttcnctcttctgcttnggangacatggncactgtttccagtattttaccaatanctngacnatcaacgttttcaacnttctgancnaanatnaatnggccactgttttaacntttcanccaaacnanccatgctcatctnaagnactattgattgaagatcgtcngcttgncctnttcttcttgannaaattttcttganttggctaatatgtcccntccanacatctatnagcnaangaacttttgttnaaagaaanatttccaaancctttttcnantttncccaccttgttttaccaaggctaatttnttgaatnaacggggggaaaaaaanaaattccanaccggngtggcatttttcttttccaattttggnaaaccaccccctttntcagaaaaanttttnttttaaatttttttaccaaaatccaagggtaaaaccaaaaantttttgnctttnacccttttggttncaacnttcnttttttccccctaaaccccnccaacttttt

SEQ ID NO: 8660 - DNA, 709 bp, Homo sapiens
  misc_feature 1, 2, 6, 9, 14, 43, 45, 51, 63, 78, 79, 131, 597, 632, 642,654, 670: n = A,T,C or G
nnaccncgntcgantccgttgctgtcgccgagtgacagagacncnatactntgattggcaatnaaatgtgaaacccannttcttgggcaagtcaaattctggaatcacatccacctaaattaaaatgactngctcgtattttccccatcttcaagtttcacatcctggtcatcaaaagactcgacagcaagacttagaatgaaaaagggtacttgtttatattaatattttttacttgaacacgtgtagcttgcagcaggttcttgatgaatgtgctttgtgtccaaaatgcctccccattgtacacaggtgtacatcatgcatgcaccaacacctaaaactcaaaactaaatggctattttgtaaggttaatactttcagttaaacagcatgtttgacttgattccatcatggtgctcttaaattacatgtcagtgcatcacatatatcatgatctaatgcagatgactaggctttttccaaaaggaagacagaccctcagacaccaaaagccaatctaaacaactcccaggtttgctgtggacaatcagcatggaatggtttctgcactctcagtcatgaccatctgtatcttgntacctgctttctctctcaacaccacagttctcaancctgaccttncagagagagctnttggatgatacaagangaatcccagggccccggatctaagatgccccttaaaaga

SEQ ID NO: 8661 - DNA, 706 bp, Homo sapiens
  misc_feature 8, 9, 15, 41, 636, 675, 690, 696: n = A,T,C or G
taaccatnnttcgantccgttgctgtcggccgccgcctctncaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggaatgacagaaaaactgattttttncctgagaaaacctgcatacagtacattcccgccagaagnggtttcgtaaatacncttggncttctgatcc

SEQ ID NO: 8662 - DNA, 708 bp, Homo sapiens
  misc_feature 6, 9, 15, 564, 588, 663, 666, 681, 687, 697, 700: n = A,T,C or G
tgaccnttnttcgantccgttgctgtcgctctccgcagtgagaacctgccttggctcccctcccctcaaggagttcatagccgtgggagggagggagacaagaactgttggagacaagaactgttagagaccagagagcaagggcgtgatgtggtctgcagggaggaggctgtctgaggcagaaccgggtcagggaggccatggtgcgggtaccctccaggcacggcatttggcctgacttttgaggggtgcccagggttggctacatggcggggcggaggtatctttagtgggggaacagcgttgtgccaccaggaggggtctctgtctcccaggtagaggaattctccatggtgagaggtggtggtgggggatggtctagctgtccactcttgccccctttcggatttggaaggaagccccatgctgggtccacactggtatggcgtattaattaggcagctgctttgtctgggagggggctttgtgtcgagtctccctgaatgagcagggctggcgacagttgtcaaaacacatggtgcttggtcagagcccccgtagaancccttgtcctccgcatggcctccnctgcacccgggcgtgggaatgtgctcttgtgtgtccctggctgtctgcttctttttacactggccccttcaaatnganggggtgggggtacangggttnctttaaaaancanacacttgg

SEQ ID NO: 8663 - DNA, 709 bp, Homo sapiens
  misc_feature 626, 640, 648, 704: n = A,T,C or G
gacctcgatcgaattccgtgctgtcggtgaggagaacatggatatggatgtaatgtccttcccttttgttttctttgcacaaatttcagtggaaacatgttgccaagtcagatcgccattctacttgagtgaatatggaatttgtccagttttccaaatgcagagctttttgtgggctgatggactgaatagaaagaggaacaaccatacacccttctacagatgaaggcaagattttatgaaagcgacttcattcgttctcctctgcctggtgttccttctttgtaaaccaggaccagggagctttgaatatagcagtatattatagaatttggtttcattaaatattatacctgcccttagtgtttatattccagtatattgacaacccaggtcctctctgtacctgtgattgtctgtgttgagactattacagagctccaaaaattaaaataaaaataataattttacagaaatacatatttgcattggaatatttaagaaagttgagtttggatgccacaagattataggagtaataggaagctgggcacagtggctcacacctgtaatcctagcactttgggagggtgaggcagtgaggcaataggattgttggagcctangagtttgagaccancctgggcnacataaggagatcctgtctcttcattaagtaaatttaaaatgaattaactggtggngctgt

SEQ ID NO: 8664 - DNA, 1078 bp, Homo sapiens
  misc_feature 3, 6, 16, 26, 70, 73, 85, 89, 90, 96, 97, 102, 104, 107,113, 114, 121, 127, 129, 136, 143, 149, 150, 157, 168, 169,173, 180, 185, 190, 191, 200, 201, 206, 216, 226, 229, 234,241, 244, 250, 251, 252, 257, 259, 264, 268, 279, 283: n = A,T,C or G
  misc_feature 285, 293, 297, 299, 311, 333, 334, 336, 343, 345, 349, 364,368, 388, 389, 391, 392, 396, 405, 407, 416, 419, 423, 428,431, 432, 439, 448, 458, 463, 473, 480, 482, 485, 488, 494,513, 517, 520, 523, 525, 540, 548, 549, 550, 564, 566: n = A,T,C or G
  misc_feature 568, 569, 572, 573, 581, 582, 583, 587, 591, 593, 594, 595,596, 602, 607, 613, 614, 615, 617, 619, 625, 630, 632, 633,637, 641, 647, 648, 658, 662, 664, 665, 683, 684, 685, 686,688, 693, 697, 699, 707, 712, 714, 717, 731, 737, 738: n = A,T,C or G
  misc_feature 739, 740, 752, 761, 769, 771, 772, 780, 784, 792, 814, 818,819, 822, 823, 835, 837, 840, 844, 852, 853, 854, 856, 859,860, 864, 867, 871, 884, 887, 889, 895, 896, 900, 904, 910,911, 916, 925, 926, 931, 933, 936, 937, 939, 942, 948: n = A,T,C or G
  misc_feature 950, 962, 967, 977, 978, 985, 993, 997, 999, 1001, 1009,1015, 1020, 1026, 1027, 1028, 1030, 1032, 1033, 1034, 1035,1037, 1038, 1040, 1041, 1042, 1043, 1056, 1059, 1062, 1073: n = A,T,C or G
agnggncgaccccccnttttttgggnggaaaaaaaaaaaaaccccccccggggggggggcccttgggtancanaacattaccctngggnnacccgnncgggncnaanaggagnnccccccnccaaangntttaaanggtggtngtggtnnatgcccnaaccaaacaanncggngaaatgnatggnccttnnaaaaacacnncaatntttttttttntcaatgggtntanatacnaagcggnaanaatcannnacagngnaacangggngggggcgccanattncntagacatngccnanctaggcaccccncctattatttcactgggaaatnncnaatcagnantatnaaccacttccgggtngccnatgataagaaaaaaaattanncnnagtncggcatggngnactatatgnatngcgnaaatncannaagtaantaagaaacnagtttttcancattnaaagctaccnctcttgnanagnaanccacangctgaatatatctgaatgntcanganaanantcagattaaatattnttggagcnnntacatagacgcatnangnnagnnaatcaccnnncaanagancnnnnaaacanacacntcaccnnnananctgacncacancnncganacanacacgnnggacagagancagnannacatcacccacacacaannnnanataancganancagatacngtcgnanacnagacctctcgtcgncgacgnnnntgatgacaccanacatgcaantgcaagananncaccaganctcnaacaaaanatggatgcaacacgcacgacgnacgnnagnnagaccctacacncntgnatgnaagatacnnntnccnnacanagntatnaacggacctagangancncgcatnntctnttanaaagcnncgaangctcccaanntcaangnagnngnganctcacntncgcataggatcnaaaancgcacggaannactagancggctagnctangnantccacgcnaataanacatnactcannngnannnnanncnnnnaccacagctatanacntgncgtaaacgtancgcgc

SEQ ID NO: 8665 - DNA, 1452 bp, Homo sapiens
  misc_feature 7, 15, 16, 17, 23, 26, 32, 38, 39, 44, 47, 55, 62, 68, 74,75, 78, 80, 87, 88, 90, 94, 96, 101, 104, 105, 110, 114,118, 120, 122, 123, 125, 131, 138, 141, 143, 144, 151, 154,157, 161, 163, 175, 177, 199, 204, 211, 212, 218, 221: n = A,T,C or G
  misc_feature 230, 232, 235, 236, 238, 239, 241, 242, 243, 244, 252, 264,265, 269, 270, 272, 273, 274, 283, 300, 303, 308, 311, 330,331, 334, 337, 347, 348, 354, 358, 363, 365, 367, 368, 369,370, 375, 378, 388, 391, 392, 396, 397, 398, 412, 421: n = A,T,C or G
  misc_feature 426, 428, 442, 445, 446, 448, 449, 450, 451, 454, 457, 463,474, 479, 482, 483, 489, 490, 492, 493, 498, 501, 505, 506,507, 510, 512, 515, 516, 519, 524, 532, 537, 542, 552, 556,559, 561, 563, 567, 570, 578, 582, 595, 598, 600, 610: n = A,T,C or G
  misc_feature 615, 617, 624, 626, 631, 633, 634, 635, 639, 640, 646, 656,662, 670, 671, 673, 675, 677, 684, 695, 696, 701, 703, 706,709, 711, 714, 725, 728, 730, 735, 736, 738, 741, 745, 749,750, 757, 761, 765, 773, 779, 782, 785, 787, 795, 807: n = A,T,C or G
  misc_feature 810, 814, 824, 835, 849, 857, 865, 877, 883, 886, 890, 898,906, 919, 934, 947, 956, 959, 964, 969, 976, 978, 985, 989,993, 1001, 1004, 1015, 1023, 1024, 1029, 1046, 1050, 1051,1057, 1064, 1066, 1075, 1080, 1081, 1082, 1091, 1103: n = A,T,C or G
  misc_feature 1105, 1107, 1109, 1114, 1115, 1116, 1121, 1123, 1124, 1128,1152, 1161, 1163, 1168, 1185, 1189, 1193, 1195, 1203, 1206,1207, 1212, 1230, 1231, 1243, 1244, 1245, 1253, 1261, 1269,1270, 1275, 1280, 1282, 1286, 1290, 1298, 1300, 1301: n = A,T,C or G
ccttctnttttaacnnntatctntanctaaanattgannagatnaangggttatngataatnggatantgtatnnttnangggtatnncnaacnanttatnttnntgggnggtngtanantnnanattaancttaatntantnngataatnttnttncatncnaagagggtgtanantttaatctttggggttttattngtaantataacnngaagcntancataagtangntanntnntnnnntcaaagantacccattttannaatnncnnntgggggganatatatattagtccccncgnggaanggncccccctttgtttgatggnngtnatnttacttatcnntatgtntagntatgntncnnnnatatntantatatctagntanntaannnatacatatctaccntatagtcanaaatngngtacattttttttnatnntnnnntanttnactaantatactactantaaanttnntatacnntnntaatntanacannnacngnacnntanttaanaatattcntcatncattngataataatntttnaancncnatanttnttatatantgantattgaaacatanatntntataactatnctagncnttatatncnaaaanannngtcnnattatncattctattngactantttatacnnanananttttatnacatttttcannatctntntantananttnaatctaaattnttncnataanntnatnttangatnntaacgtnttantatntaattatnaatatntantantntgtaatantaatgatttaanatntttnaagatacatngaactatcgantattaattatgtanttatctanttaatacnaaagttatatanggaatnatntctntcaatatnaatggtanaatatatacttantacgtaattaaatanataatataaatgnacatatatnaangtacnctatncactctnantatagtnttanatanaatactanttnatcgatatgtnatcgttannttatntactattatatattctntganngtattnttaggtntntatcttatnacagnnnatgtaaacntatctctaatantntntnagtannntatcntnntatntacttatctaatctatattaatcnttgttattntnccttnctgtactatgtgatatntatnatanantacttganaannatatntatgaaaattattatatnnatgttattatannntgatatantacatatnttatatannaactntattntnctantctntgttacanannnntataganncanagtntanntaagntatcganatnntagatannttatgnnatngatcnctatcnaanatanccgtnnntgattntacnatatntaatttnatnnatangtatncaancntattnacnatatnatnntntatcnattann

SEQ ID NO: 8666 - DNA, 761 bp, Homo sapiens
  misc_feature 3, 13, 14, 18, 22, 25, 26, 31, 34, 35, 42, 52, 55, 58, 62,64, 67, 76, 78, 85, 89, 95, 106, 111, 113, 129, 134, 136,145, 151, 152, 164, 170, 172, 181, 182, 185, 187, 188, 200,201, 208, 209, 213, 215, 216, 229, 235, 237, 238, 244: n = A,T,C or G
  misc_feature 246, 250, 251, 253, 254, 256, 257, 259, 261, 262, 265, 268,274, 275, 280, 296, 302, 324, 369, 379, 420, 473, 509, 512,525, 536, 549, 559, 560, 565, 568, 573, 581, 591, 598, 612,617, 622, 631, 634, 637, 646, 648, 649, 652, 659, 666: n = A,T,C or G
  misc_feature 670, 679, 682, 693, 696, 699, 702, 708, 709, 712, 727, 732,737, 755: n = A,T,C or G
acncatcatccgnntgcncttntanncccgntanntctttantgtctgcacntgnaancatncnttnggagctccncnatactangganacgccnctgacgctacnaacancnagatgaaatatgtatntatgnangccgatagnggcccnncatggtcaaaanaccgcncntaacgcccnngantnnatatctggcttnntcccatnngtgncnncgtgcaataactnagctgncnnctgtcnantccnntnntnnantnngcnagntgagtnntagtntttggcatttacagtnttttantatttacagttgatgatgaaanattcgtgaggtgctgccaaatatacatcaaaaggtggagcttgtntggccaactngccacctgatttaatcaacaactactagtgctgagatgcanaaagggggaaaatggaggaattatggaccaaagtctgtctttatagatgacantcacaggacaagggttaggctttgacttgcagactnctntctttgctctggncacccctgttnaccacaagccctnaattggggcnnttcanaanttatntcttggtnggcccgggcnccggttngcccacattcttgntattnccctnccccttttnggnacngcttttaancnntgnttaaaancaaacgntaangtccagggnaanatttttattanccnaanccngggccnnatntgtacgcttgaaaanaatcnctttntttataccaaattcatcnccacct

SEQ ID NO: 8667 - DNA, 704 bp, Homo sapiens
  misc_feature 13, 53, 577, 604, 635, 688: n = A,T,C or G
taccacgatcgantccgtgctgtcggagtgacctgttctcctgagtgctctantgtctccagttgtcggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatcattatttgtgtgtaattttatacgtgttcatatttttctcattttgcattgngtaaagtgtacaaaatctcaaagtatnaaatactgcttatattgcttgtaattacagngtgtaaatattttctaattgggtcattgatgggggggacaagtgggttttcangttttttttaatgccc

SEQ ID NO: 8668 - DNA, 1078 bp, Homo sapiens
  misc_feature 7, 19, 34, 44, 101, 135, 138, 156, 158, 160, 182, 188, 193,195, 197, 198, 206, 211, 212, 216, 222, 234, 236, 237, 241,242, 244, 246, 253, 265, 267, 288, 294, 296, 303, 304, 312,328, 331, 332, 344, 345, 347, 349, 359, 360, 362, 379: n = A,T,C or G
  misc_feature 382, 385, 386, 396, 397, 416, 430, 444, 451, 454, 458, 462,463, 472, 473, 484, 486, 492, 499, 501, 507, 510, 514, 522,523, 524, 527, 540, 544, 548, 549, 550, 553, 563, 574, 575,578, 583, 584, 600, 601, 631, 645, 661, 665, 668, 672: n = A,T,C or G
  misc_feature 673, 680, 683, 702, 724, 725, 726, 730, 731, 734, 735, 740,743, 749, 750, 753, 756, 757, 769, 795, 796, 808, 811, 812,825, 826, 828, 835, 839, 840, 845, 860, 862, 869, 884, 897,901, 912, 916, 925, 939, 942, 950, 954, 967, 973, 977: n = A,T,C or G
  misc_feature 992, 996, 997, 1002, 1008, 1010, 1013, 1016, 1018, 1026,1030, 1034, 1038, 1042, 1047, 1055, 1058, 1071, 1073, 1074,1076, 1078: n = A,T,C or G
gaatatngatcttgtgtantcggagaagaggtgngctccccttngccccctcagcgagcccagcgtggggaccactcttcccgggagcaaggccacgcccntgggggcacttctcaggccagacagattgatttnccngcatgcggatccctggtncncnaaaatagttttgtttgaatgcnattctnttttngngnnggtacgtnttttnntttnttccanttaacattcttntnntatnnananaaaaatntattaaaaggtngntatcccattattaaaaaaagnagaacntnttggtannccttgcangaagaaagccctggtnaannattcccattgcnnancncctaaaaatnngnacttttttcgaaaacanatnccnnttatggactnnttttgttaattttttttanaaaaattatggtanttaatttattattngtaactnatnctgntatnnattaatatnnctatgatatantncatgtngcctacntntaatanttnttantatttgtnnnacnattatttttcctnttcnactnnnaantctttctaanatttgatcgtnnatnaattnntatttttattattatnnatgatttaagttcttttattttttttattnaatattatatattnttaatatcttatcttntctnttnaganntatattnatntgttaattatttatagtantatatacttactctaatcactnnnactnnttnnttatnttntacatnnttnctnnttataactatanttaatatattacattaaatgtattanngaaatataattntcnntatcttattttannanacgatantatnntattntacgtatgaatatantnagaaatnttatttatgctttanataataatctttngtantttatttaatnatanttattttanaatttctaatgatnctntatacatngtcnatcttaacatatnttagtntatnaaagatttgtagatntaanntaagnctttcntngtnatngnatctaatntatntctntatnaaantatantaagttangtntatctctatgctntnnancn

SEQ ID NO: 8669 - DNA, 1060 bp, Homo sapiens
  misc_feature 3, 4, 8, 10, 11, 13, 14, 15, 17, 19, 20, 21, 24, 27, 28,32, 33, 34, 36, 38, 39, 40, 43, 45, 49, 52, 58, 61, 63,67, 75, 77, 79, 84, 88, 90, 91, 93, 99, 102, 107, 108, 113,114, 116, 117, 118, 119, 123, 136, 140, 141, 142, 143, 145: n = A,T,C or G
  misc_feature 147, 149, 152, 156, 158, 159, 160, 161, 162, 163, 164, 165,166, 167, 168, 169, 170, 171, 172, 173, 174, 175, 176, 177,179, 188, 190, 191, 194, 196, 209, 213, 227, 229, 270, 276,279, 281, 282, 296, 298, 312, 316, 349, 355, 371, 380: n = A,T,C or G
  misc_feature 388, 430, 439, 440, 441, 442, 454, 486, 490, 498, 522, 528,550, 581, 607, 609, 615, 630, 635, 657, 662, 663, 664, 675,676, 693, 694, 695, 713, 716, 729, 738, 744, 748, 760, 766,783, 794, 796, 797, 806, 809, 810, 818, 827, 830, 832: n = A,T,C or G
  misc_feature 842, 848, 849, 852, 854, 856, 873, 874, 876, 877, 878, 889,897, 925, 932, 933, 938, 944, 947, 948, 962, 974, 982, 983,984, 997, 1017, 1025, 1027, 1028, 1029, 1035, 1040, 1043,1049: n = A,T,C or G
ccnngtcntnnannntntnnntanaannattnnntnannnctntnttcnaanataatnaantntatnattggggngnancatcntaantnntntatagnacntcatnnccacnnannnngagngttatataatagntatnnnntntntnatnctgntnnnnnnnnnnnnnnnnnnnnangataaacantnntcnantccgggggctgtnattntgcactccagcccncngctaataagtagggaaactccgtctcaaaaaaaaaaagtanccatantcntnngggaagaccttacngnagagacttgtgagngganacctgaaggaaatgaaaagggaaggagtctgtnctgatntctaggaggaggaatnttccaggcngacggaanagaggcacaatgtctttgaggaaggggcatgttgggcatgtncacaggacnnnnaggaggccaaantgggtggagcaaaagagcccagggggagaggnattnaaaggaanaacaggccaaatggccataaaatnttgttngccttgatggggacattggccntgaccctgatcaaaatagggggtgacaggcnacagggaaactagggaggaggcttgngngctcgncattcatttgagganacccntatcatgtggaaactactgtgnaatannnttttggggtanntcccttttaaaaaaacnnngtcatttttccggtttgngcnccttgtgggcttnacacccttntaaatncccnaactaatttttngggaangcccaaagggttggggncaaaaatcaancnntggaaggtncanngaattttnttaaaaaanctnanctctttgaanccaaannatngngngtaaaaaaaacctttcnngnnncttttcaattntatagaanaattaccctaaaaaatttttctcctttngtaaaannggtgngtaggnacnncaaaataaaccccngtgagaaaattnccccacannnttttaccttttgngggggaaaaaaaatgaaaanggccccgngnnnaaaaanaattncgnctcttnagaaaaccccc

SEQ ID NO: 8670 - DNA, 737 bp, Homo sapiens
  misc_feature 13, 25, 28, 29, 32, 408, 453, 465, 535, 544, 563, 577, 590,594, 604, 607, 638, 644, 654, 679, 680, 687, 695, 696, 700,715, 718: n = A,T,C or G
aaccacgatcgantccgtgctgtcnggnnatnaataatttatggacactgctggacctcagtctcctcatctgaaagatgagtggttggagaagtttaatggttttcaaatgctttttttttcagtcttcaaataagtgtttacgtagaagcaccatatctgaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttanggatggagccaggaaatggctctgggactcagcgggtgtccagantctcatcagcanggtttctttactttcactgagtggctggtgcctgcacacttgagttttgccagcttacttctcacaaaantgagctttnctggaagccccccaactgnaaaccccttttccnttcctggaacctnggtnccgacttggnggncctgaaaccaccccaaggcccttttccccantgctgntggaatgggncaaactttttttttgcacccctccnnggtttgncccaaatnnaacncttgataaaaaattnctngaagcccaaaatgccctcg

SEQ ID NO: 8671 - DNA, 706 bp, Homo sapiens
  misc_feature 5, 8, 10, 12, 14, 26, 535, 596, 645, 665, 706: n = A,T,C or G
taacnttnancnantccgtgctgtcnagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaaganaagagttgagaccaatctttatttgtctggcccaaatactgaataaacagttgaaggaaanacattggaaaaagcttttgaggataatgttctaaactttatgccatggngctttcaagttaatgcttgngtcttttggcagaataaactttcaattattaaaaaggactn

SEQ ID NO: 8672 - DNA, 712 bp, Homo sapiens
  misc_feature 8, 625: n = A,T,C or G
tacctcgntcgaattccgtgctgtcggacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttctttggaacccttcaagctctcgtgctcattcccccatgatcgccgtaggaagtgatgacagtagccccaacgcaatggccaanggtcaaaattttgaatattaatgaaaacccccaggaaatatgccaaaagcttgaaactcttatgacagtcactggatcctgttcatg

SEQ ID NO: 8673 - DNA, 993 bp, Homo sapiens
  misc_feature 1, 2, 4, 13, 19, 39, 47, 50, 53, 56, 67, 69, 113, 115, 130,131, 156, 169, 175, 189, 255, 258, 259, 267, 273, 280, 281,284, 288, 290, 292, 309, 313, 314, 315, 325, 329, 337, 338,375, 377, 384, 388, 397, 398, 403, 409, 411, 413, 414: n = A,T,C or G
  misc_feature 427, 433, 442, 448, 451, 452, 459, 460, 463, 465, 468, 469,479, 481, 485, 497, 506, 512, 516, 523, 526, 534, 548, 554,568, 577, 578, 581, 583, 589, 590, 593, 597, 611, 613, 618,629, 639, 650, 651, 658, 660, 662, 663, 674, 681, 686: n = A,T,C or G
  misc_feature 698, 721, 724, 727, 731, 735, 736, 747, 761, 773, 779, 782,783, 790, 794, 795, 800, 804, 805, 809, 810, 815, 816, 843,848, 854, 864, 871, 873, 874, 881, 895, 896, 897, 905, 908,909, 913, 919, 920, 925, 936, 942, 945, 946, 947, 951: n = A,T,C or G
  misc_feature 956, 957, 962, 963, 969, 972, 976, 984, 987, 990, 991: n = A,T,C or G
nncncttatcgantccgtnctgtcgggacactttgtgantcccattngangangcnctggtgtgtgngngggatgaggtgctggtgtgcggatggatgaggtgctggtgtgtngntggatgagatgctgnngtgtggatggatgagatgctggtgngtggatggatgangtgctntgtggatggatgangtgctggtgtgtggatggatgacgtgctggtgtgtggatgaggtgctggtgtgaggatggaccacnttnnggttttcncgtttnggcactnnggntgantncncttttctgctcttgcanttgnnncctgcgaaanttcnccggacanntgcatacatctttgtatgcaccggcatcactttgggnanatgattncgtncctcgtgtnnggttngggaananannatatataaatgtnctcttntcttacatnttatcnttnncaccccnnccntntgnngctcccaagncnattnacctccacctgnttctatccntccgcncgantgtcgtnatncagagggngatcccactcaacntttttnggatctccctttcnaagtctttnnatnantccttnntcntttncttttgtaagtctntnaatgntagctctccanaaatattctntcccttgcggnnaaaaaanananngacccttcacnctttcgnggctntgagagcacacntcaactcctctcccccatctttnctnttntttnaacnnctatattatcnctattatcactctntggtaagacgtnaccccnctnntaaccantatnnctttncgtnnatannaaccnnctctttatcattaggggactctttttntaganataatntcttacatangcacgcntnnaaaatantacactcgcggtcnnncactctantanntatncaactnnccccnccccccccctntcttcntcnnncccntcttnnttgcnntcttcngtntttntacttccnatntanncc

SEQ ID NO: 8674 - DNA, 675 bp, Homo sapiens
  misc_feature 5, 6, 7, 11, 16, 33, 36, 38, 39, 45, 46, 47, 493, 537, 553,579, 641, 663: n = A,T,C or G
ttttnnncccntgaantaaaaaaactagcacantcnannttgctnnntgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttnatggggaaggaaaagtgcggatgatcgtgtgtgtgaaccccaangctgaagattatgaanaaaacttgccagtcatgagatttgcngaagtgactcaagaagttgaagtaccaagactgtaacaagcatatgtggttacccctgggangagatcaaaaccacctcgaggncagtgggaatga

SEQ ID NO: 8675 - DNA, 667 bp, Homo sapiens
  misc_feature 2, 3, 5, 21, 22, 24, 26, 30, 124, 586, 606, 645, 654, 660: n = A,T,C or G
tnncntgctgtcgattacatnntncngctnaggcgctggcagctgaagagcgtgttaggactctgcaggaagaggagaggtggtgtgagagcctggagaagacactctcccaaactaaacggcngctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccacttgaagaatttaatcagtttcttccanactccacagatctagaactntttggaagaacgaaacctagagggaatggaacttgaaanacctcattnctgatnagacttg

SEQ ID NO: 8676 - DNA, 704 bp, Homo sapiens
  misc_feature 9, 30, 565: n = A,T,C or G
taacctcgntcgattccgtgctgtcgttanaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaaacagaaaacccttattgaaatgtataaaactcangtacaaaagttgcaagaagcactgaaatagtaaaaaagcagatgtgaaaatttgcttcctaaaaattacccattaccaaaacccaaaataaaatgttagaagatgaaaggcccatggagtctcactgaagggttagagc

SEQ ID NO: 8677 - DNA, 1252 bp, Homo sapiens
  misc_feature 1, 2, 6, 7, 8, 10, 11, 23, 49, 56, 57, 68, 70, 96, 103, 104,105, 106, 119, 136, 138, 139, 151, 153, 176, 179, 186, 189,199, 203, 205, 208, 213, 225, 228, 232, 233, 235, 240, 242,246, 247, 248, 250, 253, 256, 259, 261, 262, 269: n = A,T,C or G
  misc_feature 271, 272, 273, 274, 276, 278, 279, 280, 284, 285, 289, 294,297, 299, 302, 308, 310, 311, 313, 315, 318, 319, 320, 326,328, 329, 331, 333, 341, 349, 350, 359, 364, 366, 368, 369,374, 383, 402, 406, 414, 415, 428, 434, 436, 441, 446: n = A,T,C or G
  misc_feature 447, 451, 457, 468, 473, 481, 482, 489, 500, 507, 514, 523,528, 536, 539, 542, 551, 556, 558, 564, 575, 576, 577, 578,583, 595, 597, 605, 606, 607, 609, 611, 613, 615, 620, 638,642, 649, 670, 673, 675, 678, 685, 691, 696, 697, 699: n = A,T,C or G
  misc_feature 708, 719, 721, 723, 730, 735, 736, 737, 739, 741, 749, 751,759, 762, 773, 781, 785, 795, 796, 802, 810, 814, 816, 818,822, 825, 828, 834, 840, 841, 857, 863, 864, 866, 881, 884,888, 901, 902, 905, 909, 914, 920, 927, 932, 934, 936: n = A,T,C or G
  misc_feature 943, 948, 949, 950, 952, 954, 955, 958, 968, 981, 987, 988,996, 1007, 1014, 1016, 1029, 1030, 1040, 1044, 1051, 1055,1057, 1058, 1073, 1081, 1085, 1087, 1096, 1100, 1104, 1108,1109, 1116, 1120, 1135, 1139, 1143, 1145, 1147, 1152: n = A,T,C or G
  misc_feature 1157, 1160, 1165, 1176, 1187, 1190, 1191, 1195, 1203, 1209,1218, 1220, 1223, 1225, 1227, 1235, 1239, 1244, 1249: n = A,T,C or G
nnaacnnngnncgaattccgtgngctgtcagccgccgcctctccccccnacactgnnccctgcggtgntngaaaacaccacctgatggccatgganggctacnnnnagcaaccggggtngttctgtcaatatcaantnngattcattaatntnctgacattactggacaagatggnacntgccatncanaaagctagtngttntntcntattntttcctaatacnacngagnnanactancntatnnntnccnttntgncnngatttangnnnncntnnnaatnntaanaatcntcnanatnatcttnanncntnatnnnttctanannantnaacattanattacaanncttacaaantccanantnnaatantctctctanatagaatatggcaataatntatnctatcgtnngtagttctcatanttatcnantgctnatatnnagtntaactnccacatactanttcanactatatnnctatcanctcactctctnttacggntcctacntaaaactcnatacntctctatnttntantatctatcnctctntntatatntctagccactnnnncttancctcataaagtntnaatcacannntntntntntgatntcttcatatagagctaanctancatatantatttcataatatcgagtatnatncnganatctcgntcttantactnngnatatacacnacatatatccntnantccaatnattannnancnctatatancnatctctantcncactattctcncgctgatnacantagaaatacnnatatancacctctntccnananattntcnacncatctnacatcnnttgtactccactactnaaaacnngnacatgtcatctatantantctntctatatacagtnnatnctcnaatanactcgnctttcanaaagntnanacgatanatgannntncnnacncataatcttnacctactactcanatggannttgctctnataataccagncgatggncncatttcacttttnntacactgatntctntatactnaaanannatagtatgttcatgntactcacncatntncaattccanatantgtntgtnntatcgtncacntctgagatcgatctnatanatancnantcgcnttatncanactcnaatcctagagnccatcactccnacnntaantatatctntacatntgatggcgntntcncntntctatctntcanaaacnagatngcc

SEQ ID NO: 8678 - DNA, 1306 bp, Homo sapiens
  misc_feature 11, 12, 13, 17, 19, 20, 23, 25, 33, 34, 36, 43, 49, 50, 53,56, 58, 60, 62, 69, 73, 84, 85, 93, 97, 98, 100, 101, 106,108, 117, 118, 120, 126, 129, 130, 131, 136, 138, 143, 150,151, 152, 154, 155, 157, 158, 159, 165, 167, 175, 188: n = A,T,C or G
  misc_feature 198, 215, 233, 236, 243, 244, 248, 264, 271, 274, 299, 307,324, 326, 330, 331, 336, 337, 345, 346, 349, 353, 357, 365,366, 367, 369, 371, 372, 373, 374, 377, 378, 379, 388, 392,402, 406, 409, 411, 419, 420, 426, 428, 433, 434, 439: n = A,T,C or G
  misc_feature 443, 446, 447, 450, 453, 457, 459, 465, 473, 475, 483, 485,487, 492, 497, 501, 502, 506, 509, 513, 514, 517, 520, 521,522, 528, 531, 533, 535, 536, 538, 546, 548, 564, 567, 569,570, 573, 578, 580, 593, 602, 606, 608, 609, 615, 624: n = A,T,C or G
  misc_feature 628, 649, 651, 653, 655, 658, 659, 662, 671, 674, 680, 681,687, 690, 691, 692, 695, 702, 703, 716, 717, 719, 720, 728,729, 730, 739, 741, 750, 752, 754, 766, 767, 769, 771, 772,778, 782, 785, 798, 799, 810, 811, 812, 814, 817, 827: n = A,T,C or G
  misc_feature 828, 838, 844, 860, 877, 902, 904, 905, 906, 910, 912, 917,930, 933, 953, 958, 972, 974, 975, 976, 980, 984, 994, 998,1002, 1003, 1004, 1008, 1011, 1014, 1015, 1021, 1027, 1028,1031, 1034, 1035, 1042, 1048, 1049, 1050, 1060, 1062: n = A,T,C or G
  misc_feature 1065, 1069, 1072, 1074, 1078, 1079, 1084, 1086, 1090, 1109,1115, 1120, 1123, 1127, 1130, 1131, 1145, 1151, 1156, 1158,1159, 1172, 1174, 1178, 1180, 1183, 1185, 1186, 1193, 1194,1211, 1213, 1216, 1224, 1226, 1229, 1235, 1246, 1256: n = A,T,C or G
cctcttcccgnnngttntnntcntntgaatgtnntntatgttntgtgtnntantgntntntntgttctncatngtgtttctgtnntttgtaantacnntnnatatnanttgtggagnnanataacnatnnnatatnanttctngatgatnnntnncnnnattaancntgatcgantccggggctgttnttctccgcanagggcccctgccttggntcttctataagacaaggngtncataatnngggnatgaccttgagacaanaactgtnggngactttttctgccatagaccagatngctatggntgaatataatgttttgntncganntctannatgcatanntgnttantctnttttcggnnngngnnnnatnnngtcgttttntttnatttctcatnaatnctntnctctattnncttatngngtgtnncgtgnttcntgnntanttntgtngntcttanaagttttnanaaattttngntntgaanttacnaaannttgnttntgannttnttnnnattgtntanancnntntttccatntnatttttatccgatatnttntnntcntttcntntgttctcttattngatttatanttantnnactgtntctacattntatnagattctagtctgtatgattngnantntcnntanattatgttntcnggtgtnntgtaanaannncangttatgnnatgataatttagnnanntctggtcnnnacatctttncnctaactatntntntgtctgtgattnnancnntcatantttngantttctttcttttnngaattaatatnnntngantggtgaatgnncatatcaccntgcgcntagctacttatgtacnttttcctctacagcacnctttcatacatttatatagatcagnannntatntngattngcattctatagtntgngtatttcctctaactctctntgtgncaacattgcgtctntnnntaangatntacataagcnatancatnnnattnttnttnntcgttnttgttnntcntcnntggtatntatatnnntcttatagtnanttntgtnatnantaanntcttntnatantatcatagcttttagggtntaatantacgnggntatntcnnttaccttagtgtantatatnatatntnntaatacatttggngnctgngnacntnnccttttnnttatctatatctatgangngtntccatatnanccntattgngataggggtgntctggtggtnaccactnnngantgtctnttatatnttntnantntntnacnattctctnt

SEQ ID NO: 8679 - DNA, 728 bp, Homo sapiens
  misc_feature 8, 13, 649: n = A,T,C or G
tacctcgntcgantccgttgctgtcggaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaaatgccagtagttcacacccgaaacccaaaaccatcacatatgaatcatcacanggtcgatcccaggccccaagatcttggaagcccaggcgtgccttgatgagtgccacagaccgatcaccttcttgaaact

SEQ ID NO: 8680 - DNA, 710 bp, Homo sapiens
  misc_feature 7, 9, 10, 18, 684, 700, 710: n = A,T,C or G
agccttntnnatcccgtngctgtcgctctgtttctctggctaatgtatttttatcacacccaagaaatttaacgtttataagatgtaatcatttaatataccaaccatgtgtatactgcttcagttgctcctcagattcctgaatctaatcagatataacactttgcattttgtttaccggtctctctagtcttctgtaattttcccagttttttcccataatactgatttttttttcagcattaaagctagctctcttgtagagtagtccacagtctgaatttatctgattgtttcatgattagattcagattaaatatttttggagaaatacagcataggtgattttttttccctgttgcattatatcaggaggcatgaaaggttagcctgcatgattattggtgatgttaaatttgatcacttgattaaggtagagtctgctggtagaaaacatacctttgaaattaaaagttatcagtaaccaaagattatcttgttcaatgaccatctctcatctaataggttttgtcatttatttatgatccttgccagaatcagtgattaccttagtggttgcaaaatattgattttctacttcaagagatgtgttaaaatttctttttaaaaattgttaccctaagatggcccttggctatagtaatcattgctctttttatttanaatggattaggaagtntgtgagaagn

SEQ ID NO: 8681 - DNA, 1453 bp, Homo sapiens
  misc_feature 9, 13, 14, 16, 19, 23, 24, 31, 32, 42, 44, 47, 53, 58, 61,68, 80, 88, 92, 99, 104, 107, 112, 115, 122, 130, 131, 133,134, 135, 137, 138, 141, 142, 148, 149, 154, 156, 157, 168,169, 229, 235, 256, 263, 286, 289, 296, 300, 303, 307: n = A,T,C or G
  misc_feature 309, 315, 316, 319, 321, 326, 332, 334, 337, 343, 345, 347,353, 361, 364, 365, 376, 381, 384, 386, 400, 401, 405, 408,411, 413, 423, 426, 428, 441, 453, 462, 464, 465, 467, 469,477, 487, 493, 494, 504, 507, 511, 515, 521, 523, 528: n = A,T,C or G
  misc_feature 530, 532, 533, 547, 559, 566, 577, 588, 589, 592, 593, 596,602, 604, 617, 621, 629, 631, 632, 636, 645, 646, 647, 648,649, 654, 664, 672, 676, 678, 682, 683, 684, 688, 696, 697,705, 707, 720, 722, 732, 740, 748, 752, 756, 761, 767: n = A,T,C or G
  misc_feature 771, 772, 776, 780, 788, 791, 797, 801, 803, 807, 808, 811,815, 820, 822, 826, 828, 830, 837, 839, 844, 855, 860, 868,870, 886, 888, 902, 910, 916, 922, 925, 929, 930, 934, 936,945, 946, 950, 963, 966, 972, 975, 976, 984, 994, 997: n = A,T,C or G
  misc_feature 999, 1000, 1002, 1014, 1016, 1019, 1035, 1038, 1043, 1044,1047, 1049, 1062, 1066, 1068, 1071, 1079, 1084, 1091, 1098,1109, 1111, 1113, 1114, 1119, 1121, 1122, 1133, 1137, 1146,1147, 1153, 1154, 1158, 1161, 1167, 1170, 1173, 1183: n = A,T,C or G
  misc_feature 1198, 1199, 1204, 1207, 1215, 1218, 1239, 1245, 1259, 1264,1266, 1267, 1273, 1282, 1286, 1298, 1301, 1306, 1313, 1335,1339, 1341, 1346, 1356, 1364, 1365, 1367, 1369, 1378, 1380,1381, 1384, 1385, 1386, 1391, 1394, 1400, 1404, 1408: n = A,T,C or G
ctcgctccntatnnanttntaannctgtgtnnctatgtatgntnganatatcntctanttnggattangtatctattgantttttttntacnggggtcntattnacntattnctntttacancatggttnntnnntnnttnnttaccnngatcnannccggggctgtnnttgttcaccgagatgcgccttctgggacacttccccttggtgccatcatccctgctcctnactttncttcctctccccttcccatgngatgtgntgcttgatttgttttacccctcncanttttttnatantantctntncaatanncantntatanctttantntcnactttntnanactatnattttctntcnntaactcacttntattnttncntttctatgatgaanntttnttntantncgatttgacnagntnttatgataatctnatactactctcntaatatatnanntntngttttatnttgttacctngtatcnncttacttatnttnactntacntatctntntctantntnntatttaattcctanactattctaatncgcatcnttctattgtanttatttaatgnncannttngtcctncntctctatacacanctantacattantnntagntaactatcnnnnntattntctgtccgtntttcttcnttangntgtnnntcanatatgatnnctgtttgncnactctgactatcngnacattttctnggtattcncacggacnctcnctcntcatnttcatnacanncatntatnctatactntancttacnaatnantacnnttntcanatatncnatcntncntatagtntnttatnttatctataantaatntaagtacntnattctttttactgtcncnaaacaatgccatgntatctacntcatcnattatnttntctnntacnantgtactatnntctnctctatctaaatnatntcttcnaanncgtatagntatcttaatntantnnanataatacctatngntantacgtatcctatcaanatnatcgnnacncnttgatctgttatnttantntantaacatancttcntatctangttaagnatgtatatatnancnnacatnanntattctatgcntaantatcttatnntattanntcanccnctctcnctntcntatactttcntaaacgcactatatnntgtanatntaactaanctnctctctatctatgttcacctnttatanaaatctatcatacnattananntcgatngtatctatntctnttctcatacttngtntctgnaaccctnttaccagcatcacttatttctngatnanctatntaatttccgntacgctanncntntatgtaatntnnttnnnaactnatntctcancccnctcntatctaaanngttacncataatntacctgtctcncgnncatnnnc

SEQ ID NO: 8682 - DNA, 711 bp, Homo sapiens
  misc_feature 2, 14, 646: n = A,T,C or G
tnaccacgatcgantccgtgctgtcgaaattttccagttcttttttcagcttctttatttcctcctaatggaaacattatctttaaaagttgcatataggaaatatacatattttacgtttgaacaaggagatttaattgtaaatatgaaagccaaagtattcctgaatggtcaaatacagcaataaaggcagaagaattaagatttttctttgttccattgtacagtgtaaataactaagttgttaactgtcaagtccagttatgtattctgtaagttgtgttctagtctttgactaaaatttatcatctcttataatgggacttaatctttctctaaaagcatataagagcttgtcaatagagcaatcaatcaaaaagattttgtgattcataacattgaagttagtctggttaagagttttggtttagacttcatttatattttccttactaatatctaatatttaatgaataatgatcaattttttataaagttattaatatgatcagggaaacctttgggacttctgacaggcatctggtgaagagacaattcaagccttagtgactatttagaatagccagtgatcactagctaattctcatatccatgcctttttgtcctgtttacagtcttaaaagangtaaaacagcaaatatttttttaagggactataccttaaggattcctgaaaaagaatttcaaaaa

SEQ ID NO: 8683 - DNA, 704 bp, Homo sapiens
  misc_feature 5, 8, 13, 25, 480, 483, 504, 554, 575, 579, 581, 591, 619,634, 645, 647, 648, 661, 675, 682, 698, 703: n = A,T,C or G
taccncgntcgantccgtgctgtcngccttttaatagttccagtgaggtgagagctggatgaggtgggtacaacagaatcatcaaaaatctggccgttgatgggacctcagagtcacttgaggaagcaacatttgagcagcatctaggagccttctgggaaaagatggagaaaactaaagacgttaggtttattgcaaaccaatcaatcatactcactgatcacctactagaggaaacctgtgataacacttgtggggagatttatagaaagaagacgtatttgcacatcaggattttacatcatgatgtgtgcctgtgtgtgtctgaaaaatactagcataacaagctggtgagtacactatgaaaaaaaacaacaacacctacttcatttggcagagcaccagaaatgagggggtaatgaggtcctgtctttgtggcatggtaaaaaaaaaaaaaaattgcccttttaattcagtttnttnttctgaaatgaaaaaagtaanatttaccccctgaatacttgacaggatgtttgcaaggcttggttaatttntgtaaatgttttgagctcctntgangngtgtgttctntaaataggaggtttaatagcaccgtcanactgaacaaactganttgagctgcantnnttttccgggaaanaaacccaacccccntaaagcntgacccccttctgggnttgcnc

SEQ ID NO: 8684 - DNA, 726 bp, Homo sapiens
  misc_feature 6, 8, 9, 25, 26, 32, 38, 43, 46, 49, 53, 67, 70, 82, 83,100, 129, 131, 135, 136, 137, 138, 141, 145, 146, 152, 158,165, 167, 173, 174, 175, 177, 179, 180, 182, 183, 187, 188,207, 259, 262, 265, 271, 272, 276, 277, 278, 280, 281: n = A,T,C or G
  misc_feature 283, 285, 288, 294, 304, 309, 311, 315, 321, 322, 333, 339,342, 349, 351, 352, 353, 355, 356, 358, 360, 361, 362, 367,369, 376, 380, 384, 409, 412, 423, 446, 472, 475, 478, 482,494, 508, 512, 525, 529, 555, 562, 569, 600, 602, 604: n = A,T,C or G
  misc_feature 606, 609, 615, 619, 626, 630, 637, 645, 650, 665, 674, 675,680, 687, 690, 693, 694, 724, 725: n = A,T,C or G
tacctngnncgattccgtgctgtcnnactgantaggtngcgcngtncanactnacacagcacctcgnttntacacaggaganngaaatggccgtacttcnagaactgcagtgcttgtgaggggatattncngccnnnngantttnngatgtncatggncattgtntnaaggtnnngngnntnncctnnatgtggactttgaatggtncatcaaaagattggtttttgcagagattttaaagggggagaattctacaaanaantgntacctnnttannncnncntnaangatganaatcctggtngaagntngttnaaaaanngctaaattacntagacntangcattancnnntnngngnnncaatntngccaccncctntggnatcatctagagtgaatgttaccaanatngcattctaagntctatttaactgactcgcactgnatgacgaatttaaaaaccttctttgnatnggnttancaaaactgtgcntcaccattgcacanttantgtcctatctatncatncgaaactttggggggcctgttagccnacacttnaggaccnggccatctcattgggactcattgatggcttntntncntanaaacantttntgttttnaacngggtatnacctcttntttangggattttttttttngaccccaannactantttgagnatnttnnttttgcgcaaaaaaaaatgggtttctttannt

SEQ ID NO: 8685 - DNA, 1444 bp, Homo sapiens
  misc_feature 10, 11, 18, 19, 25, 27, 31, 32, 34, 40, 41, 45, 46, 50, 55,56, 57, 62, 65, 75, 78, 80, 81, 83, 85, 87, 102, 105, 110,113, 122, 130, 131, 135, 139, 140, 144, 147, 148, 156, 158,159, 171, 175, 180, 183, 189, 191, 195, 196, 203, 214: n = A,T,C or G
  misc_feature 224, 225, 227, 229, 232, 252, 259, 261, 268, 271, 273, 274,278, 288, 290, 295, 298, 301, 302, 305, 309, 312, 317, 320,322, 324, 325, 327, 328, 335, 338, 339, 341, 342, 346, 352,357, 363, 377, 378, 380, 386, 399, 421, 423, 430, 435: n = A,T,C or G
  misc_feature 436, 440, 444, 452, 455, 456, 459, 461, 469, 470, 477, 490,492, 494, 500, 503, 504, 513, 514, 522, 524, 528, 532, 534,536, 548, 555, 566, 567, 571, 573, 578, 590, 591, 593, 597,612, 623, 630, 634, 635, 641, 644, 645, 646, 650, 663: n = A,T,C or G
  misc_feature 665, 668, 678, 679, 697, 705, 710, 712, 722, 726, 728, 732,738, 744, 745, 763, 764, 765, 776, 787, 790, 791, 798, 799,803, 804, 812, 819, 821, 823, 834, 837, 841, 856, 862, 868,871, 873, 879, 885, 886, 891, 897, 900, 901, 905, 909: n = A,T,C or G
  misc_feature 910, 911, 921, 926, 927, 938, 940, 950, 951, 953, 959, 965,966, 976, 984, 991, 998, 1003, 1004, 1005, 1010, 1015, 1022,1026, 1041, 1048, 1053, 1054, 1059, 1069, 1076, 1085, 1092,1093, 1094, 1097, 1099, 1101, 1102, 1106, 1111, 1124: n = A,T,C or G
  misc_feature 1128, 1131, 1143, 1150, 1161, 1167, 1177, 1178, 1195, 1197,1203, 1208, 1210, 1211, 1221, 1224, 1226, 1235, 1239, 1242,1248, 1256, 1260, 1264, 1266, 1270, 1272, 1273, 1278, 1280,1283, 1284, 1287, 1290, 1293, 1295, 1299, 1302, 1303: n = A,T,C or G
cccccccccnnatattanntgtgtncnactnnanggagtnntttnntttnctctnnnagttntangttaatcttnatnanncntncntccagatacatagangcntgggnttnttccccatngcccctanngggntttnntaanaanntaatcccncnntattgagcatcntttncgccnatnagaacncngggnntattttngaactaggaanatcgttcacnncntngcnggtgagttcatgattaatanattacanangtggatnaantnnaaanacgtcagtananctatnttntannctnaganagngtgantgnantnncnnacgaacnganntnntatngtactnctgangtaggntactaaattacctnnanataatnacatctaagtatngtgggtctctaatgttatgaangntacgctnttaanngttngttnttgcgcgntanntancnaaacatanntaactantggtgacaacatntngntcagcnacnntctcttaannatgggaangnacanatgncngnatcgtacattanggctcgngtatcatgagnnctgntnataanagataaggatanntntccntaatggaattctaantgtatgggcanataaaangtanntgaaancgnnntgcnaattgctacgaanantgnatgcaatagnngaagcgtatgtaagggtncgctcttntacgnanatatatagtnttgntnatancgatcntataannttatcttatgtatatctnnnacattttaagntacacgtgaangannttgccanngcannattacatnacattgntntnagtaagtgatnggnacangcttagggaaatcantgagcncagggnatntnaatatnatcggnntaccntaggtnatnngaanatgnnnatgtaaaagngttcnnaatatatactntnaacgatctgnnangtgtanggagtnntctaacacanggttaatntacggtnagtgagngaaannnattangtatncatatanaatngtgaagcaaagaatntcgaacncttanntcacnttcagctatntaagctngagtacacnagcattnnntcntnanntaancaatngctacacgtctanactngcnatatggtagagnatcacangaacgtactcntttatnctcaggaatnnatgaacggtgagacttntnaacgtntacangnnaggaaatatnatncnatgtctagntagnacnaatatnttctaacngacnaatnangtantnngttgntnaannacntcntgncntatnttnnattnntccacatantatatncngaagatcaatattntatcatnactgtatgntagacnanttgttantantaanaacgnagcnctanacnntnncgcaggantatntannnacntngtacgnctnctatacnnntannncg

SEQ ID NO: 8686 - DNA, 739 bp, Homo sapiens
  misc_feature 1, 511, 521, 574, 639, 642, 647, 653, 698, 707, 724, 728: n = A,T,C or G
naaccacgatcgaattccgttgctgtcgttgtccttttctaatagttcgtgttttagaaattcagaacaaacaatttctgaatgctcctcagaacgccaactcaggcagagaatctcaccgaaatagagaagaagctcatgctcctggaagaaacagcccgaggagagccgctgggccacatctggccactgtccgcagcgctgtcagattgctggggccacatctggccactgtccacagtgctgtcagatccaaggagagccgctgggccacatctggccactgtccacagcgctgtcagatgccgaccaaaccctgctttggtgttgaggtggttcgtctggtagcctcctttcttaagggtatttaatctgctgcaaattgttttcatgtatgcaatagatgttactgtaactgttttataaggtgcattgtcttcaccttggcaggctctgtgccagtctgtgtctagtctgatgccattcctgcacacatacatccttgccccancattttgganggctggagttaaggaataatcctggtggggacttaatattaactatttgggantgggaacttaatattggatcctcatggtccaactgggccccacctttcccaaaccccaaaaaaanggntgaanaatttntcttttttaacaaaaaacattttaacgattaagggccaatacttnttaaaaatnaggttaattaaagtttnattnccccacccaat

SEQ ID NO: 8687 - DNA, 704 bp, Homo sapiens
  misc_feature 1, 6, 9, 14, 43, 619, 629, 703, 704: n = A,T,C or G
naaccncgntcgantccgtgctgtcggcagagcgaaaggtggncgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattgggggctaccgagtactctgcgggagaaaaaagtcgtctatganaatgcttatnggcaatttattggtcctcacaggattaaggcaccaattattaaggccaagaaaaaaaaaaaaaaaactcctggnn

SEQ ID NO: 8688 - DNA, 1481 bp, Homo sapiens
  misc_feature 2, 3, 7, 9, 10, 12, 15, 16, 18, 19, 21, 28, 33, 44, 45, 48,50, 52, 60, 61, 78, 79, 88, 90, 95, 98, 101, 102, 107, 110,121, 124, 125, 126, 127, 128, 129, 130, 131, 132, 133, 134,135, 136, 141, 146, 147, 149, 151, 167, 174, 175, 176: n = A,T,C or G
  misc_feature 177, 189, 191, 194, 206, 207, 216, 220, 221, 222, 231, 242,260, 268, 271, 277, 280, 282, 285, 287, 291, 292, 308, 315,318, 321, 324, 333, 335, 341, 352, 354, 363, 365, 366, 374,379, 380, 387, 391, 395, 397, 401, 407, 421, 424, 429: n = A,T,C or G
  misc_feature 432, 433, 440, 446, 447, 449, 452, 456, 461, 462, 464, 470,474, 476, 487, 491, 494, 503, 506, 510, 514, 519, 521, 527,540, 549, 554, 556, 568, 580, 586, 596, 598, 599, 600, 602,604, 606, 608, 616, 618, 619, 633, 636, 638, 643, 644: n = A,T,C or G
  misc_feature 649, 651, 654, 655, 656, 659, 660, 661, 666, 668, 671, 674,678, 680, 692, 694, 697, 716, 719, 721, 723, 724, 726, 727,732, 737, 744, 746, 753, 764, 765, 769, 774, 780, 788, 789,791, 799, 804, 808, 811, 821, 823, 829, 831, 832, 836: n = A,T,C or G
  misc_feature 837, 844, 845, 848, 856, 858, 859, 860, 867, 874, 876, 884,885, 891, 897, 901, 903, 917, 921, 925, 946, 952, 966, 977,978, 982, 990, 995, 998, 999, 1014, 1018, 1022, 1028, 1032,1033, 1037, 1044, 1048, 1055, 1056, 1062, 1072, 1074: n = A,T,C or G
  misc_feature 1081, 1082, 1085, 1090, 1093, 1099, 1103, 1112, 1114, 1118,1120, 1126, 1127, 1131, 1132, 1159, 1162, 1163, 1166, 1168,1172, 1174, 1175, 1178, 1185, 1187, 1193, 1195, 1200, 1201,1202, 1212, 1216, 1218, 1228, 1229, 1233, 1235, 1237: n = A,T,C or G
cnncccncnnancanngnngntgaaagntgtgntgatggatatnnaantnantatatggnntatattaatgttttatnngtacccctntnaggtnttntanntagtnttntctttcctatngtnnnnnnnnnnnnnatgantaccnngntngaatccggggctgtantcggcannnngtcccccggctngnganaattattatatnnatattacgnatannnatacattanaattgttttcntcttaaaatttggggggntttttttnatntcgagnatnanttntnaatnngcgatttctctatacnattgtcnatntantanccttatatnangatctnctatgcattanancatgtattntnnatgtgttntgtannattcttntgcnttgntntatnaaatcnctgtatttataagnatngtagnatnnttttatnaatacnnangcngtanttatnntnctattnagtntntaattagttcnaagnaanttattacanatnaatntttntatananggtagntagctgtgatgcnatcgaactnttatntnatatgtatattngcaaaggactanataatngtatgttatntnnncntncnangtacgtgncnnaaggtatcgatgtnatnanctgcnncgtananatnnngannntattnangtnatngatntnatcgctacgttntngcnaaatatcgttcctattttnctnancnnanntatgntagantatgagnantataccntacgtaagganntatnatatnttgtgntatcgtanntnaaacgtantatancgtntgngatgtgcatnantattanannttanngaatganntangaataggngnnntgagtgnagtaatntncatatttnngtatanattgcnctangnacgtgtctgaagtntgtntatngctctcattatttatttcgancgctantatttgttatgtantgattacctannttangtaatatntattnagnnctcttgcagtttatntgtntagntatggnatcnnactnatataanatantagttgnntatganatctaattgnangtacaannaantcaangtnatattnaatnacgatgagnancgtnanattagnntatnntactgtaatttaggctatatagtattntgnntancnaaanannacncatcttntncattcncncgatnnntctatctttngcangntcaagcaatnnatgntnanctananaggtaggntcatanntagtntatnntattaattagcnatnttcgtatcngcacnanatagntantatantttnannnattntaggntctgtattatatnantcncttngagttntnncnnaagtatagnnctacatcatgtncatcntantnntggananatcncncgttnttgatgactgnagtgantaanttacnagatngaatatatnngngctatctaaaactacnacgttang

SEQ ID NO: 8689 - DNA, 756 bp, Homo sapiens
  misc_feature 3, 12, 30, 364, 365, 367, 368, 369, 370, 371, 372, 373, 374,380, 395, 398, 399, 403, 411, 412, 413, 416, 417, 418, 423,424, 425, 426, 427, 439, 442, 443, 444, 447, 448, 449, 450,451, 452, 453, 454, 455, 456, 457, 458, 459, 460: n = A,T,C or G
  misc_feature 461, 462, 463, 464, 465, 466, 467, 468, 469, 470, 471, 472,473, 474, 475, 476, 477, 478, 479, 480, 481, 482, 483, 484,485, 486, 487, 488, 489, 492, 493, 494, 495, 496, 497, 498,499, 500, 503, 505, 506, 507, 508, 509, 510, 511, 512: n = A,T,C or G
  misc_feature 515, 516, 517, 518, 519, 520, 521, 522, 523, 524, 525, 526,528, 529, 530, 531, 532, 533, 534, 535, 536, 537, 538, 539,540, 541, 542, 543, 544, 545, 546, 547, 548, 549, 550, 551,552, 553, 555, 556, 557, 558, 559, 561, 563, 564, 566: n = A,T,C or G
  misc_feature 567, 569, 570, 571, 572, 573, 575, 576, 577, 578, 579, 580,581, 582, 586, 587, 588, 589, 591, 592, 593, 594, 595, 596,597, 598, 602, 603, 604, 608, 609, 611, 612, 613, 614, 615,616, 617, 618, 619, 620, 621, 622, 623, 625, 627, 628: n = A,T,C or G
  misc_feature 632, 633, 634, 635, 636, 637, 638, 639, 640, 641, 642, 643,644, 645, 646, 647, 648, 649, 650, 651, 652, 653, 654, 655,656, 657, 658, 659, 660, 661, 662, 663, 664, 665, 666, 667,668, 669, 671, 672, 673, 674, 675, 676, 678, 679, 680: n = A,T,C or G
  misc_feature 681, 683, 684, 685, 686, 687, 688, 689, 690, 691, 692, 693,694, 695, 696, 697, 699, 700, 701, 702, 703, 705, 706, 707,708, 709, 711, 712, 713, 716, 717, 718, 719, 720, 722, 723,725, 726, 728, 730, 731, 732, 733, 735, 736, 737, 738: n = A,T,C or G
ttncctttttcnaattccgttgctgtcggnacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaaaaaaaaaaaaaaaaaaaaaaaaaaaaaaaaaaaaaaaaaaaaaaaaaaaaaaaaaanncnnnnnnnngggggnttttttttttttttnccnnaaanaaaaaaannnttnnnggggnnnnncccccccccctnttnnnttnnnnnnnnnnnnnnnnnnnnnnnnnnnnnnnnnnnnnnnnnnnttnnnnnnnnnttntnnnnnnnnttnnnnnnnnnnnntnnnnnnnnnnnnnnnnnnnnnnnnnntnnnnntntnntnntnnnnntnnnnnnnntttnnnntnnnnnnnntttnnntttnntnnnnnnnnnnnnntntnntttnnnnnnnnnnnnnnnnnnnnnnnnnnnnnnnnnnnnnntnnnnnntnnnntnnnnnnnnnnnnnnntnnnnntnnnnntnnnttnnnnntnntnntntnnnntnnnnnnnnnnnnnnnnnnnttc

SEQ ID NO: 8690 - DNA, 684 bp, Homo sapiens
  misc_feature 10, 14, 538, 568, 639, 653, 655, 665, 679: n = A,T,C or G
cccatactcncatntccagctctatgctcagagaattaccagaaaataaaattacatgaagcttgaatatagggagatggaaagatattagacaaatattaaagaaaatctgggccaggtgtggtggctcacacctgcaatcccagcactttgggaggcccaaggtgggaagattacttgaggcaaggggtttgagaccagcccgggcaacatagtgaaactctgtctctttaaaaaagaaagaaaagaaaagaaagaaagaaaagaaaatctcagtgagtgatggtcagaatagaattcaacataacaagctcattattaaaatatttgatctcactgtgtacaattctgaagacactcattcatgtacttcattaaatatttctagtttgctaaaaatagaattacccttcaacccagcaatcccattactgggtatctaccaaaaggaaaaaaaaaatcattctatgaaaagatgcctgcacttgtatgttcatcacagaactatttcagtagcaaagacatggaatcaacccangtgcccatcaacagggggactggataaaanaaaggggtggtacaccggccccccttgggaatactattgccgccctttaaaaaaaccatggaaatcctgtncctttgcaataacntngattccactnggagggcatttttncttaa

SEQ ID NO: 8691 - DNA, 708 bp, Homo sapiens
  misc_feature 9, 14, 27, 686, 703: n = A,T,C or G
taacctcgntcgantccgtgctgtcgntttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtagcaaaccatgtgatttcttctgactctatttcctcttctgccagtagtttcctgagctcaaactctactttttgcaacaagcagaatgtacacatgttaaacaagggcatacaagcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggagtttcctggtttgttcctgtggaaaatgtggagtctagatcaaagaaggaaaacgtgcctaacacttgtggcctgggcatctctgggttgaacccattaccaagaaccgaccctggagggagccactgngggagcaaacttgtcangggct

SEQ ID NO: 8692 - DNA, 694 bp, Homo sapiens
  misc_feature 2, 26, 619, 693: n = A,T,C or G
gngctgtcacactgaagttttgttcnagacactttgggcttcgctgattgaaaacaccacaccaactgaaaaatcactgtgaaaaagaacctggtagtactgtcaatatcaagtaggattcattaattttctgacattactggacaagatggttcgtgccattcagaaagctctttttctttcttcttctttcctaatacagtgaggcatacaacgtagcctgccttatggttaagttgggtgtatgacttgtaaacttccctcttgctattaaagattatataatgggaagttcattggttttgaaaggcagaccaaacccacccatgggatttctattggctttttagatgtattgcatttctctgagtaaacccatgtggctgagaaatagtgagtagcttgttggctgactgtgggaaaacctatgaaggatcagttgatctcatttgggcaggagtcagaaatggctgagaatctaaaactatatatatgaggatggttttctcttgatgttgcaatctttattttaacatgtttttgtgtttagcttctggagttgcctaacagtataatttcaaatgaggtttaatttcagctgtttaattttaaactgtangggaacatgattaaaaaaaaattaaaggctttatcatttgccttaaaattttaatggtttggtataaaaaagant

SEQ ID NO: 8693 - DNA, 712 bp, Homo sapiens
  misc_feature 9, 14, 617, 649, 667, 669, 702, 710: n = A,T,C or G
tgacctcgntcgantccgtgctgtcggcctaagcataaaaccaaaattataaaactcctagaagataacacaggagaaaacctggatgaccttgggttggcaatgactttttagatacaataccaaaggcatgctccttgaaagaaataattaattgagaagccagaaggcaaaatggtacagccattttggaagacagtttggccgtttctcacaaaactaaatatactcttaccataccatgcagcaattatactccttggtgtttacccaagacttgaaaacttgtgtctacacaaaaatctgcacgagtgtttaaagcagctttatttttatttataattgccaaagcttggaggcaagtaagatgtcctttggtaagtgaatgggtaaactatggttcatccagataatgagatactattcaatgttaaaaataaataagctatcaagccatggggagagatggaggaaactgacatgcatactattaagtgaaagaagcccatctgaaaacgctacgtactatatggttccaactgtatgacgtcctggaaaaggcaaaactttggaaacagtaaaaagatcaatggttagcaggatttgggcaggggaanggatgaataggcagatcacagatgatttttangagagtaaaaaatgcacngnattagaatggatggatcatattatccatttgtncaaacccnct

SEQ ID NO: 8694 - DNA, 860 bp, Homo sapiens
  misc_feature 3, 9, 27, 244, 258, 260, 279, 305, 307, 308, 310, 312, 315,329, 332, 334, 338, 345, 351, 352, 353, 354, 359, 361, 364,365, 372, 373, 378, 382, 383, 384, 385, 387, 388, 396, 398,399, 402, 404, 418, 420, 422, 423, 424, 425, 429, 432: n = A,T,C or G
  misc_feature 442, 445, 446, 447, 454, 455, 457, 458, 460, 462, 464, 466,470, 472, 477, 482, 484, 485, 486, 494, 504, 506, 514, 518,519, 520, 521, 522, 524, 525, 530, 532, 534, 535, 536, 538,544, 549, 550, 556, 558, 559, 561, 562, 563, 564, 565: n = A,T,C or G
  misc_feature 568, 569, 575, 577, 578, 579, 582, 583, 585, 586, 587, 591,595, 597, 599, 601, 604, 605, 611, 613, 614, 615, 616, 617,618, 620, 621, 622, 627, 629, 630, 631, 632, 633, 635, 636,638, 640, 643, 644, 647, 648, 651, 653, 655, 658, 660: n = A,T,C or G
  misc_feature 663, 664, 665, 666, 668, 669, 671, 675, 676, 677, 681, 685,686, 692, 693, 694, 695, 696, 697, 704, 705, 707, 708, 710,712, 715, 716, 717, 719, 722, 723, 726, 727, 728, 731, 733,738, 739, 740, 741, 742, 743, 744, 745, 750, 752, 753: n = A,T,C or G
  misc_feature 758, 759, 762, 767, 768, 770, 772, 775, 779, 780, 781, 782,786, 788, 791, 792, 793, 796, 798, 800, 803, 805, 809, 810,813, 816, 819, 823, 825, 835, 837, 839, 841, 844, 849, 850,851, 852, 853, 854, 855, 858: n = A,T,C or G
cgncctcgntcgattccgttgctgtcngcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcncaatttttttaatntncaaataaaaagtttaaaancttaaaaaaaaaaaaaaaaaaaaccncnngngnccnttttttccttaaanccnancttnaaaaaancctttnnnnatttngnccnnccccccnntaaanttcnnnncnntcttactntnnttncnatttttctttttantntnnnntctnccntcattttctnttnnnttttttnnanncntntntnctcnanttctntactntnnnattcactnctctacttcncnttctactntttnnnnnanntcttncntnnntntatctnctctnntcactntnntnnnnnttnnctcctncnnntcnntnnnctcncttncncncnccnncattcntnnnnnntnnntattntnnnnncnncnanctnntcnnccntncnatntnctnnnntnncntctnnnctcnttcnntatctnnnnnncttcttnnanntncntcnnntntcnntcnnnctnanctttnnnnnnnnttatnanntctcnntancactnntntnttncatnnnncttntnttnnnttncntnatntnctcnntanctnttnttancnctactctcantntntnttnccttnnnnnnnttncc

SEQ ID NO: 8695 - DNA, 939 bp, Homo sapiens
  misc_feature 2, 5, 8, 9, 10, 11, 12, 14, 15, 16, 18, 19, 20, 21, 22, 24,26, 28, 29, 31, 33, 34, 37, 40, 41, 45, 47, 50, 51, 52,53, 54, 57, 58, 59, 60, 61, 63, 66, 68, 69, 70, 71, 72,73, 75, 83, 86, 88, 90, 91, 94, 95, 96, 100, 101, 106, 107: n = A,T,C or G
  misc_feature 108, 109, 110, 111, 112, 113, 114, 115, 124, 125, 126, 127,128, 135, 136, 137, 139, 140, 141, 143, 144, 146, 147, 148,151, 153, 154, 155, 156, 158, 159, 160, 161, 162, 163, 164,165, 166, 167, 168, 169, 170, 171, 172, 173, 174, 175: n = A,T,C or G
  misc_feature 179, 187, 206, 212, 213, 217, 222, 230, 231, 234, 239, 347,348, 351, 369, 383, 411, 424, 434, 446, 447, 454, 457, 471,481, 488, 492, 500, 501, 507, 533, 536, 538, 547, 553, 560,565, 577, 584, 591, 594, 605, 617, 618, 627, 631, 634: n = A,T,C or G
  misc_feature 638, 639, 640, 654, 660, 671, 685, 700, 720, 750, 760, 772,775, 781, 784, 792, 798, 800, 801, 806, 809, 811, 814, 821,822, 829, 837, 838, 840, 862, 871, 875, 878, 894, 896, 900,907, 909, 911, 912, 931, 935: n = A,T,C or G
cnacnacnnnnnannnannnnnangngnnanannganaannaggnantannnnngannnnnanaanannnnnnanggggagancangnanngannntaannccacnnnnnnnnnngaggcgaannnnnaaagtannnannnannannnagnannnnannnnnnnnnnnnnnnnnntaanacccttgngaaaaacccgggggctgtnaaaacnncgcngaggncccgctgnngcnggaanagtagaatcaagaaccgaggattttacatgggactgggaggacgagcaaaaggaggcttaccgaatccggagatcccgaggaggaggaagaggaagaggaggaataannggnaagaactgtcacaggtanggaaacatctcagnaaaagcagggattgagcttcatgaaatnctaagggcatatnaaggagcaangacttgaaaccnngtaaganaangggggtggaataanctctgatacntccatgngcantggagagnnaaaggngagagccacggaaagcacgagacagntcngngtaaggggncttttncagttgnggaancagggagcaaanggcatcnagagggnccngcaacacaaancaatatgcttannagagggatnaatnaanaacnnnggagctaggcatgngaggcntcgagcctggnaaactacaacactntgggaaggccaaggnaggcggagaataccaacccngaaacaaacggtagagaaaaccccatctcnactaaaaaancaaaaaatgagncgnggcgtnggnggcacaancccggnanncccanatncncanaaagctnnagggcangaagaaanncntcgaaaccagaacaagcagaangtaggaggncganatnaaaatagagccagatngngganccaacangngnnaaaaagaacaaaaacatcnaccnaaag

SEQ ID NO: 8696 - DNA, 711 bp, Homo sapiens
  misc_feature 2, 617, 667, 675, 704, 709: n = A,T,C or G
gncacgatcgaatccgttgctgtcggggtgagagagatggtgttctggacacttccccttggtgccatcatccctgctcctcctttccttcctctccccttcccatgaatgtggggcttgatttgttttaccccttaagtgggctgaagatgtaaagcttaacctcttccaaactagatgctttgaggttccagctgtcactgagaacagcttggtagctggtgcagcgtaccagcgtgcagaggcagcattgttcagctggagcctcactgctggagcctcatctaccagagggctccttccatactgcctccatgcttcgctgtagaatcaggaggcgaccacagcagcagaacactgccaccctaggatccagagctattgcacaaaattcacacacaggtgtggctgtgacgtgtggccataagcatcttcttcctttatggcacagtttctgagtgtagcagagcttgatgggggtgagcccaacacccacacttctcctcactgccttcctcccttctcagcacctcgtaactgaggctggctgaaggaaaggaagcaccagagatgattcccgaggtgtttttaggtcaggaggcactggcatgaggcangctctgcagttgggtatgacctgccctgctttacctgggaccagaaattnctgggaanggggctctcaacgctgaaatggtgatgtnggggnaa

SEQ ID NO: 8697 - DNA, 710 bp, Homo sapiens
  misc_feature 1, 7, 12, 41, 645, 685, 687, 706: n = A,T,C or G
nacacgntcgantccgtgctgtcgctgggctagaacctcantctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaagcctttttaaagcaaactatggaaaataattgatgagtagcgcagttttataaaacttttttttctattacccttttaaaaactatgttgctaactgcacatcacactgcattcatatnctggggactaataccccttgaccttgccatttgaattaangnggaaaaaaggtcataagtnacat

SEQ ID NO: 8698 - DNA, 715 bp, Homo sapiens
  misc_feature 1, 5, 13, 18, 640, 655, 683, 694, 702, 705, 711: n = A,T,C or G
naccncgatcgantccgntgctgtcggagagtggaggccagagaagaccaaagctgaggaatgcgacctcaggatttccttctttctggggatagttctctttaggaggaagaggagttagcccctcacttgcttatccctctcctatgctctggagttcctctccacccttgcccccaccccacattgccccctcctgctcggtcagtgcctggccagctcaggcagcttgcgtcacagtaaggtaaagccagaatgagttttaggtctgagtgagattggaaaagccattcctctgaccctccccacctgctcccgtctctccaggcatcctacctgcaagaggacactgtgaggcgcaaaaaatgtcccttccagagctggccagaagcctgtgagtgctgttgacacgcacccttgtgcacacacatcccctttctctttctgtctcctacacacacatgtacacacacacacacacacaccccgcacttcacacatgtgctgggggaagtccccagaagcatgcaggtactttccctggagtcagtggggggaaaagggctgccaagtctaccagtccgcttgccaatagatcaaagatcgcttgagcacccgcagtacttgtgaaaaagtttanaaatatgaggcctangagaaggtgtcctaagaagatggccaanaagacccattnccatacanctnttgtcnattg

SEQ ID NO: 8699 - DNA, 707 bp, Homo sapiens
  misc_feature 1, 5, 622, 663, 683, 707: n = A,T,C or G
naccncgatcgaatccgtgctgtcgccggcctcctatgccttctttccgggcctgttttaagagcattttcagaatacacacagaaacaggcaacatttggacacatctcttaggttgtgtattcttcctgtgcctggggatcttttatatgtttcgcccaaatatctcctttgtggcccctctgcaagagaaggtggtctttggattatttttcttaggagccattctctgcctttctttttcatggctcttccacacagtctactgccactcagagggggtctctcggctcttctctaaactggattactctggtattgctcttctgattatgggaagttttgttccttggctttattattctttctactgtaatccacaaccttgcttcatctacttgattgtcatctgtgtgctgggcattgcagccattatagtctcccagtgggacatgtttgccacccctcagtatcggggagtaagagcaggagtgtttttgggcctaggcctgagtggaatcattcctaccttgcactatgtcatctcggaggggttccttaaggccgccaccatagggcaagataggctggttgatgctgatggccaacctctacatcacangagctgccctgtatgctgccccggatccccgaacctttttncctggcaaatgtgacatctnggttcactctcatcaactggttcn

SEQ ID NO: 8700 - DNA, 704 bp, Homo sapiens
  misc_feature 18, 446, 452, 457, 483, 513, 563, 568, 576, 592, 605, 643,644, 665, 675, 690: n = A,T,C or G
tgcttgcaattaaattcnccgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtaagaaatatgtgaagagaagtaccctgatatactgaattttgtggatgatttggaacctttagacaaagctagtnaagctntgtanaaacgctggaaaagaatttgaggcanatgggaaggcagcttcaacagcttgagaangaattggaaaccttttccccctcctgaggactttgcattgacaagttttnggacnaaagatgnccaagatttgttatcnagttgcaaaaagnacaaatatgagacacttttcgaagtttacacgaaaacnntgggaaaagttattcccgaantttaataggnatacttttgcccatngatttgaaaaaagg

SEQ ID NO: 8701 - DNA, 743 bp, Homo sapiens
  misc_feature 1, 2, 536, 679: n = A,T,C or G
nnagatcagctcttgttctttttgcaggatcccatcgattcgggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaattcctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaagatgaagtggtgaagagagcctgcgattgaagattttttcatctcagctttttcccccttaccttgttctctctcatgtttcatgatctgtgtcatagatatttcttcattacgagcacttcgcggtgtggcttttcaatgtctgaagtggattaagtggcccacagtcagttctgtgacttgagtttcaaaagtnaaattaccatcaacaatgtgattcaattttattttctatactagctaaaagcaaggaactatattattaacaatcttggctttactgtagtttaaggcaggtgatgatgatgcttattagtccacctgaaagagtccttccangtttttggaaccttattcctgcttattaccttgcccttgaaaagtccttcatggaaagtggaat

SEQ ID NO: 8702 - DNA, 675 bp, Homo sapiens
  misc_feature 6, 12, 334, 660: n = A,T,C or G
attcanatacanctacttgttctttttgcaggatccctcgattcgggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaattcctctggaactgccaccattgctgaacggagaggtagccatgatgccccacttggtgaatggagatgcagctcagcaggttattctcgttcaagttaatccaggtgagactttcacaataagagcagaggatggaacacttcantgcattcaagatgaagtggtgaagagagcctgcgattgaagattttttcatctcagctttttcccccttaccttgttctctctcatgtttcatgatctgtgtcatagatatttcttcattacgagcacttcgcggtgtggcttttcaatgtctgaagtggattaagtggcccacagtccagttctgtgacttgagtttcaaaaagtaaaattaccatcaaccaatgtgattcaattttatttttctatactagctaaaagcaagggaactatattattaacaatcttggctttactgtatttaaggcaggtgatgatgatgcttantaatccccctgaaaa

SEQ ID NO: 8703 - DNA, 756 bp, Homo sapiens
  misc_feature 1, 398, 400, 558, 571, 593, 595, 628, 655, 656, 732, 742,746, 755: n = A,T,C or G
ntccccccatcggacctccagctgccggctgggaaggcgtgggcgacccggtgtgtggcgcgcccagagccccgcgtttcagccctagggaaggaagccagttgagggaagttctccatgaatgtacgtcacaatgatgatgaccgaccaaattcctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaagatgaagtggtgaagagagcctgcgattgaagattttttcatctcagctttttcccccttaccttgttctctctcatgtttcatgatctgngncatagatatttcttcattacgagcacttcgcggtgtggcttttcaatgtctgaagtggattaagtggcccacagtcagttctgtgacttgagtttcaaaagtaaaattaccatcaacaatgtgattcaattttattttctatactagctaaaaagcangggaactatattnttaacaatcttggctttactgnangtttaaaggcaggtgatgatgatgcttattaantcccaccctggaaagaagttcccttcnnggttttttggaagcttttatttcctgctttaattaacctttgcccccttggaaaaagtcctttcattgggaaaagnggggaaacanctgnggtttgacnc

SEQ ID NO: 8704 - DNA, 732 bp, Homo sapiens
  misc_feature 2, 3, 4, 5, 6, 16, 17, 286, 599, 690, 701, 711: n = A,T,C or G
gnnnnnttctaatacnnggctacttgttctttttgcaggatcccatcgattcgaattccgttgctgtcgctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcancagggcgaggccatgcgctgcccccagtgccagatcgtggtacagaagaaggacggctgcgactggatccgctgcaccgtctgccacaccgagatctgctgggtcaccaagggcccacgctggggccctgggggcccatgagacaccagcgggggctgccgctgcagggtaaatgggattccttgccacccaagctgtcagaactgccacttgagctaaagatggtggggccacatgctgacccagccccacatccacattctgttagaatgtagctcaaggagcttcgtggacggccttgcttgcttgtaancgtttgtaagggccctgcctgcactgcggttgtcacggtcacatctgccccaatgcctttgtccttccttggggcttgccggcagactttntatccctgcgnttccaacctntgctgaccccagcttaaacat

SEQ ID NO: 8705 - DNA, 793 bp, Homo sapiens
  misc_feature 6, 14, 286, 380, 503, 509, 581, 626, 641, 655, 665, 679,685, 692, 707, 732, 739, 745, 750, 770, 782, 785: n = A,T,C or G
tcttcntcgaattncgtgctgtcgctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacanaagaaggacggctgcgactggatccgctgcaccgtctgccacaccgagatcttgttgggtcaccaaggcccacgctggggccctgggggcccangagacaccaacgggggcttgccgctgcagggtaaatgggattccttgccacccaactgtcaaaactgccactgagctaaagatggtggggccacattgctgacccaaccccacatccacattntgttanaatgtagcttaagggagcttcgtggacggccttgcttgctgtaacgttgtaaggggccctgccttgcactgnggttgtccacggtcacattttgccccaatgcctttgtcctttccnttggggcttgccggncaaaactttttttncccttggggnttcccaccttttgncttganccccaancctttaaaaaataanccccctgggccaaaaggccttttcnttgggtngggaanccctnttggggggaactccattaanttctttcccaancanaaaaaaaa

SEQ ID NO: 8706 - DNA, 767 bp, Homo sapiens
  misc_feature 2, 3, 4, 5, 8, 9, 10, 17, 484, 602, 685, 720, 736, 752, 759,761, 767: n = A,T,C or G
gnnnnttnnntttatanatacaagctacttgttctttttgcaggatcccatcgattcgaattccgttgctgtcggcggggaggacgtaccttgtgagatgcgagccggccaacagcttgcaagcatgctccgctggacccgagcctggaggctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaagatcttggcccagcagacaggccgtagggtgctgacggtggatgctcgtaaccacggtgacagcccccacagcccagacatgagctacgagatcatgagccaggacctgcaggaccttctgccccanctgggcctggtgccctgcgtcgtcgttggccacagcatgggaggaaagacagccatgctgctggcactacagaggccagagctggtggaacgtctcattgctgtagatatcagcccantggaaagcacaggtgtctcccactttgcaacctacgtggcaaccattgaaggccatcaacatcgcaagattaaacttgcccgnttccgtgccccaaaaactggccggatgaaacaagnttaatttctgtcattncaaggaacatgggccnttccggnancacctn

SEQ ID NO: 8707 - DNA, 949 bp, Homo sapiens
tggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggytgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaacttgacctttcccattttattcttaattctgaggcaggagaatcgcttgaacccaggaggtggaggttgcagtgagccaagatcatgccattgcactccagcctgggcaacaagagcgaaactctgtctcaattaaaaaaaaaaaaaagaatataaatcaccaaataaatgttaattgctccctacccattaaagttacacttccttacctataaagacaacctccccctccacatactcacggaaaagtct

SEQ ID NO: 8708 - DNA, 293 bp, Homo sapiens; identical to SEQ ID NO: 7399
  misc_feature 165, 168, 169, 170, 177, 194, 204, 205, 208, 210, 218, 221,227, 231, 232, 233, 234, 240, 242, 246, 252, 254, 255, 259,263, 264, 265, 270, 273, 274, 276, 278, 279, 280, 283, 284: n = A,T,C or G

SEQ ID NO: 8709 - DNA, 534 bp, Homo sapiens
  misc_feature 461: n = A,T,C or G
aattcgttgctgtcggaagttattgctttccaggggtcactctggcttcgactccgtcgctctcaattcgtcaccrggaggaagacggagctggctgcccagcccaaaggcccatgaggggatgcagttatgggctctgtcgccgtggattgttattttgtgtcagtaagtaatccatawwgtgccaacatgggaaagaaacggwcaawgggaaaaactgttccaatcgawgattcctytgaarctttaraacctktgtgyakacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgncttgaagcactatctgacgccaagatctgaacctcactgtctggttcttagtttggacaactggagtgtatgg

SEQ ID NO: 8710 - DNA, 454 bp, Homo sapiens
  misc_feature 382, 406, 436: n = A,T,C or G
aattccgttgctgtcgggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaattacaaggagcacccagaggccctgttcctggcctactggcttncaacttccggaaggaggaaaaagncccaggcgaggggagatgggtggaaggtgngtagctgaaggccgggcc

SEQ ID NO: 8711 - DNA, 592 bp, Homo sapiens
atttttagtttttcgagtacaccgtcccagaaagaaatacgctataacacccaccagcctgagggctgcattgctgtggaagcaggaatggatacccttatcatgcatctctgcgaagawwctgatsmcywgmswrtcakwmkktyatcttgywgkaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatc

SEQ ID NO: 8712 - DNA, 682 bp, Homo sapiens
aattccgttgctgtcggctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattktcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcaggcctcgggggcccagctatgtacaacgaagctgtcgaaggagaagacaataaagtcgtccgcagctgctctgtgtgtttctc

SEQ ID NO: 8713 - DNA, 581 bp, Homo sapiens
aattccgttgctgtcggaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatsacttgtgccatgggtattcgcttcaagtcttactgctccaaccttgytcgcactttgatggttgatccttctcaagaagttcaagaawattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattcccgtgaaggctccctagtaatcaatagcaaaaatcaatacaaacttgaagaaaggaatggttttcagcatcaatttaggattctccagacctgactaacaaggaggggaaaaagccagaagagaaa

SEQ ID NO: 8714 - DNA, 594 bp, Homo sapiens
aattccgttgctgtcggcactggtggcaagaggctgctgatccccgttgtgcctggtgtggacagcctcaactcggccatggcggcaagcatcctgcttttcgaagggaaaagacagctgcggsggaggtctgggaasttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtscycagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagc

SEQ ID NO: 8715 - DNA, 859 bp, Homo sapiens
  misc_feature 673, 737, 844, 858: n = A,T,C or G
aattccgttgctgtcgggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggayacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttartgggctattaaacttggatttttctttttattaatgcagtatgtnctttttatycaagtatgacttgttgagaactatagtaatatgatttttaagagatttatgttcncttaaaatgtgaattgtacttctgagctgcttaatcaggycatttatatttgttaagaggaataccagatcactcatatcccactgaatctgaggtttataatcccnccaacgatgctggng

SEQ ID NO: 8716 - DNA, 988 bp, Homo sapiens
aggcgcggtgccccagagtggggtgcctgcactctcagcttccacaccctcaccctacccctacatcggacacccccaagyatgtmggswsgssrgaagccacagtcgccgccgccagggscttgctcctggctctgtcctttgcttccctccgtcctcgctcagttgtgatccagcagcccccctccccactgcctccccagctctcagtgaccccgactgtctcctgacttagccgaggtaaggtcagyscmgcagacagggccagaytgrggwgtgssgskcykwscyrgrcacatsmsysasgscyctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctcttttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaa

SEQ ID NO: 8717 - DNA, 854 bp, Homo sapiens
gccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttaaraggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaggatgtgtcattggtcatgatatttgaaaaggggaggaggcccaagtttttcccctttatccagtgattgggaaattatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgatttttttttttttttttgtacagagcttttaagcattaaaaacagctaaatgtgaaaaa

SEQ ID NO: 8718 - DNA, 637 bp, Homo sapiens
  misc_feature 572, 614, 620, 634: n = A,T,C or G
ctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggtgawkywgkwttymctcaacatymtyctcagtgtstttgccattattctcggggctttcatagcagctgggtctgaccttgcttttaacttagaaggctatatttttgtattcctgaatgatatcttcacagcagcaaatgggagtttataccaaacagaaaatgggacccaaaggaggctaggggaaatacgggagtaacttttttctwacaatggcctggctttcatggattattccccaacttctttatttatttaggtggttcttcccactggtagggacctggccaaccagggcttacngggaatttccaacccatgggggtgggattgttggtggttttnattccncaacagttttcttnctt

SEQ ID NO: 8719 - DNA, 300 bp, Homo sapiens; identical to SEQ ID NO: 981

SEQ ID NO: 8720 - DNA, 923 bp, Homo sapiens
gaaagaactccctggctgtagctcctatgtaggttwaggttgagacyctggattccaccaatttttaaaggttaccatctgaggtttckratcatagtctacttttgaagcagctgctgctrtttctttattccattgaacaccctggaattgacataattttatctatcagcatttctccccttttagtttatttaataattaacccggtctccagggcagttttcatatgaccatgtgtatattcactgctcacgaawaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaa

SEQ ID NO: 8721 - DNA, 1125 bp, Homo sapiens
  misc_feature 311, 1020, 1037, 1098: n = A,T,C or G
aattccgttgctgtcgcagacaccttctcctatggtgggcatgaagacttttcaaaaatgattgatgaagctgagcccctgggctacccagtcgtggtgaagagcacacgaggccaccggggaaaagctgtttttctggcaagagataaacatcacctctctgacatctgccatctgatccgccacgatgtgccctacctgttccagaagtacgtgaaggagtcccatggaaaggacatccgggtggtggtggtagggggccaggtcataggctctatgcttcgctgctccactgatggacggatgcaganaacatgctcgtctcggtggcgtgggcgtcaagtgtccgctgacagaacaaggcaagcagttggctattcaggtgtccaacatcctaggcatggacttctgtggcattgatctccttatcatggacgatggctcctttgtggtgtgtgaggcaaatgctaatgttggcttcctagcctttgaccaggcatgcaacttagatgtgggtgggatcattgcagactataccatgtccttgctgccaaataggcagactggaaagatggctgtcctcccaggactgtcgagtccaagggagaagaacgagccggatggctgtgcttcagctcagggagttgcagagagcgtctataccatcaacagtgggtctacctctagcgaaagtgagcctgaactgggagagatccgggattcctcagcaagcacaatgggggccccaccctccatgctgcccgaacctggctacaacattaacaacaggattgcttctgagttaaaacttaagtgaattcctgctttttggcagcatttaaaccaaatcctactgcttccctagtagttttgagtgaataaaatctggactaatgtgatttcatttgcacagaaactagaaatcccatctgggcactcagcatttttyctaacgatgatttaagcaaatggcctagctttgtggtttttacaaagacaaatataaaaacactcacaagnacaacgtcccgactgancaatatgagactgatgtctgctgtgagcacgtggatattacggctgacgctaaggcactgnctctgctgttgcttctgacttttagca

SEQ ID NO: 8722 - DNA, 620 bp, Homo sapiens
aattccgttgctgtcgtggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaaacacactgtaatatttcaagtgtatgccagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatat

SEQ ID NO: 8723 - DNA, 573 bp, Homo sapiens
gtttatgggtttacattgtcatgtctccacaggacaatgcacatggtatgtttgtcagaacccagttggagttttgtttcccagcatccaaaggaaatccctaactttcattttttcttcccgtaagccagccccgaacacttaccttataagcccatctctacctgaattagcaatcatggataagctcaataactgatcatttccttatccagtttaaaccatatatattttaacactgtctctttttcacacacactagttagctaagaatgagctggggggctgggcgtggtagttcacgcctgtaatcccagcactttgggaggcggaggtgggcggatcacttgaggtcaggagtttgagaccagcctrgctaacrtggtgaaaccccgtctctactraaaatgcaaaaattagctgggtgtggtggcaggcatctgtaatcctagctactcrggaggctgaggcrggagartcccttgaacccgggaggcagaggttgcagtgggccaagatcacaccactgcactccagtctgggtgataaaacgagattccgtctcaaaaaaaa

SEQ ID NO: 8724 - DNA, 539 bp, Homo sapiens
cttctgtagatactgaagaaacaattgaaccttatacaactgaaaagatgagtcgagttcctggaggatatttggctttgacagagtgctttgaaattatgacagkarawwkcwrcaaymtycaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctataccgtgtatttttggacctatcctcattgccctgtatacctttaagcaagccagtggaactcttaagactagatttaatgactccgtatttgaacacctctaacagagaagtaaaggtatacgtttgtaaatctgggargacttgacttgctatttccattttgggkatcatatggtacccttgaaggaggtttagggttgggtacttycagtggaggcctcccmctgggaaaccaagctggcagtttgttt

SEQ ID NO: 8725 - DNA, 672 bp, Homo sapiens
  misc_feature 626: n = A,T,C or G
aattccgttgctgtcgataaaataatgcatgtaaggccctcagcatagtgcctggcacagaattactgctcaaatgttagctgtcgtattaatattgksacktttgcacrckkatgtacatttsctgttkatsyakgctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcargccttttttgtagagtttagaaatgaagtatttgaatcaatttagtatctcctttactatgtttctccttttaatctcagccaacccccwacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttggataaagaaaatnaattggatgatgtatattttatgtttccttttagcctctcttaaaa

SEQ ID NO: 8726 - DNA, 424 bp, Homo sapiens
  misc_feature 309, 419: n = A,T,C or G
tgtaggcacaagattttcttgctagcggaatgtgaaccaaaaagtgtagaggccaatcagtaaaaatattcaaagccagttttgttgttttcagcagttagtaactatcagtagatgaatatttactaggaaacattggtcttttaaccactttgggcatgcttcttatttagtatgttcatcatgatttagtatcatgacattcagcgaacatttattgagtgcctactgtgcactagggactagtaagcatgttaagtttgtaagctttgttgatttccaccacaaacccataggacctcaggttantctcataattgaggaaactgagattcccagtgttgaatgaaagccacacagtatcacatggccaatatcatgtgattgcagagtcaggactcaaacccagctcttaaccnccacg

SEQ ID NO: 8727 - DNA, 300 bp, Homo sapiens; identical to SEQ ID NO: 6239

SEQ ID NO: 8728 - DNA, 908 bp, Homo sapiens
  misc_feature 825, 838, 848, 879, 894: n = A,T,C or G
cttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttracagaaaatatattttaaaaattttraccamttgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgaymggagtttttttggccaaagctggcatctgacttgccacattcctctgagtctggagtagccgcagggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataacttttgttcttataagtgataagctnttataaagatcanaggaaaactngaaaaaatgtaaaatgtaggacaatttgtanaacaaacttgcattngagatgtttttgat

SEQ ID NO: 8729 - DNA, 476 bp, Homo sapiens
ggaaggactacggatccgcaggaagaggcagttgggggccaggggcccagtagaggaggctgagctccttccaactcctcagaacctccactctatggatctggacctctggattcggctttctccctgggcactgccttcaggaagacgttgagaattgaccttacacaatcccagcgccctcctcacaggagcctttcactttacagtggcaaggggctggttctggagaactggctgatgctctgaatttcttcatataccccacatttgactttggcttacactgtacaattggagatgttgctacaggtccctggagatgcaatcagattaagcgtagaaagcattgccaattgggaaagtcaaaataatttattttttttccctttcccctaccccatccccagccaagatttctttcaagatatcgcatcattcttaacaacattcttacccccactgggtccccattt

SEQ ID NO: 8730 - DNA, 1648 bp, Homo sapiens
  misc_feature 885, 1565, 1567, 1635: n = A,T,C or G
aattccgttgctgtcgcactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagccygctctgmgggrkgcccagctcatgggcactgycccttcagctagcctgcctmcgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggartccgtcccnaaaaaaaagaaaagagaaacagctgtcacctcccgcagacccaaatcctctctctgagcaccgtcatccaccacatggctgggcctggctcccaggaccagtccagtcctctagtgccttatctgaggctgcagcgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcagtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggaagccaggccccgagacggaggtgggggcagcacgtgcctccacagccaccgctttcccgcctcagcagcccaggcctcctggcccagccctgcctgggacagtgctytyccctcacccgggaagntnggaatyctcctgcccgagaggaaggcagacggcacagggacaaccytgccacttgggattttggcttncaagttggttttt

SEQ ID NO: 8731 - DNA, 956 bp, Homo sapiens
  misc_feature 909: n = A,T,C or G
agaatacaagccaaaacatggcttcaaaaggtcagctgcatcttcactggattacagaattcttgctgactctcagaagaaattgttggagagaatagtcatacckrcwykagmwrgagaataaatwgcctttcctaaattcctctgcttcgctcctttcctggcgttgctctggaaccttgttggtgtctgtgacccaatgactgttagggtcagctagcttcaattgcccctgcactggaagcaaggtttgtcagtaacaccaattaaaatactaccagtgtaagtagaaggtgtgttttgcagatgagaaggtgctaagatgccttgcttatgttctctgtgttgctgtaataccatgaggggtatgttgtggcaaacctggcctttragatcaagacgaaccccacctgccctgagaagccgtctgctaccaccacagcctacccgaattggkcctgtcccctaaacccctcacactgagaactgcttgtgtgggagagagctggttgggttgatcttttccgagtgtgacttacctccttcaaggggatgtttaagcttctcgggcagaagtggtgtgtctattcctgacaccaaacaccgtggtatatgtggttgtcacactcagctagtgatgataaaggtgttcttaaatatgttagctttcagttttcctgaggaagcaattttatggatacttccccctccttctcaagtgaggaatagcagagcaaattttatttggaacttaaaccaatagttataaccaatagtttcaacctcctgcctcaccactgsttccttcctgagctctttccccacacctcaaaaagagtacaaagtgattccatctgcagaggtaaattctttgtttaaaaaagtactgtttttcttatcttttctggntctcctaggtatcagaacaaggtttattaggaatccttaaaaaagta

SEQ ID NO: 8732 - DNA, 300 bp, Homo sapiens; identical to SEQ ID NO: 6259

SEQ ID NO: 8733 - DNA, 903 bp, Homo sapiens
  misc_feature 849: n = A,T,C or G
aattccgttgctgtcgaccccaaccctctctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctkttgtcccagctactcaagaagctgagatgggaggwtcctgagctcaggaggtcaaggctgcagtgagccgagattgttgccactgcaytgcagctkggggtgacagttgcaagaccctgttttcaaacccaaacccaaacccacacacacacaaacacacnttwcacacacacacacacggggttcccattggttggccggggtttccccagggg

SEQ ID NO: 8734 - DNA, 524 bp, Homo sapiens
aattccgttgctgtcggcgcggaggagaagtggcgtcgagtccggccgggcagtagaggaaattgcggtagtgaccctcgggcctcgcmatgaagagccgctttagcaccattgacctccgcgccgtactcgcggagctgaatgctagcttgctaggaatgagagtaaacaatgtttatgatgtggataataagacataccttattccgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgt

SEQ ID NO: 8735 - DNA, 1081 bp, Homo sapiens
caagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggttaaaaaaaaaaa

SEQ ID NO: 8736 - DNA, 1516 bp, Homo sapiens
aattccgttgctgtcggtcccacccccacctcgccggagtccggggcggccccggtgtcccctccgagcctgctgcactccrcrtcyysmywscarskctyswssycyyakgkrrrtstcygamywgrycygtcycwgsagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggcaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaatgggtgttgactgaggaatcccccttgcttgtcttcttttg

SEQ ID NO: 8737 - DNA, 888 bp, Homo sapiens
  misc_feature 868, 873, 880: n = A,T,C or G
aattccgttgctgtcggcagctggatggacactatagcaaacatcaatcaagagctcattaaatatgaattcttmyyygrmrcmrstcgaagtgaagaagacttaaagaaataccccaagtacccctggggrrgagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtggtttggnggccnttttggngccttttt

SEQ ID NO: 8738 - DNA, 300 bp, Homo sapiens; identical to SEQ ID NO: 6301

SEQ ID NO: 8739 - DNA, 770 bp, Homo sapiens
ctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttcctgtagggaagactcccagcacttctggaactgtgcttctctttatttttctacttctcaatttgatggttcgattaaagccttctagtatctcaatgaaaa

SEQ ID NO: 8740 - DNA, 603 bp, Homo sapiens
aattccgttgctgtcggtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaattttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggagtaatgcaacagatctccttagaaaattgcacacagatggtagctgcacagcttgcatcaattggttggattacccaagtcagcacattattgcaatttgaggagccttggat

SEQ ID NO: 8741 - DNA, 685 bp, Homo sapiens
  misc_feature 575, 580: n = A,T,C or G
gtaaggcctgccttttacacaccagttgtgtgtttgttagtggctgctggatgccagtccacaccctcaaacacctcacagtcccaaacggggtgctcctacaggtcccagggtcctgttagtggaagaaaggcagttccaggaagtcttccctctagccttcatgacaggaagtagtttaatcctctgggaaatagacttgcagccctgggaagaaaagagttgttcctccttggggacatacaccatcatctgggctatttcatccagtgtctcttctttatacaggagctcctggctcaggaaggcatcccgtgcacacagcctcacgtgacggtactccaaaggcaggaaggggatgaagtagtcaatcaggttttccttcacaagacggctgtgccaaagccattgtctatggtctccacaatctccgcctggaggtggggctccaggtgttccatcgtaatttcttcccgggaccatccagccttgagcaactttaggaccacctcattgattatatcgcccctgagattactgagaaacagaaagatagtccatggagactcagcccnttgtnctcaggggcccggcgttctaagtgtggcccaaggacctccagcagccctgggtgcagcttctccgcttcatcgaagatgaacagggtctggtgcagagctgctgc

SEQ ID NO: 8742 - DNA, 583 bp, Homo sapiens
agtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttttttttgtttgttttagacggagttwcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattgacaaaaa

SEQ ID NO: 8743 - DNA, 958 bp, Homo sapiens
  misc_feature 24, 49, 901, 912, 925, 932, 938: n = A,T,C or G
atcgagaactcttactacaagctncttgttctttttgcaggatcccatngattcgwrkyssgttgctktcgccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtckactcaaccatgtakccatagcagtgccaratttggaawakgctgywgcawtttataasaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttctacaatggggkgnaattgaatgtnatggtgtttagcngtggacnaggggnatgtgtgtgatggatgggta

SEQ ID NO: 8744 - DNA, 1583 bp, Homo sapiens
  misc_feature 1157: n = A,T,C or G
ggagaagcaactgacgacagatgctgcccgcattgtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggcmrsccaggagctgggacgatccttgcaggaacctcaggattacagcagstgcagatggcaggagctmcaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctggggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggnaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattgaaaaaaaaaa

SEQ ID NO: 8745 - DNA, 1518 bp, Homo sapiens
  misc_feature 1431, 1470, 1507: n = A,T,C or G
gaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgaccatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcgtccttctcagaaggagattagacacaacatatggtaaagccaaaagcaggagcttatagatttgcatgaaatgaaggcgttcttcagacttcttcataacccacgtgacatcagcacttccttttcccactggtattttctacacttccgagactccgtttctgtctgagcacggcaacacaatcattcctgtcagggtgttcacttgctttttatttggcctgcattacattntaaattggttggtaaagaaaacttggggcacaagtcctngggaaattccaccatggaccaaagcggagattcttcnaggctggtttg

SEQ ID NO: 8746 - DNA, 386 bp, Homo sapiens
  misc_feature 352: n = A,T,C or G
gggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccngacatcagatgtttttattttatattattattat

SEQ ID NO: 8747 - DNA, 485 bp, Homo sapiens
  misc_feature 424, 429: n = A,T,C or G
ctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagrcwmsmkcttcaatgctattgccggaaactgggagcgcaagaggcctgtctgggtgatgctcatggtcaactccctgactgaagtggacattaagtcccgtggagtgcctgtyttagacctgttccttgcccaggaggctgagcggctgaggaaacagactggggcagtggaaaaggtggaagagcagtgccatccattgaatgggttgaacttttcacaggtcatctttgctttgaaccagaccctcctgcagcaggaaagnctgcnagcaggcagtcttcagatcccctacacgacggaggatctcatcaaacactataact

SEQ ID NO: 8748 - DNA, 766 bp, Homo sapiens
  misc_feature 735, 744: n = A,T,C or G
aattccgttgctgtcggaaaatattattatgttagttttagcgtggaaattggaggctgaaagcatgggattttttaccaaggrmrmrwggttaaagggaatgacttcattacagtgtgactgcacagaaaakttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggrgcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagamcantaawgrttncaggattkgtgacaaaggcaaa

SEQ ID NO: 8749 - DNA, 401 bp, Homo sapiens
gtttgagctcttgagccagtgacttccctgcacgttcagctttctcctttgtgaaatggtaatagaagcacgctgcacttgggattcttgtggattacatgtgagggtcttagaaacacttgatgtgtaagccaactattatgtattactgtatatggaacacaagggatgtagccaaaactaaatgcaagtttgtgcctcagatgtcttcctatcagaacagagtcaaatccagattttgatgctkwratgtgacagcttattcagatttagaaaaacttttggtatgggccaaagaaaacatatccttaaggggatatgcccctaggccctcattttccttttctgtctgagcaattaaaaaaaggaaaatgaggcctaggggccatatccccgtcgta

SEQ ID NO: 8750 - DNA, 475 bp, Homo sapiens
  misc_feature 469: n = A,T,C or G
aattccgttgctgtcggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggtgagcagtgatagaggggacaggagggcagggcagaggttcccagtgccctgtggccaagactcgagccagtttagagcagctggagtaaggggactaagggggacaggtccctgggggaagcagagggcctnaggcat

SEQ ID NO: 8751 - DNA, 1731 bp, Homo sapiens
  misc_feature 1620, 1634, 1688, 1731: n = A,T,C or G
gacatttcsrmwmgmkcytttgtgaatttccagatatgggattttcctgggcaaatggactttttkgacccaacctttgactatgagatgatcttcaggggaacaggagcattgatatacgtcattgacgcacaggatgactacatggaggctttaacaagacttcacattactgtttctaaagcctacaaagttaacccagacatgaattttgaggtttttattcacaaagttgatggtctgtctgatgatcacaaaatagaaacacagagggacattcatcaaagggccaatgatgaccttgcagatgctgggctagaaaaactccatcttagcttttatctgactagtatctatgaccattcaatatttgaagcctttagtaaggtggtgcagaaactcattccacaactgccgaccttggaaaacctattaaatatctttatatcaaattcaggtattgaaaaagcttttctctttgatgttgtcagcaaaatctacattgcaacagacagttcccctgtggatatgcaatcttatgaactttgctgtgacatgatccgatgttgtaattgatgtgtcttgtatatatgggttaaaggaagatggaagtggaagtgcytatgacaaagaatctatggcaattatcaagctgaataatacaactgtcctttatttaaaggaggtgactaaatttttggcactggtctgcattctaagggaagaaagctttgaaagaaaaggtttaatagactacaacttccactgtttccgaaaagctattcatgaggtttttgaggtgggtgtgacttctcacaggagctgtggtcaccagactagtgcctccagtctgaaagcgctgacacacaatggcacgccacgaaacgccatctagtctgaatcccagcgtcggggctctgtgccagcttactcttcactccagggtcggatgccacgtgctacaggacatgggagctgctgcttgtgggaatctggtgcctgttccactagagacaaggggtagagtttctcatttggatgaaaaccccttcaactggtggtgtacaactgaagctactatatcttttttgaaaatggcaaaaaaaaaaaaaaaaaaattctggagaccacagaactcaagtgtgtgtttctcctcttttgggtcccctttaagtagttgggatattttggacctggagataacaccagttacccatccttaccagggaatgttgccatcaattccagttgaaaataatagaaaagactgaatttttatatgcttcacttaggctttcatttgagtagactctaaaaattctgccttgcttaagttctaacactgcctctcagatttcagttttggacattgcacaactaagaccttttaaacgcatttgcttgctaactcggaagacacatagtctgcagcaagacattcctatattgaagaaatgagagaaaattttatgctgcatcaggtggagagcaaggctcaacggtggttgcattagttccctcggaagtattgaaaaaactttgaaatggaagaaaatttttggcacctatgttctgagtaccagatgtctggggttctttcttctgcattaggataaatgnatcatgctcagtgntaacaaaggggaattaaaagtttttcccacagtccccttctaggggaggaaaanccattggtggccactggaatggttagcttactttaatcttggn

SEQ ID NO: 8752 - DNA, 300 bp, Homo sapiens; identical to SEQ ID NO: 7107

SEQ ID NO: 8753 - DNA, 300 bp, Homo sapiens; identical to SEQ ID NO: 7637

SEQ ID NO: 8754 - DNA, 300 bp, Homo sapiens; identical to SEQ ID NO: 7643

SEQ ID NO: 8755 - DNA, 300 bp, Homo sapiens; identical to SEQ ID NO: 7121

SEQ ID NO: 8756 - DNA, 908 bp, Homo sapiens
  misc_feature 863: n = A,T,C or G
aattccgttgctgtcgggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactactaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccntgaatttctttcttttataaattttctcatttaaaaatcaaaaaa

SEQ ID NO: 8757 - DNA, 872 bp, Homo sapiens
aattccgttgctgtcgaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacmagggaatactattraaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctcgtgattccacctatgatgtttgatgcagaacaaagacgagtcaagtycattamcatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtkttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacaraaaaaaaagaagaagaaaagaaagatgaagagga

SEQ ID NO: 8758 - DNA, 448 bp, Homo sapiens
cgcgctttgaaaaaatgagatcagcaaaacgcaggcaacagacctaatacatttcaaaacttgatatttcattttgcgttttagctagagaagttttccttgtgacttactaatggctgcaatgccaatgattgtaagaaaacaaacaaatttatcatgaaattctccttgtcattttatamrtssmyattttaacatcatttatggttccagagatgcatacacttttttctgacaagaaaaagtaaaaggtgatgagggcaattctgtcctactgtttttacaggcctttttcaaatgcagattttgtcataaagttgttatagattttttaaaatgcttttttaatattaaaatgtacttttacattcttaatctttttttagaaaggaaaagttttcttcatttagctgctgatttaaaagtaaagttctccaattcttaaaaa

SEQ ID NO: 8759 - DNA, 498 bp, Homo sapiens
  misc_feature 324: n = A,T,C or G
aattactagtgggggagtaaggggacaggccattgggcatactggagcagcatttactcagtcattgagaaaaggatggaacattcaataaagggtgctggacacatttgtgctctaaaaattttgtgtttcacctattaatttatccctccccttagcccctggcaaacactgatctgtttactgtctccatagttttgcctttcccagaatgtcacacccttggaatcatacagcatgtaaccttttcagattggcttcttttacgtagtaatatgcatttaggattccttcatgccttttcctggattgatagctcatttntttttagtcctgaataatattccattctatggatataccacaattgatccattcacctactgaaggtcattttgattgcttccaagttttgataatttaaaaaattttttaagacagggtgtcattgtgttttccatactggtctcctgaacacctgggctgatgtgaacccct

SEQ ID NO: 8760 - DNA, 300 bp, Homo sapiens; identical to SEQ ID NO: 7161
  misc_feature 265, 266, 267, 288, 289: n = A,T,C or G

SEQ ID NO: 8761 - DNA, 787 bp, Homo sapiens
  misc_feature 663, 690, 694, 722, 734, 742, 751, 766, 778, 787: n = A,T,C or G
gccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcmatatttaatgtctttgcaactttatgctgggattgtttttaaaaaaactttaatgaggaaagctattggattattattatttcttgtttattttgccatggctttagaatgtattctgtatgcctctcttttgctctgatactgttgctcctgctattctgattgtgcagactgtataattagtggaaaacaatccttggtctgactgtgactttggacactcagtnaccctggcttggaccactctcaggagncatncttgagagagtgggtgtagttacatttntcagtaacatgnatttaaantcccttganaggaagaatagagtnacagaatagacncacagaatn

SEQ ID NO: 8762 - DNA, 703 bp, Homo sapiens
ttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatrtctctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctcaccccagtgatctggcctcagacaactactggtgagcaagctggacccascmtgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtt

SEQ ID NO: 8763 - DNA, 1018 bp, Homo sapiens
  misc_feature 961, 1005: n = A,T,C or G
aattccgttgctgtcggaaactccctggagcgacgcagcgtccggatgaagcggccttcctcggtcaagtcgctgcgctccgagcgtctgatccgtacctcgctggacctggagttagascwssaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccgagcggacacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttkttccaytgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttyytsgttgtacagctccaccttttagaggtcttactgcaataagaagtaatgcctgggggacggtaatcctaataggacgtcccgcacttgtcacagtacagctaatttttcctagttaacaatttgtcatattammmmntgcacagammaccattgggggggattcagaggtgcatccacggntcttcttgagctg

SEQ ID NO: 8764 - DNA, 587 bp, Homo sapiens
atcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaartkygrmwkmksatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcat

SEQ ID NO: 8765 - DNA, 300 bp, Homo sapiens; identical to SEQ ID NO: 6450

SEQ ID NO: 8766 - DNA, 1187 bp, Homo sapiens
gggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcrggaactgaagttattgcttcatcgttctactctgttgttttcacaagggcaaaatgtatgggttatgtgggataccttacttactatgttaggccatgcttttaaaggtagcaatgaatcgagcccaagtttgtttgatatccagttccargtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatatkactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacaagctcttaatgtacagggctttccctttctaatcggtacctcaattacgtggggcctgcaggaatccatctac

SEQ ID NO: 8767 - DNA, 1402 bp, Homo sapiens
  misc_feature 431, 1332, 1356, 1374: n = A,T,C or G
aattccgttgctgtcggccactgcgcacggcctggggaggttttatttcttgacaaaggtatttgatactcgtgcagtccctggagggtctcactggagagacaacatttaggctgagatctgattaacaggaggcagctgcagtgcagaggtcaaaagggagggtgttccaggcagagaaaacagcctgtgcaaaggccctgaggmagaaacaaactctacttgaggtcagcctggttagaaagcccaactcaaaatagaaagtattacatgataaggtctgaggcaggctggacccagatcttacaggaccttgttaataaggatcccatttggtcccccacagtcctgagaagcgggcagggctgtgggaaacagcagatatttagtggtaagcctgagatcagaacccaagtctgcacttcctagtnacgttctccctgtagtgctaagcccagagacctgagctgttaacctagaacagtgtgcttcctaagccttaatgtgcatacccatcgcctggagctcgccttaagatgtaggttctgcctgaagcccaagttcatttagtatgtcatggttaattcagagtaaaatcaagagttagtacttgatttatgcttgttatataaagaaagagacaacttcactgtatgatcattttgtcacttttcaaaagcatttaattcccattcaattgaaaatgtttcaagaacaaacctgtttggtcattttattgatattgcacatttgtatatgaataaatttttgcaaattaarraaraaaagatgtaggttctgaaacagggtgaggtccaggatcctgcctttctaaggagctcccacgttgtgcagttgctgctggcccggggaccacattgaatgacggctctacgtcctcatgcctccagctgctgccctgtacatgtccaactgcacggagcactttacatcctctaaaaccacagtaaattgctccatttcctaaattacctcttcaagagaagactggttttgatgtcatttttaaataaaggagaagttgaatttcaaaaccaagtggaacaggaatgatgtgacttggttgacattgattttaacatttggttcatggtgagtgttttgctttattgttaaaaactcgccactaaaagcatgacagaacattttatcaaatgatggcgtcatcctttaccgtaagtttgcccctagcaagacagctcttcctgagacgtgcttgcaggcccctatgtgggttttcccaccgcagtcatcatccgtcatctgtgaccttgctgcatttactccatgctcacaccccagcagcccgcnggggtttgggcatcgcccttcagngggcatcaaacttccccnggtggcaatgttacaagagttaggccag

SEQ ID NO: 8768 - DNA, 343 bp, Homo sapiens
  misc_feature 317, 322, 335: n = A,T,C or G
tttagatgaagtgctgagaatatttagaaaaagcgctttaaaaagcatctagagattatcatgaaaataattggagmmaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaamtgtacagcattgggagnagttnttctttgagacantgggcagt

SEQ ID NO: 8769 - DNA, 509 bp, Homo sapiens
gccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgtcctactaaaaagaataaatgttggcagtgaattaaacaatttttcaaatga

SEQ ID NO: 8770 - DNA, 485 bp, Homo sapiens
aattccgttgctgtcgggcagtggtttcttagatgttgacaccaaaagcacacgtggcaaaagaaaaagcaaagtcaacaccatcaaagatgaaagtgttcgtgcttcagggaacactatcaagaaagtgaaaagacaacccaagaatgggatagtattttsyamwwcwmmtawmtkytrmgrmkctygayatctattctagctataggactcttacaacttaataaaagagaaaacccacctgggtgcactggctcacgcctgtaatcccagcactttgggaggccaggcggacggatcacttaagcccaggagttcaagaccagcttgggcaacacggcaaaaccctgtctctacaaaaaataccaaaataattagtcgggtatggtggcgggcacctgtggtcccagctaatcgagaggcagaggtgggaggatctcttgggcccaggaggtggaggctgcagtgagccaaaatcagaccat

SEQ ID NO: 8771 - DNA, 1260 bp, Homo sapiens
aattccgttgctgtcggcaactgtgacctggagcgctttgctcaggtcttggagaaggaactgcccctgtatgcgcgccccatcttcctgcgcctcctgcctgagctgcacaaaacaggaacctacaagttccagaagacagagctacggaaggagggctttgacccggctattgtgaaagacccgctgttctatctagatgcccagaagggccgcatacgtcccgctggaccaagaggcctacagccgcatccaggcaggcgaggagaagctgtgattccccccatccctctgagggccggcggatgctggatccggagccccaggttccgccccagagcgtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggcctctggttcccaggstgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacsccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtcctcctagcctgtgtgcaaaccacccaagcccaccctgaccccagarccccacagccccactgtggccgcttgatcccccacgccaaccccctggcccattgacccgcctcatctgttcattcacttatctaagctgagggtgtagcaggtaagatgccgcagcccctgcctccaatgtgctggttcagccggggcagtgcccatgtgaatctggcaaggtgtttaacagtgtgggcttgaaagyccaaaccaaaaaaaaa

SEQ ID NO: 8772 - DNA, 649 bp, Homo sapiens
  misc_feature 616, 625, 632: n = A,T,C or G
aattccgttgctgtcggttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaaagtgcagctccttctctccacccaccacagtgattctccttatcctgctgtgctttgagggcctgctcttcctcattttcacatcagtgatgtttgggacccaggtgcactccatctgcacagatgagacgggaatagaacaattgaaaaaggaagagagaagatggggctaaaaaaacaaaatgggatgaacatgaaagccgtttttkggccaccccttcttytctagggcttggggccagcccctttttgccacggscaggaccaagggggargggmagaccccttaccagtatgttgggggttttaagggggcccccgacccggcatttgggccactttaggncacaagttnccccaancacaagcactttaccgt

SEQ ID NO: 8773 - DNA, 862 bp, Homo sapiens
aattccgttgctgtcgaaaccawgratctwcwgkyrgmawkwaayaaaaagsaatckgctatctcagtcaswwcatgtattcagyayttkcttctmtctggaytammttraagttactssssktymccaagcagtgaaacgaatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggrctgttcaacccacacaagaacaaacgctaactaatattttttttaagagattcttttccctatgaatgtgggaaatgcaggatttattctgtga

SEQ ID NO: 8774 - DNA, 655 bp, Homo sapiens; identical to SEQ ID NO: 6010

SEQ ID NO: 8775 - DNA, 844 bp, Homo sapiens
  misc_feature 296: n = A,T,C or G
gtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccascaggacmtggascwgtacctgtycactggstactctgmagattgcagwgyggygagmycmtwagncagcatgtcatccatggaagtgaacgtggacatgctggagcagatggacctgatggacatatcggaccaggaggccctggacggtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtgggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaa

SEQ ID NO: 8776 - DNA, 415 bp, Homo sapiens
aattccgttgctgtcgctggtgatgagatcgggaaagtgggctcaggaggtctggatctgtgatgagatggggaaagtgggctcaagaggtctggatctgtggtgagatgggggaagtgggctcaggaggtctggatctgtgatgagatggggraagtgggctcaggaggtctggatctgtgatgagatggggaaagtgggctcaggaggtctggatctgtgatgagatgggggaagtgggctcaggaggtctggatctgkgrtggrgatctggagtggaagkggarytcakkwgktcwkkrtctrtccttttgtattgattgaattttttatatatatatgtgaattttcacaataaaatttttttccaaaataaaataaacaaaaggggctttttgcaacccaattcctatct

SEQ ID NO: 8777 - DNA, 647 bp, Homo sapiens
  misc_feature 597, 609, 617, 622, 630: n = A,T,C or G
cacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagcycaaggctcttcttgggggaacwgmcwsmgtcccagrgcctgtacgagacgatcaacgtgacgatcccccctgggactcagacagaccagaagattcggatgggtgggaaaggcatcccccggattaacagctacggctacgagaccactacatccacatcaagatacgagttccaaagaggctaacgagccggcagcagarcctgatcctgagctacgccgaggacgagacagatgtggaggggacggtgaacggcgtcaccctcaccagctctggaaaaagatccactggaaactaggccgggaagcagcagcccctccaagggncagggcacctgngacgacgngaggnttccagancagcagcactgagctcc

SEQ ID NO: 8778 - DNA, 870 bp, Homo sapiens
aattccgttgctgtcgccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttattcktgagtaycwgrayrmyrcytatcywkgraggaagctgtttcmatatgacccttatgaacgagctcgccaaaagatgttattggagctatttkgtaaggtcccacattkgacccaaggagtgcctrgtagcgttgaagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagcctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgt

SEQ ID NO: 8779 - DNA, 300 bp, Homo sapiens; identical to SEQ ID NO: 7329

SEQ ID NO: 8780 - DNA, 2672 bp, Homo sapiens
  misc_feature 2558, 2608, 2626, 2634, 2639, 2646: n = A,T,C or G
aaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctwtcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctatagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgkcggtctcctctcaccccttaatactgtkgcaagccccaaactccctaggactccttgaacatctttgagcagtttttggtgcctttgaggccacctttttggnccaaaaatgggctcccatttttccacagcggggggttttcccttaaaatnggtttaaagggttttaanaggccccntaggnaggaagnggttggccttccttaaggccaaaaaa

SEQ ID NO: 8781 - DNA, 1282 bp, Homo sapiens
aattccgttgctgtcggtggttgacgagctcggcggcggttttgctgagatctgtggccgtcggcagctggtgcggggggcagctgagagcgagaggtggatcggggcggtgtgtggccagggcmrtgacgggcaatgcsgkggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggttcagtgcagtaaggcctgtcatagaaaaaaggrtacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagggaaaataggataaaagaacaaggtgtgagaaggaatagaaggaaacaaacaggaaagatatggctgcaccatgcagtgctactatatgctgagattctacaggatgagatttttgaatagctgagcagttgcctataatctgtgatgacataaaagtatttgacctaaaatctttttatttgcaaaataataaataaaaagtgattctccctcg

SEQ ID NO: 8782 - DNA, 681 bp, Homo sapiens
  misc_feature 346: n = A,T,C or G
gcggctcttttccctcgtgactcggttgctcctggcgccgcgacggggcctcacggtccgcagtcccgacgaacccctgccggtggtgcgcattccagaagagctcccgagacatacttctctgcacagacatagcctctcggggcctggaccagcactggtgtggagctggttgtcaattatgatttccccccaacgctgcaagattacatccacagagcagggagagtgggccgtgtggggagcgargtgccaggcaccgtcatcagttttgtgacccatccctgggatgtgagcctggttcagaagattgagcctggcggctcgccgaaggaraagtcttccnaggactagcatcctcggtgaaagagcctttgccccaagcaacctgattttgacaaatctgattaaaatgtgatgctagaacagggatctttcccagtatcttgagtgggtgacccacacttgtcagtgggaggctctgggctgcctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgcaaaaaaaaaaaaaaa

SEQ ID NO: 8783 - DNA, 300 bp, Homo sapiens; identical to SEQ ID NO: 7355

SEQ ID NO: 8784 - DNA, 964 bp, Homo sapiens
aattccgttgctgtcgctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcggaggtgggatgtgagacagcccacattggaaaatccagaaaaccgggaacagggatttgcccttcacaattctactccccagatcctctyccctggrcacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaat

SEQ ID NO: 8785 - DNA, 635 bp, Homo sapiens
ccgcactatagaatacaagctacttgttctttttgcaggatcccatcgagaaaaaactggccatgcagaagtcgtccgagtggtgtaccagccagaacacatgagttttgaggaactgctcaaggtcttctgggagaatcacgacccgacccaaggtatgcgccaggggaacgacccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaartaattgctccccacatggygggcctttgaggttccagtaaaaatgctttcaacaaatgggcaatgcttgtgtgattcacaatcgtggcatttaaagtgcacaagtacaaggaatttatacagattggkttaccgmagtataatctataggaggcgcgatggcagtgataaatgtgacttatctcctaataagtatggggggtggagctgt

SEQ ID NO: 8786 - DNA, 300 bp, Homo sapiens; identical to SEQ ID NO: 6612

SEQ ID NO: 8787 - DNA, 300 bp, Homo sapiens; identical to SEQ ID NO: 6613
  misc_feature 272: n = A,T,C or G

SEQ ID NO: 8788 - DNA, 676 bp, Homo sapiens
  misc_feature 547, 627, 638, 646, 651, 673: n = A,T,C or G
cttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagggatggtgagagaaggtcagctaaatggctcatctgcagcacacagtgaaataagaggctgtagtacatgagcgagctagagaaatcaccaccgtttangaccaagctgtaaggccctactacagacagtgtttaacaagtaaactttacaagaacccaacacaattccccagaaagtnaccaatagccngaggttgnagggnccggggttgaacaacggggggnatg

SEQ ID NO: 8789 - DNA, 829 bp, Homo sapiens
  misc_feature 806: n = A,T,C or G
aattccgttgctgtcgcttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaatcctrctcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaycccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtarcgtgamatttaggttgacgtggctaagccggagggactaacccttgctcactgacttcctgttgtaaacactttccttamggggcctgggctgttttcacagtaatttcnatgaaatttaccccacacaggtg

SEQ ID NO: 8790 - DNA, 396 bp, Homo sapiens
  misc_feature 247, 293, 310, 334, 351, 367, 382: n = A,T,C or G
cggatatcctctccctcatcaaacttttctccaccaactttagcatctggttgccaccctccaaaatggccccagtgatcccatctcctaataagtacatgtctgtgtggtcctctccyacactgcataggaatggcttacgtaaccaataggtagttgaggatgtgatgcagtctgacttttgaggctaagttgtaaagaaagacactgtgtctttcctccttgttgtcttggagcgcttgctctnggagaaagccagaggttcatgttcgtgagggataacttcaagttgnccatttgggagaggtgnacattgggtgaaggaaatgaaggncctaactggccaattgnacccatgttaaagttnagtccaaccaagggnagattatttaccca

SEQ ID NO: 8791 - DNA, 467 bp, Homo sapiens
  misc_feature 407, 419, 423, 429: n = A,T,C or G
ggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgnccccatgctgtnccgncacggnaagcttgtggtccaacttctgggggcgccctgagcccc

SEQ ID NO: 8792 - DNA, 706 bp, Homo sapiens
gtcggctcttcctatcattgtgaagcagaattcaccaagcgttggattgttcacccactaatagggaacgagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacagrcccataccggagtatggcacttaytcgctctgctcctcccaaagcagttctccgacagaaatgggatgaaaatgagtcatggacacagaaagtctaaagg

SEQ ID NO: 8793 - DNA, 566 bp, Homo sapiens
cagctcctccaccagcataatgggacccagcatccctgccaaaactcgggaggtgctcgtcagccacctggcatcttacaacacatgggctttacaaggcatgtatggagtttcttgtgggcttsgsaggtgsyygtsaaggccaycwgygatctkaagccwryacwtgsscytymcmaggtcctgtgagtggagaggcacagagtgttctgggctagctgagtgtggaggctgggtggctctgatgctagccaatcactctacgctctaggctcacacctttccacctycgacttcgccagcagaagtcttgagttcaatctcattgccctggcttgggtcacatgtccatccatgaaccaatcactagactgggtgcggaaactctgatttgccaagttcgggtcatgtgtctcactaggtaagagcagaggaggatcacccccaggaagaccagagtgctctttcagaagagtgggacaatcgctggatggctctttgcaccactcactcctgttctctgctagggctgctgggactcacaaggggtaggttgtggcagctgc

SEQ ID NO: 8794 - DNA, 760 bp, Homo sapiens
  misc_feature 631, 646, 656, 670, 743: n = A,T,C or G
ttgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagctacacatgatacagatacactatatgactctgctccacctatagaatstaatacattgcagcacaactgaattccttccctaaagaaaaagtccctgcccattggtaacatccataactttaaaacactttttttggaagaagatttaaaatattttggcccatggctacagggaagagactggtattaaaaatgggatacaccaggtcagttgacacctatggaagcctccaagctacccaaaaaggaaagtggggcnatatattggactccngggatctccnaagcctggggtggntttaggcattaccggggggtaaagacctttgaaggggccagaagttggaggaaataagccggccattttggtncggatcccaccttctgg

SEQ ID NO: 8795 - DNA, 273 bp, Homo sapiens; identical to SEQ ID NO: 6747
  misc_feature 123, 124, 125, 130, 131, 135, 147, 149, 152, 160, 163, 165,166, 168, 169, 171, 174, 177, 181, 183, 187, 188, 193, 197,201, 204, 208, 210, 214, 217, 229, 233, 236, 238, 243, 248,252, 255, 257, 266: n = A,T,C or G

SEQ ID NO: 8796 - DNA, 334 bp, Homo sapiens
gttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgacttgtcggcatccg

SEQ ID NO: 8797 - DNA, 306 bp, Homo sapiens
ggtagaagcagcaaagaaagcccaccatgcagcgtgcaaagaggagaagctggctatckcrcrwgaagccaacagcaaggcagacccatccytcaaccctkaacagctcaagaaattgcaagacaaaatagaaaagtgcaagcaagatgttcttaagaccaaagagaagtatgagaagtccctsaaggaactcgaccagggcacaccccagtacatggagaacatggagcaggtgtttgagcagtgccagcagttcgaggagaracgccttcgcttyttccgggaggttctgcttggaggttcaag

SEQ ID NO: 8798 - DNA, 1078 bp, Homo sapiens
ggtgaatgccacacccttcaagattgctcgaggccagatcttgaagatactcacagggaagatagtggtggggcatgccatccacaacgacttcaaagcccttcagtactttcaccccaagtccctcacccgtgacacctcccatmkscmcsmsctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcartggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaacacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagatccgtctcc

SEQ ID NO: 8799 - DNA, 300 bp, Homo sapiens; identical to SEQ ID NO: 6822
  misc_feature 76: n = A,T,C or G

SEQ ID NO: 8800 - DNA, 441 bp, Homo sapiens
  misc_feature 349, 393, 400, 421, 433: n = A,T,C or G
ccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgattgacatcagtcaagagattgcccagttacaaagagagaaatattcactggaacaagacattcgagaaaaggaagaggcaatcatgacagaaaaccagcgaggtgcaggaattacaaaatgacctagaccgggaaacaagcagtttncaggagctcgaggctcagaaacaggatgctcaagaccgcctggncgagatngaccagcagaaggccaagctncgagacatgctnagcgacgt

SEQ ID NO: 8801 - DNA, 439 bp, Homo sapiens
  misc_feature 347, 391, 398, 419, 431: n = A,T,C or G
ccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttncaggagctcgaggctcagaaacaggatgctcaagaccgcctggncgagatngaccagcagaaggccaagctncgagacatgctnagcgacgt

SEQ ID NO: 8802 - DNA, 304 bp, Homo sapiens
gggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcrccttgaaggctcagacgtgcag

SEQ ID NO: 8803 - DNA, 921 bp, Homo sapiens
  misc_feature 638, 921: n = A,T,C or G
gaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggaagataattctcaaactctgagaaaaagtgtttcatcaaaaagttaaaaggcaccagttatcacttttctaccatcctagtgactttgctttttaaatgaatggacaacmatgtacagtttttactatgtggcccactggtttaagaagtgctgactttgttntctcattcagttttgggaggaaaagggactgtgcattgagttggttccctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaaaaan

SEQ ID NO: 8804 - DNA, 300 bp, Homo sapiens
gcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaaga

SEQ ID NO: 8805 - DNA, 300 bp, Homo sapiens
catgtacagtagctatttcctgatgaccaaatctctcaacgaatcatgttattaataaatatttttagcactcatcagtattctccaatgtgaccttctcattggagtacacagaaggaaagcaaagaagagcatctgacttctagctctggcttacagcctctctaccaggccgaagcaagagacccgcggcagcagctccccgccactcagacctgggtggtgataacctcaaagaatggctctgttttctattgacagaaaacccacttgattttgcttctgagttagcagtcagaa

SEQ ID NO: 8806 - DNA, 300 bp, Homo sapiens
atcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtggatttttta

SEQ ID NO: 8807 - DNA, 300 bp, Homo sapiens
gacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaa

SEQ ID NO: 8808 - DNA, 300 bp, Homo sapiens
acgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctgg

SEQ ID NO: 8809 - DNA, 300 bp, Homo sapiens
aattccgttgctgtcggtgaggctctggcctgcagctcgcgccgccatggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttac

SEQ ID NO: 8810 - DNA, 300 bp, Homo sapiens
atcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacgaacctccagcctctggaaagacctcagctaggacttctaaaaaaggcctggtgcagccgcttggttggggattaacccttcagac

SEQ ID NO: 8811 - DNA, 300 bp, Homo sapiens
aaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacat

SEQ ID NO: 8812 - DNA, 300 bp, Homo sapiens
  misc_feature 66, 162, 170, 270: n = A,T,C or G
tttatattaaaaaaccaaaacctcaaaaattgtagttcatgtcacgtcagtgatgactcatcttanaagtattttgtttttggatgtgtgaatgtgcatagttcttaaagtccaacattcatgtaataagacatcttgcatataacaatgacccttacgtcnaagatgtnaaatagatcctaagcctggtataactttattcaagtatccttatttgcccctaaaatgtctttaatacacattacttgggttatttcctggatgaacatncaggtatcccaatttctgtttttaagagaa

SEQ ID NO: 8813 - DNA, 300 bp, Homo sapiens
gtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaagtttggagctctgg

SEQ ID NO: 8814 - DNA, 300 bp, Homo sapiens
atctctttgagcaatcgtcttaatttccttgtcgtcaccaattatcataaccaattatcatcgtaaaggatggtaattcctttaattatacccaccttaaaaacatgattctgttccacaaacgaaaggagcacatcagagatgccttcagttctgtgtgcttgaactttgaattccatgaattatagttgcactgaggggagaatcctgtttccatcctcctggttccttctccctttcctgtccccatgtttctctgaggcctggcaatgctctctggatacttggtgagtagcccag

SEQ ID NO: 8815 - DNA, 300 bp, Homo sapiens
ctggaaagccggaattcaactctggaccctgggaagcctgagatgatgaagtcccccacaaacaccaccccacatgtgccggctgagggacctgagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccac

SEQ ID NO: 8816 - DNA, 300 bp, Homo sapiens
agaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgta

SEQ ID NO: 8817 - DNA, 300 bp, Homo sapiens
  misc_feature 73, 143, 171, 184, 253, 279: n = A,T,C or G
gcgcagcccggcctcgaagaacttctgcttgggtggctgaactctgatcttgacctaaagtcatggccatggnaaccaaaggaggtactgtcaaagctgcttcaggattcaatgccatggaagatgcccagaccctgaggaangccatgaaagggctcggcaccgatgaanacgccattattancgtccttgcctaccgcatcaccgcccagcgccaggagatcaggacagcctacaagagcaccatcggcanggacttgatagacgacctgaagtcanaactgagtggcaacttcgagc

SEQ ID NO: 8818 - DNA, 300 bp, Homo sapiens
caaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagaccccagccttgcctcgcgctgggaggggagatccagaatgaaaggcaagaaaggtattg

SEQ ID NO: 8819 - DNA, 300 bp, Homo sapiens
aattccgttgctgtcgcagaggctgggatcatggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgcagggaca

SEQ ID NO: 8820 - DNA, 300 bp, Homo sapiens
ctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctcct

SEQ ID NO: 8821 - DNA, 300 bp, Homo sapiens
gaggctcggcgctcaggaagcatggcactctggcgggcataccagggggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtaggaggctggtacaaggttttggatcggttcatccctggcaccaccaaagtggatgcactgaagaagatgttgttggatcag

SEQ ID NO: 8822 - DNA, 300 bp, Homo sapiens
aattccgttgctgtcggtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggca

SEQ ID NO: 8823 - DNA, 300 bp, Homo sapiens
agacaaagatgttggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctt

SEQ ID NO: 8824 - DNA, 300 bp, Homo sapiens; identical to SEQ ID NO: 8823

SEQ ID NO: 8825 - DNA, 300 bp, Homo sapiens
ggcggctcggagcgggctgacgggcgcatcgtcaagatggaggtggactacagcgccacggtggatcagcgcctacccgagtgtgcgaagctagccaaggaaggaagacttcaagaagtcattgaaacccttctctctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaa

SEQ ID NO: 8826 - DNA, 300 bp, Homo sapiens
atgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctgcttaccaactggaaaattttatgcatcccatgaagcccagatacacaaaattccaccccatgatcaagaatcctgctccactaagaacg

SEQ ID NO: 8827 - DNA, 300 bp, Homo sapiens
gttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcat

SEQ ID NO: 8828 - DNA, 300 bp, Homo sapiens
attgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccgcacgagtatgtgccctgggtcaccgtcaatgggaaacccttggaagatcagacccagctccttacccttgtctgccagttgtaccagggcaagaagccggatgtctgcccttcctcaaccagctccctcagg

SEQ ID NO: 8829 - DNA, 300 bp, Homo sapiens
cccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaa

SEQ ID NO: 8830 - DNA, 300 bp, Homo sapiens
gcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtg

SEQ ID NO: 8831 - DNA, 300 bp, Homo sapiens
  misc_feature 226, 248, 253, 260, 263, 274, 275, 283, 285, 287: n = A,T,C or G
gtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcanaggcagccttggagagccccangccanccctggnganatccgctccanngacaccancnangactgaattccca

SEQ ID NO: 8832 - DNA, 300 bp, Homo sapiens
cttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaa

SEQ ID NO: 8833 - DNA, 300 bp, Homo sapiens; identical to SEQ ID NO: 8832

SEQ ID NO: 8834 - DNA, 300 bp, Homo sapiens
gaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtctta

SEQ ID NO: 8835 - DNA, 300 bp, Homo sapiens
aagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctgg

SEQ ID NO: 8836 - DNA, 300 bp, Homo sapiens
gtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtcctatgggacagtgtacaaggcccgtgatccccacagtggccactttgtggccctcaagagtgtgagagtccccaatggaggaggaggtggaggaggccttcccatcagcacagttcgtga

SEQ ID NO: 8837 - DNA, 300 bp, Homo sapiens
aattccgttgctgtcgctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcagg

SEQ ID NO: 8838 - DNA, 300 bp, Homo sapiens
cttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcg

SEQ ID NO: 8839 - DNA, 300 bp, Homo sapiens
  misc_feature 140: n = A,T,C or G
attaaaggatttaaatttgaacctggctttctcacagctggacataattctaggaaaataaaatactatgtcgccacttggtcataatcatttagatggtggtgtagggcaaagctgttagaaagattgtagcgttttantctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttag

SEQ ID NO: 8840 - DNA, 300 bp, Homo sapiens
  misc_feature 20, 76, 103, 178, 225: n = A,T,C or G
gaagtctgtagatggacggnagatccgagtagaccaggcaggcaagtcgtcagacaaccgatcccgtgggtaccgnggtggctctgccgggggccggggcttnttccgtgggggccgaggacggggccgtgggttctctataggaggaggggaccgaggctatggggggaaccggttngagtccaggagtgggggctacggaggctccagagactactatagcanccggagtcagagtggtggctacagtgaccggagctcgggcgggtcctacagagacagttacgacagttacgctac

SEQ ID NO: 8841 - DNA, 300 bp, Homo sapiens
aattccgttgctgtcggcagacggctttcagagtacaataaacagggaatgagaactatttacatggaatgttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagata

SEQ ID NO: 8842 - DNA, 398 bp, Homo sapiens
cttgaacttctgggctcaagtgattctcccacctcagcctcccaaagtgttgggattgtaggtgtgaactactgtgcctggccttctacattttttttttaaccatttcatagttccctttttctttgaacacttggtccaaactcacttttcttctggattcatattttctgatctcacctattatgttatagaactgatatgttacgtttgttttcattgatgcgtctgtacttggcttcagagagcaaaacaaggccctgtgagtcactgggagccagattttggatcaaaataaatcactttctgacaagtgtagttgtctagtaatggaatgaggcagtcttcttaggaagtaatgaattccctgcaccaaaagggagaagctagcgagccac

SEQ ID NO: 8843 - DNA, 424 bp, Homo sapiens
aaaatacaatgtctaggagctatcccagggtcgtgaatcctcgagtgcaggtggggaagtagggtgatacccacctgtgaccatgacaagttttggagaccagaaactcggatagagtttctagaaccccgcatccctctcatactgcctgaagccctcctctggggagagtgtcatcacagtaccatgtggcatgcgagtgtcgtggtaatgctccccgaccaaaccaccaaaccgagggttgggctgcttattctcgctgcccaataatgagatgcagataaactaggaaagaaaggagtttatttctgtaaccaggtacggggcgaaggcgtggaaaatatcccagaccgactcagaattacagagctttccagagcttatataccttgtaagttgtatgtttatgtgtaaagtgtgcatt

SEQ ID NO: 8844 - DNA, 411 bp, Homo sapiens
  misc_feature 212, 221, 225, 226, 228, 231, 235, 242, 245, 256, 260, 271,283, 284, 286, 287, 291, 297, 304, 311, 312, 314, 315, 321,328, 333, 334, 343, 344, 346, 349, 351, 357, 366, 371, 377,381, 383, 388, 396, 406: n = A,T,C or G
gctggccagcatagtgaaaccctgtctctactaagaatacaaaaattagcaggcgtgctggcgggcacctgtaatcccagctgctcgggaggctgaggcaggagaattgcttgaacccaggaggtggaggttgcagtgagccgagatcatgctgctgcactccagcctgggtgacagagtaagactccgtcttgggagaaaaaaaaaaaaanggaaggggnaatnnanatnccanttttttnttnttaaatttaanaaanttaaaaatggnttttttaaattnntnnaaangtttgnaaatganccataannanncggttngcaaacnggccnnggtttttgnntncantnggagancagggtttnaaacnatcgtngttncnttganaaatggtnagtttttganggcaa

SEQ ID NO: 8845 - DNA, 390 bp, Homo sapiens
ggaggccaaggctggaggattgcttgagatcaggagttcaagaccagcctgggcaacatagttagaccttgtctctatttttaaaaatataacaagcacagttgtacacgtctttagttcagctgctcaggaggctgaagtgggaggatcctttgaacccaagagtttgaggctgcagcaagccatgatcacaccactgcactccagcctgggtgacagagtaagaccctgtctcaaactttttttaaaatgaaagaatccaacctttttttactctgacctgcgagagtgcagagggtctggggaacatttgcagaagcaacaggtaccagccagtgctggaaggagctcaccctgggaggtctcgtcagcctctgtccttcatggctg

SEQ ID NO: 8846 - DNA, 401 bp, Homo sapiens
ccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaagttctgtgttgcctttctcttcttagctgatgatgggagaaccagttactaccttctctaacacaggctccatcctatctcttcatctcttcttgccagtgatgttgcacctgtaaccatctt

SEQ ID NO: 8847 - DNA, 413 bp, Homo sapiens
caggatttgctttttccctgctttgaagaaaagctgaagtcaaattttatgaatactcagtagcatccgtcaagaaaaaaaaaagaaaaagaaaaatttgcatgtagggggttctgttctcaacagtgtgcgcagttttggggctacagtagggctgaggccgcacgccagttccatttcacagggttcctgtttcctagtaactgcttctactcgagccttcctcaggaaagcccacaatagcaattgagagtaaaatgatttgaaaacgtgggtgtgctgctgctgggactccaccctcagtaacgatcaggcattgttctgtcttccttgctcagggggggcacacttcaagagattaaatttactgcaggataaacagaatgcgtgttccacagcaggctaataaaacc

SEQ ID NO: 8848 - DNA, 409 bp, Homo sapiens
  misc_feature 27, 45, 102, 106, 112, 135, 189, 225, 227, 235, 271, 313,326, 333, 336, 337, 342, 361, 364, 365, 367, 369, 370, 375,382, 385, 392, 402: n = A,T,C or G
cccagcagtgtttactgaggacctggntttctagaacaggtgtgncctgtcctcttccatgttccctgggggctggtcagctccaagttgtgggtggcaganctgngtttancatgaactgactaaagacccatntggaggcaaatattaagttgccaggactgctttcacttcagggtgattgaaggncacatattgaagtacctagaatgccagaaagtgttntnttgcccanaaaacaaatcagaaaagcctattcttttttgcaacnctgttaatgattactggagttcctgaaaaatactttgtgccnccttggaagactntgaaacncgnnttccntgggattttgctgtaaatnacnntncnntggcnctgaagnttnccttggntgcctagctntaaaaaa

SEQ ID NO: 8849 - DNA, 392 bp, Homo sapiens
accacgccgggctaatttttgtatttttagaagagatggggttccgccatgttggccgggctggtctcgagctcctgacctcaggtgatccgcccgcctcggtctcccaaagtgctgggattacaggcaataactttatgtctcccctcccttatctctgggcaaaccttgtttattctctactaacttggttgtaatctgttcatcaaagtagacccttgaatttgttattctccaggctgctgggacacgttggagtggccttagaaggctgcaaaatggactgatggtttctgccttccactgacgtcccaatacgacttcctaatactagggctccagttcctgataccagaattacagggagaaaatgtgggttctgcaggggtgtg

SEQ ID NO: 8850 - DNA, 300 bp, Homo sapiens
aattccgttgctgtcggtcacttatgcctataagcgggcatacaacaggggcgcaataaatgtttgttaagtgaatgaattctttcagaactagatgggatcttagtccaactctcttatttaacgaggtccacagaggttctgcgattgtctaagaaagaaggctgtgttcatggcctttgttgtttacgtggccctgtgattctcttggctccgtgaaagtcctgatgcagacattccggccatctagaaaggcatgcagacaagccatccagctggcatgatcctgagtccagcttt

SEQ ID NO: 8851 - DNA, 401 bp, Homo sapiens
  misc_feature 301, 309, 316, 327, 329, 334, 342, 358, 370, 371, 374, 386: n = A,T,C or G
gactcggatgggagatgccattggaatcaatcaggcgtctatgagtcgatgtgttgccaatgtcactgaagcacttgtggaaagggcctcacagttcattcgctttccagctgatgaagcctccattcaggctctgaaggatgaattctatgggttggcagggatgccaggggtgatgggggtggttgactgtatccatgtggccatcaaggcaccacatgctgaagacctctcctatgtgaaccgaataggcctgcattctataaactgctgatggtgtgcgacattagagggacactantgaccgtngagacanactgtcccggnancctanatgactgngctgtgctgcagcagncttcctcagtanncancatgaagcgganatgcacaaaaaatcc

SEQ ID NO: 8852 - DNA, 403 bp, Homo sapiens
atctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactaccattttaaggagaggaaagagaaaactctggggtcagggagagaccctaccccccctaattatccacatatatgtaagaaat

SEQ ID NO: 8853 - DNA, 390 bp, Homo sapiens
caaaggtgaagcaggacatgcctccgccggggggctatgggcccatcgactacaaacggaacttgccgcgtcgaggactgtcgggtcagtatcactctgcgccggggtctcagagtctgggcactcggggctcgggggcggggttccggggacacaggcgggcctcagttttcccggcggtgtgaccggaggcggagcccggggatccatcatagcttctgtaataacgctaagtgctgcagtttgttgaggtctttcccagctcctcttccttctcgtaacagcccaggaaatcggtccctctagttatttacgttttacagtgggttaaactgagtcatagcctgtgctctggccctcagccacccttggatttctaagatggggaaa

SEQ ID NO: 8854 - DNA, 400 bp, Homo sapiens
ggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaatt

SEQ ID NO: 8855 - DNA, 378 bp, Homo sapiens
  misc_feature 372: n = A,T,C or G
aaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaanaaaatg

SEQ ID NO: 8856 - DNA, 300 bp, Homo sapiens
aattccgttgctgtcgcttccgcttggacatcagctttgaaagccaacacatcctcctgagaggggacaagacaagcagggatatgtgggccactggatctttgccagacttcccagctgcagccaagttcttagggttccgtaagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactgg

SEQ ID NO: 8857 - DNA, 415 bp, Homo sapiens
cttttaacgttcagcctcccgaagaaagccaggtgtcagggcagaagaccgccattcttgccagtacacctgccagcctacagaggaagccagatcggggaagccaggaagttttagtgaagcccccagcatgaccctattgtctcccctttcacccagagcaccagcaactggtgaagtcttagaaacgtccctgatacaccaaaaaccatcccaggaagccagcatcgtccaagctgagaagtccaagctgagaagcctgaggctgtgacgtcagcctgctcggcaagaagctggggctgccgcagggttgccaggagatagatggctttgcatactattaaaatatttttgcctgtctctaccaaagaaaaggaggaataagatcgccccaacatagttgcatggctgaaga

SEQ ID NO: 8858 - DNA, 417 bp, Homo sapiens
  misc_feature 285, 296, 367, 373, 410: n = A,T,C or G
gagcattctaatctggaagagctgttccaaaaaacataaacttagtgttgatgaagacttttgtcattatttgaagaatgacaactgttggacaacaaaaaatgaaaacttagattgcaacagtgattcacaggtgtttccctctttgaataataaagaactaataaatatcagaaatgtttcaaaccaggaaagatcaatggatgttgtagcccgaacacaaaaagatgggggcatatctttattgtttctattaaaacggagaatcagatgcaagctggaatntgaatggttcnctttctatgattgggcctcatggatatatctctgcatcagattggcccctaatgattttttacatggggangggatnggttatatattatatggcatactctggctgacgtggnctgcctg

SEQ ID NO: 8859 - DNA, 415 bp, Homo sapiens
ggacagtctgagccccaggatctccgtgcccctgattccggactctgtacagcaatacatgagttcttcctctagaaaaccaagccttctctggctgttagaaaggaggctaaagaggccgagaacccaaggtgttgtgtttgaatcccctgaggaaagtgctgatcaatctcaagctgacagagactcaaagaaggccaagaaagagaaactttctccctggcctgcggaccttgaaaagcagccttcccaccatcctttgcggatcaagaagcagttgttcccagatctctatagcaaagaatggaacaaggcagtgcctttctgtgagtctcaaaagagggtgactatgttgacggcccactgggattttcagtgcacttaaggtctacagatgaggagtttatttctcaaa

SEQ ID NO: 8860 - DNA, 415 bp, Homo sapiens
ccttgtcttgcctccaaaagactggacctccttttcttcttcagtggtaaaaggagtttcttggtgccaccgtgggctctgggcagagactgtgccttcctcccttttgtgtctgagtcgccccgcatgctttggcgcagggagtttgggccagagcgatctccagccccttccagttcactggctctgtgataaggttcctggggattttgtgtcatgttgcttggaaaccagatggaaataggccaattaccattgaagtggggcggctcctgaatgttccaggaccaggagatttgagctaggcttgggaccttctctttgctgggtctctccctggtcctgcctcctaagaaagagaaaacaagcaaatactctgtctacattcagatacgatgccttacatgagaagtaa

SEQ ID NO: 8861 - DNA, 400 bp, Homo sapiens
  misc_feature 353, 395: n = A,T,C or G
aaagttgctaaatctggccgtcctaaactagatggcagactgagaaatgtgactcccctccccagtaccttgttttctgtgtccttgtagccgtggtccttcagcatatctctgtgctgcagacaacacaccttcctgatggaggtgtccggtaagtttccaagcagtgccgtctctgcagtaccttgaccgccaggagttggtggttaggaactggctcctgaagtagggtgtaaactagaggactgttccagggactcctacccctacgcctagctctgagcaataactagtgttcgtgtgtgtctagggaagagggagaataaccagtgggttagcccatgggttcaaanaccccaaccctcaagtggcacctctgtgaggctgcttcctgnaactg

SEQ ID NO: 8862 - DNA, 403 bp, Homo sapiens
gctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctccc

SEQ ID NO: 8863 - DNA, 403 bp, Homo sapiens
ccaggctggctgtttttcttggtgaatgttctccaggctggttatttttcttggtgaatgtaatgtactgtctttttagagtaagttactaagctggttactaaatcaggaatattttagttataaaactttagatttttaagaatattggccaggcacggtggctcacacctgtaatcccagcacgttgggaggccaaggcgggtggatcacctgagatcgggagttcaagaccagcctggccaacatggtgaaaccccgtctctacaaaagaaaaaaatacaaaaattagctgggtgttgtggtgtatgcctgtaatcccaactatttgggtggctgaggcacgagaatcgcttgagcttggagggcggaggttgcagtgagctgagatcgtgccactgca

SEQ ID NO: 8864 - DNA, 396 bp, Homo sapiens
cttgtatatagaagctatttctcatctcagctgtaaatcccatctgggctggactatattagattactttggtagcctaaccaatgctaaaatttattaatgtcttcataatagcttgctacttggtaatgtttatacttgttgtaaaaagcatgtgacaaggccaggcacggtggctcatgcctgtaatcccagcactctgggaggccgaggcgggtggatcacctgaggtcaggagttcgagaccagtctggccaatatggtgaaaccccgtctctactaaaaatacaaaaattagctgggtggtagggtgggcgcctgtaatcccagctacttgggaggctgaggcaggagaatcgcttgaaccccggagggggagtttgcagtgagctgaaa

SEQ ID NO: 8865 - DNA, 406 bp, Homo sapiens
cccagcagtgtttactgaggacctggttttctagaacaggtgtgtcctgtcctcttccatgttccctgggggctggtcagctccaagttgtgggtggcagagctgtgtttcagcatgaactgactagagacccatctggaggcaaatattaagttgccaggactgctttcacttcagggtgattgaaggacacatattgaagtacctagaatgccagaaagtgttctattgcccaaaaaacaaatcagaaaagcctattcttttttgcaacgctgttaatgattagtggagttctgaaattactttgtgccacttggaagtactgtgaaaccgcattcactgggattttgctgtaattcacatccgctggactgaagtttaccttgatgttagctataagaaatag

SEQ ID NO: 8866 - DNA, 392 bp, Homo sapiens
gaagaaactcagagattctctgtaacttgcccagcattaccccactgatagattctggggattgaatttggatccaggtcttttcaactccaagtttcaccacgtgaacttgagttggcataagaatcacttgaggcttggttataatataggttctgggccctccccagacctgctaactccatcaccagggaaggggccctgaaatctgatgactggtatgatcaggcaagtttaagacattatactctactgtatagcctcctttggtttaaggtcctgattctcaaggctttccatttgtaacaccttagaggtataggcattgatgccaaaaatagtaaagaagcaaatcatgtacagttgacctttgaacaacctggggggttagg

SEQ ID NO: 8867 - DNA, 402 bp, Homo sapiens
ggcggagaaagcagaggaggaccggcgggccaagctttcctagcctgacagcagccatttcggaacgtacgtcccagccctctttagctacttagcgcctctgggcccgagaacacctgctccttggctcagtctggcgccaccggcatcacggaactgtacttcccagagacgtcacaccgggagacttccgattcccgctcttgagattggactctcacgtgcaggagccagtcctcgctgggctctagcgggcttctgatggaggagctactcctctgggaggacagaaattagcagcagcctctgtcaccatccaaagattacaacccatgaaaccattgaatttgtgccttgtatcagaaagcaaaggagaatgaaaaagcacagctaacattgctt

SEQ ID NO: 8868 - DNA, 389 bp, Homo sapiens
catggccaatttttttattagaaaatatgtgaccaaaagattctatagagtaaaaaatcaaagcaaaacaaaaaccacaaaaagacccctgtactatagaaaatgtaaagttggctgaacagatagggtcttgaaatttcaggaaacatataatctcacggttcttaaagattgtcactgtagacatctgagtaattaattttcagttagtaacaggcttatagaaactttgggattatttacaaatggtttaggaaagaataaggtatagtaaaagtaatatcctggagaattctgggccacctacccaccataatcaattcagctgtactactgaagtattgtaaaatctgatctctagaggaaaatacagtattctaccttacgtt

SEQ ID NO: 8869 - DNA, 395 bp, Homo sapiens
gaggatatttaggggtacagaatcccacggtgtgagttgcagaagggcccgagcatctgtctggtggcaccttctcaggaggaacctcactgaccggcatgggtgaaccgttcagctagggtcttggggaaagtcaggcatctctggagcctccgatgttgaggatagggtaagagcagcattgttctctggggccctttttccttagtaacacacactcacccggagccagttgtgccttcttgcaaacaaacagctttcaagaagagttaataaattaatcttctgggaaaaagaatctgctctgcgccagcaagacctctagcagccagggccagagacttgggcaatgtagtcaaaacacacgctgatcactgtgtgttactgctgacgag

SEQ ID NO: 8870 - DNA, 402 bp, Homo sapiens
cctcagcaagggcgcggtctggtactcgtgcgtcttttatcgcctcagtttccctccgccgactagcgcgcggggcccggttctccatcgcgcgcacgggagcctagcgcaatgaggcgggcagcactgcggctttgtgccttgggcaaagggcagcttactcctggaagaggactgactcaaggaccccagaaccccaagaaacagggaatcttccacattcatgaagttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgctttgggcagtgagc

SEQ ID NO: 8871 - DNA, 405 bp, Homo sapiens
  misc_feature 335, 364, 368: n = A,T,C or G
agacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaagtggattgtcctgtttgcggggttaacattccagaaagtcacattaataagcatttagacagctgtttatcacgcgaagagaagaaggaaagcctcanaagttctgttcacaaaaggaagccgctgnccanaactgtatataatttgctctctgacgtgattaaaaga

SEQ ID NO: 8872 - DNA, 391 bp, Homo sapiens
ctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttgggg

SEQ ID NO: 8873 - DNA, 422 bp, Homo sapiens
  misc_feature 399: n = A,T,C or G
gcatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccatcctgagccagaggctgctagccccaccaccagaactcgcccagtgacccgaagcatgggaacaggagacacccctggcctggaggtaccatctagccctctgcggaaagccaagcgagcngcctctgttcttcacaattcgga

SEQ ID NO: 8874 - DNA, 402 bp, Homo sapiens
  misc_feature 382, 390, 392: n = A,T,C or G
cactcctcctccatgcccagggaccgcgggtgcttggggccccgacgcgtacccaggtgccatctggccctcacctcccgccgtagctggctgtgacgcccgccatgggcacactggggcagtgcagtgagaagacgaggatgcccagcaggctgacaacggtgcagaacaggcagaacttgatgaccgcggagccccggagcctgagcttgttcacaaagaagccgcccaggaaggtgccgccaccacccgctggcaccaccagtgtcgctgacttgaacccctgcgtctgcagcttagtgacatcctgtaaacctacactttccagcctctcaccagagcagactgtcggcctacatccccccacctgcaggagggcggntctttctntnggccacacct

SEQ ID NO: 8875 - DNA, 368 bp, Homo sapiens
  misc_feature 136, 141, 148, 152, 154, 178, 179, 185, 188, 189, 193, 194,204, 205, 211, 213, 214, 216, 223, 227, 252, 261, 262, 263,266, 267, 269, 279, 281, 284, 286, 291, 293, 296, 306, 309,313, 314, 320, 328, 336, 338, 339, 341, 345, 347, 348: n = A,T,C or G
  misc_feature 352, 353, 359, 360: n = A,T,C or G
gtgggcgcctgtaatcccagccactccagaggctgaggcaggagaatcgcttgaacctgcgaggcagagattgcagtgagccaagatcaagccattgtactccagcctggacaacaagagcgaaactctgtctaanaaatntcttgtnctcncncccaaaaaaaggttttcactcctnnaaaacnaanncatnntaacccaagnnggaatntnngntgggacncttntgcaaaaaactgtatctgtctttantaaatattnnnctnntnctttaaaaancnttnanataantngtncccaaacttnttntggnnattatntttttaanattttttngnncnacantnncttnnttcaannaaattttt

SEQ ID NO: 8876 - DNA, 383 bp, Homo sapiens
tgttttcctgactggaactcagtgctgaaacgggcctcacagttgctcatcgtcagggatacagaggatccaacgaggatgaagtacacaaggattgtcaacctgtgggggatgactggccgcacagccccatgaagaccacctgggcagctcctctctcaggccttctgacttgaagaatggccagctcctgtggggtcaatacaagaataacttatgtgcacagaaagaatatttacaattacttgagcttaaatttatgtaattaaatttattataattataaatttaaaaacataattttctttttctttttctttttttgagacagggtctcactttgtagcccctgctggaatgcaggggacggtctcggctctcgc

SEQ ID NO: 8877 - DNA, 396 bp, Homo sapiens
  misc_feature 269, 275, 292, 298, 304, 317, 340, 351, 353, 355, 359, 377,382, 392: n = A,T,C or G
gcccaacctccctgtcccgaggcccatggggaggagttggggggatttcagaggtaggcagcccagcctctccgccagccagtggagggctcaccgaggagcccctggggcccatggagggggagcttccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacangaaganatgggagggcaaagcanctcggnccaggncacggacagtgtnaatgcagaggagatcaaggtagnccgtattcatnantntcantgggttggtggaggatgntccanaacccaatgnactg

SEQ ID NO: 8878 - DNA, 344 bp, Homo sapiens
atctcagtgctttccctttttgaacttcccttctattaaacttaaaacagatgtcttaattaatcaggctgtcttggaagggtattgtattgggagacaaggggcggtggtggacctcaccttcaatccaagttttcaaagatattttctcaataactctaaaagggaggtgcttgggattaaggtgacagtccacttgatccttttctttgttttagtgtgaatttcagcagctccatctgtcttcatgattgtacttgagcagtattagctgtatgagttaattttattcagattgaagatggagggctgggttctgctcactcagtctttttttttttttt

SEQ ID NO: 8879 - DNA, 378 bp, Homo sapiens
ctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgct

SEQ ID NO: 8880 - DNA, 385 bp, Homo sapiens
cgctgctggcctggggcttcccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttaattttgttttcccgcacagcaagctctctgtctttcaa

SEQ ID NO: 8881 - DNA, 350 bp, Homo sapiens
  misc_feature 303, 309, 338, 340, 346: n = A,T,C or G
ctttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcttgcagtggagaggaggtctttcagccncagcangtctggagggctgataatgaacctgctanangttttnacat

SEQ ID NO: 8882 - DNA, 300 bp, Homo sapiens
aatttatgacattgtcagaagataagtgatagatttcataccttatttaattcttacatggctgtgcagaagataatgctaagtggatctctctaaggtcacacaggcattgatgggctcaagcctaaaaccaaggtctgctgactcctagactacaataggtactttaatttccaaaatgttttcattttgaattggttttagcatgagttggaccatagaatcttggaagatgagatttgcttaagttcctggaataccatattatgtgaacaactaacagagggtaataaaatatat

SEQ ID NO: 8883 - DNA, 420 bp, Homo sapiens
  misc_feature 402, 407: n = A,T,C or G
aggatgttcaacaggaaagcagtgagcaaaaaaataaatcaacagacaaaggtgaaaagaagccagacagcaatgagaaaggagaaagaaagaaagaaaagaaggaaaagactgaaaagaaatttgatcactcaaaaaagagtgaagatacacagaaagttaaagatgaaaaacaagcaaaggaaaaagaagtagagagtttaaaacttccttcagaaaagaacagtaataaagctaaaactgttgaagggacaaaagaagatttctctttgatagattctgatgtggatggacttacagacatcacagttagctctgttcataccagtgacctttcatcttttgaagaagatactgaggaggaagttgtaaccgtctgatacatggaagaaggagagattncgtcngatgatgaaaaaa

SEQ ID NO: 8884 - DNA, 422 bp, Homo sapiens
gaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctg

SEQ ID NO: 8885 - DNA, 417 bp, Homo sapiens
ctgcaacctcggtctcccgggttcaagcgattctcctgcatcagcctcccaaatagctaggattacaggcgcccaccaccacacctggctaatttttgagacagtctcactccagtctgggcgacaaaacaagactctgtctcaaaaaaaaaagtgtttggcattcattggctcttaaatggtacctatttaagaggctgtacatgttccagtgggatgggaagcagcagagaccaacagagtctgaagaagcaagcttctgagttatgaaagcctgggttcaggagactaacctatatgtaggttcctaggaaagtccagttaaagggcctactttgccactgctgcctccttcttaatgctgaacctcatctcccacaagggggcagtctcagcaggtgtcagctgagccatgtg

SEQ ID NO: 8886 - DNA, 418 bp, Homo sapiens
gttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaaccgtaaagctgctttctgcttatcttattgcactgctagttgtatgtaggtattaattttattgctg

SEQ ID NO: 8887 - DNA, 414 bp, Homo sapiens
aagcccactgcctcctaaattgctgggattcccaagaattcagcttctagtgtgaccaaaacaaagatggagacaagtcgccctgcagggtagggcacaatggaggtgggggtgggagggcagagctgctgacctctgacctctgccaaggcagacgcattggacaacagagcaggacctgaggtgaggctaattcctccaggtgtgaagaaacaccttaggggggccaggcgcagtggctcacacctgtaaccccaacattttgggaggctgaggcagccggatcacctgaggtcaggagtttgtgaccaacctggccaacatggtgaaaccctctactaaaaatacaaaaatcagttggtgtggtgtcaggcgcctgtaatcccactactcgggaggctgaggcaggagaat

SEQ ID NO: 8888 - DNA, 418 bp, Homo sapiens
agcaaaggcatctcaaagcaaatagagatgtctgcaaattctcattctgcagcaaaatctttgtggtggtggtctcaatctttctttgttctctgaataccatcagccaacctatacaaccttttgcaaggtgttatgaattgagcccccactgttatatccacaaaaaagaaacaatcagaccccctagttgaatttgatcgctacattgaagatagtgtggtttcacaggaacagtaccttgtaacattgatagtcctatgatcaggtcttaaaacagctaaggaatgggtgattacatgaaaattattgcaccaggaatttgtggaaagcattctgagtaaatacagtgctgttagattaaatggattttaacatttaatgaaattgccagattatttttatgccaatatttaat

SEQ ID NO: 8889 - DNA, 416 bp, Homo sapiens
ggtggctgttgttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcgggacgactatgacaagaaggtgaagcaggcggccaaggagaaggtgaggaggcggcacacgcccgcgccgacgcggccccgcaagccagacctgcaggtgtacctgccgcgacaccgagatgtctctgcccacccacgcaacccagactatgaagagtccggtgaaagcagcagtagtggaggctctgagctggagccttctggccatcaactcttctgcttagaatacgaggcagacagtggagaggtcacat

SEQ ID NO: 8890 - DNA, 415 bp, Homo sapiens
  misc_feature 401: n = A,T,C or G
gaccgcggggtgggtggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctgggngaacttcttacaat

SEQ ID NO: 8891 - DNA, 412 bp, Homo sapiens
gtcacttatgcctataagcgggcatacaacaggggcacaataaatgtttgttaagtgaatgaattctttcagaactagatgggatcttagtccaactctcttatttaacgaggtccacagaggttctgcgattgtctaagaaagaaggctgtgttcatggcctttgttgtttacgtggccctgtgattctcttggctccgtgaaagtcctgatgcagacattccggccatctagaaaggcatgcagacaagccatccagctggcatgatcctgagtccagctttctttaaaagagcttccaaaactgcttaagctttgactgcacaaaacctgcatcacctccagttgagaaactcaagagaataagtaagttatggagttggagaccccagcttaactactagttttaaaa

SEQ ID NO: 8892 - DNA, 409 bp, Homo sapiens
ggtctgtctcctcctcccacctccaccattccctggttctagctttcttaatatcactgactttctcatacgtaactgtatcttttgtttccctcatactgctgcattacagatttgttgtgtaataatgttacttgaatcaagagaatgtcgaagcaaatatccaagggattagaaagagctaatatgcaaatgaaagattttgggtaggcttatatggaagtcacaaatgggtcagaatgactgagatctctccttaagactggcttttgataggggatgcaggccagcattcagttgattcgcagaagaaaaaccaaggagttcctttaaactgaacaagaggcagggctatgtcccaggtggacaggagggatggggggatgttttcttatggaaatagcaggct

SEQ ID NO: 8893 - DNA, 409 bp, Homo sapiens
aagttatgaaaacagtgagttattgtttgatcgtctgtgatcccaattttcctaggaatatagactgttaggaatatagatcctgtcacaagaggcttaataagtaaaggaaccatgtggtttcttggctgttttgcttttcaaagtctgtatcattttaactagtgtagcaatgacagtttctttttgtttcttgataaccttgctggctactttgtttcctgataaccttgttgtctactttgtttcctgataaccttgttgtctacattgtttcctggttgatttatcctccttctccccagcctctttggaaatcttataactatggtgtttgtggttagaggttagagtctagtagaggatggtcaagactttgaaggcaaacgcttgcctgtgagggctgctt

SEQ ID NO: 8894 - DNA, 407 bp, Homo sapiens
  misc_feature 325, 353, 355, 384, 401: n = A,T,C or G
ggaaaaactcacccccatgattcaattacctcccactgggtccctcccatgacacatggggattatgggagctgcaattcaagatgaattaaggtggggacacagcccgaaacatatcaggaggttcctggaagaaacagagttgaaagcagttatcttgctgagtgggggactcagggcatgggcaggagactgctgagttttgttttacatcttactacatttgatttataaaagacagatgtgcatatatcacttcaaaaaaacaaaactggatgtggctgatgccaaagtgacctgcccagaagagctgctaacagaacancatcccaggaggctgcagaaggctgaanancaaagccccacctgctatggccacaagangcctggatgccatggangccgca

SEQ ID NO: 8895 - DNA, 401 bp, Homo sapiens
gaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttacta

SEQ ID NO: 8896 - DNA, 401 bp, Homo sapiens
attctgagttggggcaggctcagcctgccagcttcttcgatgtccagcatctctgcagccttgggtgttctcattccctctgagccccaacccctgtcattgcttctagctctggctctgggatgtggcagttccaccataagctaggctacctcttctctgctctcctctcagtctcccaaccatgtcttccatccatatgttaaccctttccttcaatttatgtatgaggttggctgaccttgagagttgacatcattgatggtaaataaccaagatgcccactgacctctccacttcagaaaagatagcatcagaaagaatccacttagaggtggaaccctctgccaccttttcactttctctctctcttttttttttgagacaggctctcgctttgc

SEQ ID NO: 8897 - DNA, 407 bp, Homo sapiens
  misc_feature 341, 356, 374, 402: n = A,T,C or G
gttatactaggaattctttataaacttaataaatgaaagctttttctcttataggcccgattctctagtggacttctggtgaaattatgtggctaccttccattaatgttaatggaggttatggatataaatccctccatagtgatggaagaatgagccccagagagaagaatgtttctaatgaatcactggattgtgatataggattaacttggtgtccctaataccattttttttcctcctgaaagtttaaggtcttatgtttaggaactagtttctctccaccttaatcctttattgcaagctgcaataatgttaagaacaggaaaaaaaaaatgtanattcctggataggcncagtttttatattaatgnaactatttaggctaagttttatattaanggacc

SEQ ID NO: 8898 - DNA, 402 bp, Homo sapiens
attctataaacaaaaactctttgttaaattaaccatgacacaaattattctattgtcttccccgaatcccacaaccccctccaacatttaaaattcatctttagatagcagattatcccttaaagtaccattttactctctgaaaaagtcctagaaatactactctctgtcaatgcagcagaccgctaccttgcaaggaaaagatggtctacttacataattatccttagttatgtttacaacattgaagcaggcaatatctgactttcattcctgagtgaaatccagaccacagcccagggaggaccaagccatggcattctgttgctccccgctgaacgtcccacaccatagggtctggctttggctggaagaagggcaacctcacccagtccttcagaa

SEQ ID NO: 8899 - DNA, 406 bp, Homo sapiens
cccaaactcttatggctaacttttttgccacctagtagactccagctgctgctaggctgggtgtgtgtagaataaggccctgtgaacacagacatccctctcgggaataagagctgagcagtgcacttcacggtccccaggcggcccacaccatctgtttgctgcagcaggatggcttgggtggtccatccagggccctgcccagagtctcttggggccaaggctttcccaccctgtccctctcactgcccacctccaggtaggcacagtagggagggctggcaggaatgacccaggagtgaaagcaatcctcttgtcttctggtgggaggatggaggggccagggcaaactgtgaaccagcctttggacggggtacccacccacttccgtgactctccttgcccc

SEQ ID NO: 8900 - DNA, 404 bp, Homo sapiens
  misc_feature 385: n = A,T,C or G
gcatttcaactcagtattcattattagttgtgtgtctggaaagattgtacttacttttcctctttacactacagttcgctcttatggggctctaaactgtttaactgaagaagcttcgtctgtattttgattgagcataatttagtattttatgatttccaagatgatgttcttatgtctatcaagtctatgtatcaaatttataacatcatttaagaaaaaggaatttccacagatacttcagttgcaattttttgtttcatgctactgaaaatacatttgtttctaggggttggaatattatagaagatggaggatgaaagaaaaccgatagaacaacgaaagaattctgtttatgaaattacaggaattgtgccactatggnaaagcattgtcattttagt

SEQ ID NO: 8901 - DNA, 402 bp, Homo sapiens
  misc_feature 334, 344: n = A,T,C or G
gcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgncgcgtggtgncaatcacacgggaacagtgatgtatggagctatgttgcaggcagatgatgaagatgac

SEQ ID NO: 8902 - DNA, 404 bp, Homo sapiens
gaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgtctggcctggg

SEQ ID NO: 8903 - DNA, 399 bp, Homo sapiens
gataaaatgatggtcttggctgggattgcaggcgggagccactgcagctggccatcttacttaatttttataagaatccccagaaggtaggttgtgttaagattcaaactgtataaatgagtaaagtaaagcgtaatgagaataaatagttcaagtaaacaaagtgacagaaccagcattcaaattcaagtatctctgacttcagagttcatgatcttaaccactctaccatactgcctttctctgggtacataggagatatggctgttggaagaagggttaatgtaacaatggcatccaaagtacaattttgcttcatagaccaaaattcaaaggtactcctactgtatataattcagtgatggactagatctaattttgtcttaactatattgcttg

SEQ ID NO: 8904 - DNA, 397 bp, Homo sapiens
gcgcccggtcctggggtccgcacgagccgggtcgggcagaggctgctcctcctccccaggacgccggcgccacacccgccccccgacgcgtgcggcgggacagaagcggaggcgggagtgctgggaacagcctttactgcccacgccctacacggcgaacatgcgcagagcctcctccgccgagcggcactggttcagctggatctgcacctctacggtcaggggctcagggtggtaatcgccttcgtagatcggaatcacggctttcggcttttctgagaaaatttaagtgcgagcatgagccccgggagacggatgggctggcgttctcggccgccctgacccatcccatatgcaagccctggaccctgtcccagcgggagcacagttttggtcc

SEQ ID NO: 8905 - DNA, 399 bp, Homo sapiens
  misc_feature 363, 376: n = A,T,C or G
ggggccaccaatctggccgacctcaggctctgggaaacaggctgccctcgtccctctgcctgtgggtggctgaggcttctcagcccatctccagttctctgcagcaaaggccctctgtttctgtcctgcagtgggggccctttcgtggttaaacatgtccctcccctcctcacagaactgagtacctattgcggctgggcccgcccaaccctgtgtccctgcacccatgggttctaccacctgattcggctgcagctgtcactgtcccgtgtctgctctctgtcaggcctctgagtgctgcagacgtattaacatatcaccgctagttgatggaaagtcttgtttcttattagaatattttgngtaggcacagggngccccagcactgtctatagcaac

SEQ ID NO: 8906 - DNA, 398 bp, Homo sapiens
ctaatattaaaaagtcattagaatcagagaacattgcagagttcaattttagaatacatttagcagaaaatacatgaattaagagagggtgactgaatgcaatatagttctgtggagtggaaaatatgaggtatatgtgttcagtgatggaccactgaatatatagatagtagtcattgttaattttaagagtctagattggagactagaaaggtcctctggttctagttagtgaaagtatttgtacaagaagtgactcttaagtattgcaacaatgttccaagagtatacatattgaaatccatctcttaccatcatcatgatcacactcactgccacatctctgttcccagaacagggcatagacatcagtttctgaaacctaatagtacctaggg

SEQ ID NO: 8907 - DNA, 395 bp, Homo sapiens
ggccactggttcccaggcccccaagtccccctgggcctgtccaaagactccaagagggggaaccagaagccccactgggcccagggtgggtcagtgccgcccagcagcctctgagcatcgggaggaatgtggagtgtgggtgaggggcacaattctccaccccagggggcttccaggctgtagcaaagcagccacgtctctccacctgcccagggcacagacccggtgctcagccgcctccagctccagctgagcccctgctgcatgggcggcccggggcctgggggcagagaggagagagccgctgtgggaggagagtttgggggcgtggtcaaggcagagttggtggggtttgaagtccagcaggagtggcagagagaggacttgacgtttgg

SEQ ID NO: 8908 - DNA, 420 bp, Homo sapiens
ctgtcttcaagtggctttacaggttttacaccgcaaacttccccagttttgcgctcacctctgcaatgctgtgattggctacctgagtactcgcggttcctcagtagatggcagtcccctactgctatttctccgagatcagacgagttccagactcctggagcaggtcctgctggtgttggagcccccaagactccagagcctctttgaggagcacttgcaggggcagctgcagaccctggctgcacatcccattgccaacttccctttgcagcgcttactggatgcagtcactacccctgagctgctgtcccctgtgtttgaggagctgagccctgtcttggaagctgtattggcccagggccacccaggggtagtcattgccctggtgggggcctgtcgcagagttggggcctacca

SEQ ID NO: 8909 - DNA, 393 bp, Homo sapiens
  misc_feature 336, 352: n = A,T,C or G
gtctttgtaaggagcgtaacattgcttaagatttatatataaccgagtcattttctgtctctgtatcatattcctttaggtaagctttttcaaagttactttgaatagttgatatagatttagaacaaacgagtcaccattctcaggatacttctattgcctttctggaataatgcagctcattgttctgccaagtatcctctaatcagcctgaaaagtgttttcttttatttcatcatgacattgggccttttaattgagagtgaaaatcattaaaggcaaattattttgtgtaaattatggtagatttagccttactacataattttggaatgnttttatgattggttgngtatgctctggcagatgtctttatcatgacttattttaagg

SEQ ID NO: 8910 - DNA, 392 bp, Homo sapiens
atctcatccattcttgcttcactcaccacttcctttttctcagaggtcaatgcctgatgccaggtccactcactgaaattccatgaagactggaatttgttgccttggagcatgtatatacattctcttgttattctcctcccagttcctcatcaggaccttctgttgcttctaatagttaacctctttaaatagcacagtttccctcttctgcaagtaaagttgcagtagggttctgatggcattaatattttaaaagaacttgtgattttgtttacttaaaagtgagggatgtgaacagatgtcgactcaacctgagaaagaaggtatttgttctagtgactaaatttataaatgagattcagagccacttgattaatagaagatattta

SEQ ID NO: 8911 - DNA, 384 bp, Homo sapiens
  misc_feature 270, 275, 282, 284, 306, 312, 313, 314, 317, 318, 319, 328,329, 331, 349, 357, 359, 366, 367, 374, 378, 380: n = A,T,C or G
ggattgtgaactctggacaaaggagggtttttagttctttgcttcttttgacgggtcactttgccatgagcattagtggggaattaggttacactttcctgttatgtatttattatccatttatatattatacaaggcatgcttatttttaaaatagagtaaaatccatgccgaaagccccatttctcaccctgctgttgacagctgcgtgagtcctaaaccttctcatatcatgccgcatgctgcatgcttactcctggagccgttttncaaanaagtgcnantacactgtgctattgaattttntgcacnnngtnnnaatctcccnntncttgatttttttaagaancccccccncntttactnntttaagngggncnttaa

SEQ ID NO: 8912 - DNA, 363 bp, Homo sapiens
  misc_feature 159, 161, 164, 169, 171, 173, 176, 177, 179, 199, 205, 206,207, 210, 215, 216, 220, 233, 237, 239, 241, 245, 254, 255,257, 259, 265, 267, 285, 286, 293, 297, 305, 307, 314, 325,330, 332, 333, 335, 343, 348, 355: n = A,T,C or G
atggactccagctgtatccatgttgctgcaaaggacacgatctcattccttattatggcatataatattccatggcgtatatgtactatattttctttatccaatctactgatgatggacacctgggacaaatcaatgtctttgctattgcggatagtntntanttttncngncgnnancatgtccctgggggtgggtntctttnnnttnttttnnactncttttgttttagncccncngncacntttcaacgnntntnctttgngnatagtggccaaaaaaacnnaaaaaantttntttttttngnaaaaaanaattttttggnggggngnncnatttattngaaancttattntccttcct

SEQ ID NO: 8913 - DNA, 389 bp, Homo sapiens
ctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagt

SEQ ID NO: 8914 - DNA, 300 bp, Homo sapiens
aattccgttgctgtcggaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagctgtatttt

SEQ ID NO: 8915 - DNA, 417 bp, Homo sapiens
  misc_feature 349, 362, 375, 384, 390: n = A,T,C or G
ggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgctaattgtgaaaattttcagaagactgatgtgaaagatgatctgnctgatcctcctgntgcaagcagttgnatttctganaagctncacgtagtcccaactttcagattttgg

SEQ ID NO: 8916 - DNA, 408 bp, Homo sapiens
cacacacacttaagaccctttgttcctagtaacattcatcctcttgattcctggtgaacacggttaaattcatgcacatttgttcttgtagtttctaaaaattagatcaatttatttgttagccagcaaattgaaaattccattattagattaatgaaatttttgctctgcttatatgtatacgaactggaaatctgaatttttaaatttagatctttaaatcaaattatttttatgcatattttcatttaatatagagtataccaatcgattgaagcctttcacaagtagtgcgctgagcttttcttattgaagagagtgaattagtttctgagaagcagtctattgtgaaaagtttcagatgagattattttcttttagtctttttaaatatcactatatgtattg

SEQ ID NO: 8917 - DNA, 417 bp, Homo sapiens
  misc_feature 176, 186, 198, 214, 230, 234, 258, 263, 285, 289, 324, 327,349, 375: n = A,T,C or G
gcttccctccaatggtttttactccatcctctttctggtcccaccatcaattaccttggagacagtaggaaatgaaaaagaaaagaggtggaggtaagagagaggaaagacaagtgggaacccagggctcaactagtctgcacctcctcaaccagtagtttaaaaaaaaaaagtanaggccaggcncgttggctcacncctgtaatcccagcantttgggaggccaaggngggnggatcacggggtcaggagtttganaccancctggtcgggatggtgaagctntgtntttactaaaaatggggaaaattggctaggcatggnggngggtgcctgtaaccccagctgnttgggaggctgtggcaggggaatcgnttgaacacgggaggcggaggtggctgtgagccacattgcgcc

SEQ ID NO: 8918 - DNA, 421 bp, Homo sapiens
  misc_feature 380, 383: n = A,T,C or G
ttttttttcttgagatggagtctcgctctgttgcccagtctggagtatagtggcgtgatctcggctgatggcaacctccgcctcccgggttcaagcgattctcctgcctaagcttcccgagtagctgggatcacaggcacctgccaccatgcccagctaatttttgtatttttagtagagatgaggtttcaccgtgttggccaggctggtcttgaactcctgacctcaggtgatccatctgcctcacatctgtaatcccaatactttgggaggctgaggcagtgaggcggcatattgcttgagcccaggagtttgagaccacctggcaacatggggaaaccccacagggggtagaagtgaaaaagactgaaaaaaattanctnggcattgggggcatgcatctggaatcccacctattcag

SEQ ID NO: 8919 - DNA, 413 bp, Homo sapiens
gtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaaaaccgttaacaggattttctgg

SEQ ID NO: 8920 - DNA, 412 bp, Homo sapiens
gacctttagagataattcctagctatgaacgtagtttctagaacagataagaatttcttggaaaacgttgccttctgtagtacataagaagaattgagtgtcaatacatataactaaacaggagcaaaaataacaatacttctggaaatttgacttaagtcatggaaatttacttgattttggacttgaggtaaacaatatgtctttctgcttttatccgcagttgcttgcatatttcctgttataaatgtttgtctaatgattaaaccaacaaaagttctgaaccttaagttcaaatatcaaattccaatttattcccattttgatgttcctaaaattatacctctagttcaaatttttagatggccaaagtgtttgctttattcacaaagttgaagagagactttcagga

SEQ ID NO: 8921 - DNA, 412 bp, Homo sapiens
ctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttg

SEQ ID NO: 8922 - DNA, 413 bp, Homo sapiens
ctgtcccgggggtcaggggagggaggccagcgggccggcggggtccgccccgaccccatccacgaccccgactcctatccgatcctatccccggccccgctcgggcctttccccttgcgccctggctcggctggctcgacgagcagtaagttcgtagccgccctccgaagccgggcgtgcatgggatggcagagttggcgtgcgtgcgtgagtccaccagtgtggcatgggcatgtaaggtgcgcggagggactgcaccttctccatcaggtgcagaaggccacgtcatgctgaacaagagccgagaagtagaatcgccagtgtcaagccgtccacgttgtgggatgcccactgttcccccaggatcactcaagaccctgtgacttgtggtcactgatgagtggaccaagtga

SEQ ID NO: 8923 - DNA, 418 bp, Homo sapiens
  misc_feature 409: n = A,T,C or G
attttttgtacctataagctttttccagaccatagacaagatcctaaatgccttttcttcatccctgcttgctaaatcccctccttcaaacatttcagaaaatactgtctttactttttataaagacttcactttccaaaaatgtacccccacctccatttcttattacttaacaccacttgtgtgaaaacatacaactgcccacttgcttttcctttaagacactgactttaccaatagtagaaactcattactgacctactcactttaggctgaaggttgacagataaagcaagttctctctggtgatctgtggacccgccatcagtccacaatctaaagatagtattgagatgctgatgagattggcaatgttaatctgatgatctgtatgctctttaccacaggnttttttttg

SEQ ID NO: 8924 - DNA, 413 bp, Homo sapiens
  misc_feature 397, 400, 402, 405: n = A,T,C or G
gagatgtggtccaagggagccatccagtgacgggtactcttgtgtttgctgaattctccaagcccagtgctgcaagcattgagtgagccctagtgtgtgccaggccctgacctgaagctgatcaggggtcagagtgccctgggcagcccaggatgaagtgggctccaacagcatctggagggagttaggtgtgcaagggcctggcaccccatttcccttccacatggtttaacctgctctgctcactactccatggctcacccctcgcccagccatccccaaggcctagcaccagttgatgctcaatatacatttgcagactacagaagttaggttcatttatcgcattggcagagtgtggacgctccacctgacactaccgcttcctgccatttgngtnanttnccaaggat

SEQ ID NO: 8925 - DNA, 405 bp, Homo sapiens
ggccccgcggggcagccatgcctggccgtctgctgcggggcctgtggcagcgatggcgccgttacaagtaccgcttcgttccctggatcgcactgaacctaagccacaacccgaggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttaaaaatgagtgatagtacatggctaacgtcagaaattcataaccctctggctgtgggacagtatgtcaacaattgttccaatgacagagcagctaatgtctgttatcaggaatttgatgtgcctgcagtttcc

SEQ ID NO: 8926 - DNA, 398 bp, Homo sapiens
gttagtcaggatggtcttgatctcctgacctcgtgatccgcccgcctcggcctcccaaagtgctgggattacaggcgtgagccaccgcacccagccatgcctggaatatttttgtaatggaaaaatgaaatgggagaagtcactgttcctggctttgaggcttactctgaagccacaaatcaacattgcggcgatggcagacagacgcgtctgtggagagaagagaggactcaggccacacaagagagaccagcggagctttgacagaggcagaaaacccgttcatcagatggtctggagcacctgggcagcggtaggcaaagccctaagccctcgttctacagaacagctcatcagaatgcagggcatttaggtgaaaacctttgtggcctggggct

SEQ ID NO: 8927 - DNA, 398 bp, Homo sapiens
cgagaaaaaagtagctcaggtacaggatactgcaattcttagaatctgggaaactttttatgtgggaaataactcgatttgcttctctgtaactgagctacttttttctcgagctcatttttgtttaaggtaacactgctagggttctgagtttgagaagggatcttctaaaggtaaacttaatattgcaactttcaccacagggcctctgtctaaattgcatttcaagtggaaggaaaggggtatgagaagtgaaatcgaattttgctgcagaccaaaatcattctacaaaatgtagacatggtaacagcttaccacgaattcagcaagatttaacgccaagtacagtggtgtagactttacaagtatccacttccattgggtgatcagacaagtca

SEQ ID NO: 8928 - DNA, 400 bp, Homo sapiens
aaaagcttgggaaccagtgcctatttattggtaaactaagtgaaaatccagtgacttcactgacatatttggatcttattagtatatggctgggaggagattaagtcatttgaatttatttcaattctgaaaagaaagtgctgcctaaaaattattatagtatttgggaatatttctacccagtatacatggtggcagaaaatcacataatctgtgttgtggcaaaagcattgaataggaagccaggagatgtgggttccagtacccacatgccgtctctcctgagtacccaggtggccgtgggctagacacagctgcaggtgtctagtttgtaggtgatgggttagaaatgggctgtaaatgagatgaagattgctttggccttggtggggtggagtgg

SEQ ID NO: 8929 - DNA, 420 bp, Homo sapiens
aaatattagaacagtaaaaagtcttagaagaagatgatctcctgcgagtagaggagcagctaggctctgatacaaaggcaattgaaaagttagaagaggaacagcatgccctctttgccagagatgaagatctgactaataaactttccgactacgaacccaaagttgaagaatgcaagacacatttgccaacaattgaaagtgctattcactctgttctcagagtctctcaggatctgatagaaacagaaaagaaaatggaagacttgactatgcagatgtttaatatggaagatgatatgctgaaagcagtgtctgaaataatggagatgcagaaaacccttgaaggaattcagtatgataatagcatattaaagatgcaaaatgaactggatattctaaaagaaaaagtcatgattt

SEQ ID NO: 8930 - DNA, 384 bp, Homo sapiens
  misc_feature 159, 167, 173, 185, 191, 196, 198, 207, 218, 228, 230, 231,241, 242, 245, 255, 257, 268, 272, 278, 279, 281, 283, 285,288, 300, 313, 314, 323, 324, 325, 328, 329, 330, 333, 334,335, 336, 338, 339, 346, 357, 362, 363, 364, 366, 369: n = A,T,C or G
  misc_feature 371, 378: n = A,T,C or G
ggagaatccattactgaaaagcatttaacttaaaaaatcacctcagaacactgccagttctgaggtgatttttaaatttcagtattagggagagccctgcattcgctgactcagattctacataactaatgtatgatatcatatgcttaactattatantgtgcgtntcttgngcatacacaggntataanttttntnttttggcanaagatcttttnttaaaaaagntnnggttttggtnnttntattttaagncncctttttttanttgngggggnntnantnggnggataccctttntttaaaccttttnntttgggtgnnnaannnctnnnncnnttttttntgtttttatgntgggnnncnatntntcccctntttttt

SEQ ID NO: 8931 - DNA, 411 bp, Homo sapiens
  misc_feature 301, 303, 321, 343, 353, 360, 374, 386, 395, 399: n = A,T,C or G
gtttggactttaatatatgaagggctggtggtgaagacagactctagactctaaaggttggtggctggctatgtaggggatgggggagtgctacccctgtcaggtggtgggggcttcctggctgcagagttgggtgggagacttggggaagatgctttggaaggcagtgagtgggtggtgtcaacttctagtagtgcagtgggagagctggtcagggatgggatggagtgaagggggcagaggcatttggtgtggggttgatcaaaggaattttggaaaggcttggaaacattcctatgtntntgaaacacacctatgccnggcaaagactccaaactcaagnttttctcttncttctantcacaaaaaacatngctttggagtgngacactggnctangaatccatgact

SEQ ID NO: 8932 - DNA, 374 bp, Homo sapiens
tattttcctattttctggaaatttcatttctttgaattcgggcataagagatttagaagcttcactcaaatattaagctttatttaaaaagatgatttccagtatttcattttatattcacattaatcaagtctacatgtttcgtttagagtaacaggaagatggtaatacgcccagggaactatctggaagtgtagaaattgggatgaacaccggggttatacttgttttgatctgcctgtggtgctatgatgacttattttctctcattattgcatagaaactcaattcagtgatgttattcagatgttattcataagttattgccatgattcatcacttttatgtcatcagagttgggatggctacccaga

SEQ ID NO: 8933 - DNA, 369 bp, Homo sapiens
  misc_feature 74, 75, 80, 84, 85, 86, 109, 113, 128, 137, 143, 146, 148,155, 166, 167, 169, 172, 175, 179, 184, 185, 188, 189, 191,194, 206, 220, 221, 224, 233, 237, 241, 249, 270, 272, 278,279, 280, 282, 283, 285, 286, 287, 290, 293, 307, 309: n = A,T,C or G
  misc_feature 310, 315, 324, 326, 327, 329, 330, 333, 338, 339, 340, 344,348, 356, 358, 361, 362: n = A,T,C or G
gaacagcctgaccaacatggcaaaactccatctctactaaaaataccaaaaaaattagcagggtgtggtggtgnncaccngtcnnnccacctattcaagaggcttatgngccngaatgctcgaacccnggacgtgcncttttnttntnggctctntcgagcctctnnanttnaangctntccgnngcnncnttntctttagggcantcaagtggtccaanntcnagctcttcngggnacgnatgtcggnttttggtttggaaaagggtgntntctcannntnncnnngcngcnggcggtgttttttntnnggacntccctgtgncnnanncancctcnnngagntatngatgtctngnccnncactttt

SEQ ID NO: 8934 - DNA, 369 bp, Homo sapiens
  misc_feature 118, 120, 124, 126, 130, 132, 135, 140, 143, 146, 149, 150,158, 159, 160, 161, 165, 169, 170, 173, 175, 177, 179, 185,189, 197, 201, 203, 206, 208, 215, 216, 218, 219, 220, 222,224, 225, 230, 234, 240, 241, 242, 247, 252, 255, 258: n = A,T,C or G
  misc_feature 263, 264, 265, 266, 267, 268, 271, 275, 279, 280, 288, 289,291, 294, 299, 300, 305, 309, 317, 319, 320, 333, 336, 340,352, 360: n = A,T,C or G
ctttgctatcttgaaaaaaatttagattgttttattttgtggacacattcttcattcacattgaaagcagagtattacagagtgttattttaaatttaagctgtcaaagtttgatttngncgcncnattnanttnctttnatngtntcnntattggannnntatntctnnttnantntncacatncatntttcttanctantnaancnttcttanncnnntnannaccgntatntaatannntaagntcttnctnttnttttnnnnnnctncgtntatnntatttcannanatnttctnnatagnactnctccttcntnnctctccttattanaangacncatcattattcntattattntaatatttt

SEQ ID NO: 8935 - DNA, 392 bp, Homo sapiens
gttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggag

SEQ ID NO: 8936 - DNA, 305 bp, Homo sapiens
aaaaaaaatacataaatacataatgctgattaggtatgccttataattttctttaatacaggaaatacttattttagtagaactgacacttatgggaggtattatgtttttggtttacatctgcaaatctacatatttgaataggaaaaacctggacatactgggatcttcttatatagtaagttttcataagtattctatcaaatttattttggttatttggctaactcataagttaatccacccaagtctttttagtgattttttaacatttgagtagtaattgggtaatttttttttttttt

SEQ ID NO: 8937 - DNA, 300 bp, Homo sapiens
aattccgttgctgtcgaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcggcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatga

SEQ ID NO: 8938 - DNA, 300 bp, Homo sapiens
ctttgatccttctggaattaattttggtgcaaggactgaggtaggggctcacgtttccttcccgatgtcagccactacttttggtcttttaatctataaaagcagggcactgggttagaatttcctaaatctcttatatatcaaacaaagcactcactgcaaacttgatcaatagaggaaagtatgctttttttgtattttaccttttaccagtttcacttactgtaaatcataaggttgtcttacatagtagaaaaatagcattatcttaaacctggctttttattactaaatatatca

SEQ ID NO: 8939 - DNA, 511 bp, Homo sapiens
  misc_feature 11, 13, 15, 16, 17, 22, 28, 29, 31, 33, 36, 37, 43, 51, 52,53, 59, 60, 470, 480: n = A,T,C or G
tgccgtagccnangnnntgctnaatganntntnaannggaaancccccgannnttcgannagaatccggtgctgtcgggcactgtttaagagtaccatggagatagcctcaccttcaaaggatttacagacttgctggaaaatctaaacatgagaaactgttaaatcaatgagactattttcaagttcccaaagcagtaatatcctactgacttctgggtaaaaaaataaaccagttataagttgatgtcctaggaaaatcgaagagagatctgtgtggcctggagtagttgaggaacatggcaagaggcatggatccctgttgcaaaaggtggaaagtctcgtcagaatacaaggaaatgaaatgaagagatatttccagcaagaacagacaaaatttaggaaacaattagtaaataggagcacagaaaatcattccagtcttgtccttcaagttttttttttttcccntgggtaagtntgcactgaagttaggctaaattcttgactgg

SEQ ID NO: 8940 - DNA, 300 bp, Homo sapiens
aattccgttgctgtcgcgggagcggggacacggcaggagaccgagggtcgccccgcgggggaatggaggaaaccaggcgagaaaggagcgggaagaccttggagccgcggtgttcgggctccgcgtcccttttccccaaaaatccacccccgccccccgcagacggaaagtcacgcagttgtttgagactcgcgcatctttcctcctggtcagggggatggcagtaggagcttcgtctgggtcgtcatgaggaatgcagagaatggaaacgggaccttagaggactacccccatttcaca

SEQ ID NO: 8941 - DNA, 422 bp, Homo sapiens
gcggacgtgagcgataatggcggatatggaggatctcttcgggagcgacgccgacagcgaagctgagcgtaaagattctgattctggatctgactcagattctgatcaagagaatgctgcctctggcagtaatgcctctggaagtgaaagtgatcaggatgaaagaggtgattcaggacaaccaagtaataaggaactgtttggagatgacagtgaggacgagggagcttcacatcatagtggtagtgataatcactctgaaagatcagacaatagatcagaagcttctgagcgttctgaccatgaggacaatgacccctcagatgtagatcagcacagtggatcagaagcccctaatgatgatgaagacgaaggtcatagatcggatggagggagccatcattcagaagcagaaggtcttg

SEQ ID NO: 8942 - DNA, 418 bp, Homo sapiens
  misc_feature 370, 373: n = A,T,C or G
atattttttaaacatttaaaattaattatttttgtaagtacattaattcagatgagttagatcaatatgaattttggagaagtgttaactgtagaatattttaaggcagagcagttttgttaagtataaataattgtagaaactgagataacagtattgattgatagcagtcttaaagggaactgctctaatgaaaagattcagataatatagttttaacatgttggttaatatatatgagttctaacgatcccaaacaactgagaattttgaagcatgtttaaaatcttgtgacttcacaagcgatgatccaacctatcatttcacctttcaacatttagcagttttgtgcgtatagtttatgcaatgnggnactatgctagatgcttagtcatcctaccagtgggaaaaatagata

SEQ ID NO: 8943 - DNA, 421 bp, Homo sapiens
  misc_feature 393, 414: n = A,T,C or G
ctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcagattgtgacacagacacaaccacagatgatgaatactacctggatgaaaatgacaaagagtcagaactgtgaggctttttcaataaaatgctttacttttttcccaaaagcttataatggactaaggtgnacatgtgcatgtgcatggaangataaaa

SEQ ID NO: 8944 - DNA, 410 bp, Homo sapiens
ctggatttttacaatatcaagtcagcccctcccctccattattcttatgaaagtctggctgctattcctttctcagcaggttctctaaaagaagctctagaaaggaaacaaacattattattggtagtagaagtaaagtcctttggggttgtgagtctttactgtatataacacttcctttctgacctgctatttaagcctcattacagaagatgaccctgaaattgaaatatttcacaattattggtttcagttcctcaaaaacattaatggagacaattaatatattatcagagttgaatagaggtaaatcattataatcttgctgtatcagttattgctctatgacaaaccattcaaaaactcagtggcttgcctgtaatcccagcactttggggaggccagcgtgg

SEQ ID NO: 8945 - DNA, 410 bp, Homo sapiens
  misc_feature 376: n = A,T,C or G
cacaaagcaaatgtctaatttaagcacttaatttttaatgtgtgaaatctggatattttgtgatttctgagcatttatttttcatttatgtacagtaaaattaacaaaattgcagatactcttaaatgttggaatcctagttttatattatgttcaaatgttttttaagttggagagctcttaattttttatttgcatgccagcagggggcattctaatctagatacaacatttgaaagcagtattttcaaaaaatatttgttcgctttgttatattttttatttagatgaatagcatctactttcattttcttttagaaacttgagatttcaaaggaggatctagtaacattgaatctttaatagttttctgtgncacaatttttgagacagataacctttaaaaaaaa

SEQ ID NO: 8946 - DNA, 410 bp, Homo sapiens
ccgctatctgggtcaggacgcgacggccgcggcgcgggaccttaggacccgcgggctccagggctactgtccgtccgccactgcgcgccagcaggtcctggtctccgctctccaacagctgaaaggccggcgcagtgaacacagaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactga

SEQ ID NO: 8947 - DNA, 405 bp, Homo sapiens
  misc_feature 330, 382: n = A,T,C or G
acgatttgtaaggatgactgcttgtgttctgttggttgttaaggtaatctttgtaggctaaaagtttagcattttctcaacatttgggacattgtatcaattgataacactaaacactataaagaagaataaataatccttcctgttcaagccgtgccacactgagtctgtgaacgtgaaaaattatcagtattatcctgttcccccagcacaatttcattttgaaaattccattatcagttttcgagccaaacactttggtagaaagaagttagaaattttaatagaaggcagcacatgcgccctattatctaaataaacttggtatgnaaaatttaaaatctgattatagaattagagatttccaatatttttggtgganttttggttctggttttaactaac

SEQ ID NO: 8948 - DNA, 403 bp, Homo sapiens
attgtcactaaatttttataatcatagatctttgcagtttactctctaagcctgatgaaattaagccaagggctggatctggcccatggattagaagcccattcattccttatccaggaaaggaccagagaatagttaattaagaatgtggctttaacagagctaaactgcttggatttgatttcctgccctgccacttattgcctataatttttgacaaataatctaacttaatctcaggttgtacagtgtgcataaaatgggaataggccaggcacagtgatcatgcctgtaatcctagcagtttgggaggctgaggcaggagggccacttgatcacttgaggccaagagtttgaacatgcagtgagctatgatatgccctgcactcttggctaagcacaa

SEQ ID NO: 8949 - DNA, 398 bp, Homo sapiens
ctcaatctttatgaatatatctaaaatggctacttaattaattttgttcaatgttgtcccgatgaattcagagattattggtatttgttccattctaaggaagaataaattaaactaatgaagacataggcagccagtctggcatcactgagcacacagacctagtattattgacagagcaggtggaaatctcctgagttctgggcatatctgcggatgaaaacacactgccttcattttagagaggtgcaagacagaagggctattggagacgtaaatttatgttaaagaacagagaatgtccctctcttttttccttaccttaaaaacaaaacaaattctttggatatgatagtataaaaatacaaaaccctctgctttcctgtaattataatgct

SEQ ID NO: 8950 - DNA, 398 bp, Homo sapiens
ggatgaggcgctgcagtctctgcgctttcgacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgc

SEQ ID NO: 8951 - DNA, 394 bp, Homo sapiens
gtaaaacagcagcatggtaagttaaaaaaaaatcagataatagaaatgttaaaacaagaatggaatttattaagtgctaaaaattttacatttttaaacttcagagatttaagtccactgatgttaaaagctgccttgtagtagaaatagtataatgtggaaaaattagtctgtcctttttaaaaattgggaaacaattctccaacatctcttgaaataactagagatatctggggaggttaccaaacctgaatgaagagtctcaaatcccaagaaagcattgtgtacattttgcttatgaatattggtagttctgtattgtataataaatcttactccttgacttggttatatgtaattctgggctccttttttatattttagatggaacaga

SEQ ID NO: 8952 - DNA, 394 bp, Homo sapiens
atgatcctttgctgcctaactacctcaacggcttcgagtgtttcgtctgtgactacgaactggctcggctggatgccgagaaagcccacgcggcctctcccggggacagccccgtctttgagccccacattgcccagccctcacacatggactgcccagtgcccacacctggctttggcaatgtggaagagattcctgagaatgacagttggaaagagatgtggctgcaagattattggcaaggtctggaccagggggaagctctcactgccatgatccacaacaatgaaacagagcagacgaaattttgggattacctacatgaaatcttcatgaagaggcaacatctctaagtgcccttgcaagagcctttaacttggcggagctaaggaga

SEQ ID NO: 8953 - DNA, 396 bp, Homo sapiens
ggctgcccttcttccctgcggagggagggcctgggcggtcgcgttggcgggagggaggttacctttcccagtctcgctctggccgcctgagccaggaggaagcagcggcgaggtctgcgggaggcatggcgggagctccggacgagcgccggcggggccccgcggcaggggagcagctgcagcagcaacacgtctcttgccaggtcttccccgagcgtctggcccaggggaatccccagcaagggttcttctccagcttcttcaccagcaaccagaagtgccagcttaggctcctgaagacgctggagacaaatccatatgtcaaacttctgcttgatgctatgaaacactcagttgtgctgttaacaaagatagacacttttcttgcgaagactg

SEQ ID NO: 8954 - DNA, 385 bp, Homo sapiens
  misc_feature 348: n = A,T,C or G
ctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagtgtctctctagaagtgcctggtgtggaagaaatgtttgctgaatgaataataaaaacatcaactgccacttattcctcagtagcacttacaggttctgtaactcattatctcacttgattttcaccacataccatgaaagtatcaccattctgcaagcgggaaacctgagattcagaaagntggtggtaggggaccttggccctggtgggcagcaagc

SEQ ID NO: 8955 - DNA, 487 bp, Homo sapiens
  misc_feature 10, 19, 20, 21, 22, 30, 34, 36, 41: n = A,T,C or G
tagtatactnaagttttcnnnnggaaagcncccngnctttnagcaggatcccatcgacagcaacggctggtttatttgttcaggcagtgcttttacatgaagacaaaaagaaacaaaaaacaacaatatttttgagtccccagtcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagtcatgatgtatgtatttaagccacgttaaaagaaaaaatatactatgg

SEQ ID NO: 8956 - DNA, 415 bp, Homo sapiens
  misc_feature 147, 148, 152, 160, 161, 168, 170, 176, 177, 183, 186, 188,190, 194, 195, 200, 201, 203, 206, 209, 210, 219, 220, 226,230, 231, 238, 245, 246, 250, 251, 253, 255, 256, 259, 263,278, 283, 285, 292, 294, 295, 300, 308, 309, 317, 321: n = A,T,C or G
  misc_feature 325, 327, 331, 334, 336, 343, 350, 351, 354, 355, 358, 361,362, 365, 369, 370, 373, 381, 386, 387, 388, 392, 394, 397,409: n = A,T,C or G
taataagatgttataaaaatataacattttaaaaaagaaaggtccagaccttaagcgcagagctagaacaatattttttaaataatggggggaaaagggggcactttggtaattttagaaatcaggtagtatacttttttttttttnnaaanggggtttnnccttgtngntaaggnnggtttnaancncngggnntaaannantcntcnngcttgggcnnccaaangggnnggaattncgggctnnaccnncngnnccnaccnggaaaacggggtttnaaaancngggttancnnggccntttggagnnttaaaaanatantggntnaaanttnantagggcngggccanntcnnaangtnnttngcannggnggaaaaanggccnnnaatntngantttttttccccnaccctc

SEQ ID NO: 8957 - DNA, 407 bp, Homo sapiens
gccattctttggtggtaatatcatttcttgttgcaaagatgatttgagacactaactacgttgtaaaatgccccaaaattaccatgatttccatcatagtttaagtactagttttcattattgttggtctcaaattcagagatgaataggaatgatggataggatttatttaagtatatatcttaggtatacatttatttagtgtgtgctgattaatgtgaaagttaaggtataaaacctagagacaactttcagggaaaaaaaaaagatatcatattaaatgttttagaagtagggattcccattctatattgaagataacatagtttcaacacttgattattataattttttggggttgggggaacatgtaataaagtaaatgtgtgtagttgtagtagagttct

SEQ ID NO: 8958 - DNA, 405 bp, Homo sapiens
ccagcctgggcgacagagcgagactccatctcaagaaaaaaaaaaagaattttcattagtgctggccgggtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgggaatattatcttctatacattaaaacagttctagtttgtagaataataccatacaagttttatttttaaattctagttattttcagtgcttacttaaatgtaattctagaatt

SEQ ID NO: 8959 - DNA, 418 bp, Homo sapiens
gtaattagtatttgccatataaaaaatgtggcttgagcaagatgtacttcctgagtgaccctgggcaaattatgtaagtcatccatgaaatggaaaaaataacacctatttcttggggggggactaaataaaagtgctctcttctgaggctgtggtgctaaaatcctttacgttggctcattggatcctcatgtgtaaagttacttagaatggacggttgtcataatgaatatgtggtaaatatttaattcccttctagagtgatgtgctgggccttgggaggtagagagatgaatcgaaagggaatcctctgtctcaggctcagcttctgctggagggggaggcagatattttcatggattattacattcgaagggtgatatggtttgctgtgtccccaccaaatctcatctcaaat

SEQ ID NO: 8960 - DNA, 411 bp, Homo sapiens
gttttattaattggcagtggaaattggaatgtgatttaaggaagaaaacagacttttctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctctt

SEQ ID NO: 8961 - DNA, 405 bp, Homo sapiens
ctacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggtcccaccctccacgttatttc

SEQ ID NO: 8962 - DNA, 419 bp, Homo sapiens
cacaccaggtatgtcacaacttgtgcttttgcacctaatacccttttacttgctactggttcaatggacaaaacagtgaacatctggcaatttgacctggaaacactttgccaagcaaggagcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagacttatgaaagat

SEQ ID NO: 8963 - DNA, 391 bp, Homo sapiens
tatacatttttaatacattttacttttcctgcatggactgttttcttcacgttgagttgtattttaagtgtttcatggtaaactttcctgagatgtttgctaatgttaatctgcttaatagtttttttttaaattgaggtgtatgtacatacaataaaatgtgtatatcttggctgggcatggtggctcacgcctgtgatcccagaacttcgggaggctgagacaggtggattatggattcttaatttactacagtttagtttatgttagttggttttattacttcccaggaaatgcaagaaccgtacatttagctctttacctccttcttgtcctttgccctattgatggtatattttcttataaacctctaaagcaacagtattattgt

SEQ ID NO: 8964 - DNA, 393 bp, Homo sapiens
aacgaatattgttagtagacttaataagtaacccatctgtatacatcactactttttaaatgtctgtggttacttttgacaataaaaattccaaatacaactgaagtcaaaatttttcattttttttctctgacaacagaaatcaaaagtgcaattggtcattgtttaatgttccaaaaattcctttctgacttgaaaaaaaaatgttattatagaggcattttactttcagaagttaagaattcctgcatatgagtttagaaaactaatggagttacgagttaccagcctgtaagtttttatcttaggaaatatggctttctaaaggcatcatttattgtcagggaataaaaagtaataaaataaaaagtcatactttttctgccctttttc

SEQ ID NO: 8965 - DNA, 400 bp, Homo sapiens
  misc_feature 386, 395, 396: n = A,T,C or G
gtctactttaatcatcaatatgctgttctctgaacataccttatactttcctagttcacatctaagataatatgcttccctctgcctgacacaccttacacattcttaagaacccagctttgacatcacttccatgaatcctaacctgaaattaactctgtcaatcttaattacagtcatctctgacctctataaagctgtacttgtttgtagttatttatctagcaatcttttctccactattagattgttagatcctagaggacagagatcatcttttataaatcctgggtctcctttcacaatgtcaggctatagaaaaaatgatattacctataataatagctcagttaatatggccattggaaatggcctgaatgctctgnactaaggtnnccat

SEQ ID NO: 8966 - DNA, 401 bp, Homo sapiens
ctagaattgaaactactaggtcaaatcattcattttttctttctctctcagaaaattctgccaaccctgggaaatgccagtgttactgtgttttcaccgacactggatgttatcagtctttatttgttgtcagtctgagagtcagtcaaaagatgggaactcagcattgaatatgtaacttctgtaattatgaaagtactatccttaggagaatatgttcttgtatttaggttgatttctagcccttccaaaaatgagaatttccttacattctctggaattccatgtcctaggctcagtaatgaagctaatccctccctcctggggttgtctgagtattgtatcgaaaaataaaaaatgtctgacatagcttattaactccattaactatgtaggtctct

SEQ ID NO: 8967 - DNA, 397 bp, Homo sapiens
cattacctgaaatatttattccgtcaaccccctctcccatcctctgtggattttactcagagccagggaagttctgggtttctttgcattaacaaagttatgatgttttgtggaatgaaaaatggagcaattcgagtctatgtcctaaatcaaaatgatccttcattgaccagtttggtggactactggcacttcaatatgcatgacaataattatggatgtattaaaagtattgctaatagctttgatgatcgtttcttggtgactgctggagcagatggcaatatctttgttttcaacattttttctgaatttatgctaaggaaagacatgaaggccaaagttccatctcccaggtttggaattgaaacagagccaattccagaagacattgaag

SEQ ID NO: 8968 - DNA, 395 bp, Homo sapiens
  misc_feature 151, 153, 160, 192, 196, 203, 205, 229, 249, 255, 261, 269,288, 293, 306, 329, 330, 333, 335, 364: n = A,T,C or G
gtgtgatctctgcacacaccagctcccctttgctttctgccatgagtggtctgaggctctcaccaaaagccaagcaaaggctggcaccatgcttctagtacagcctgcagaactgtaagccaaataaacttcttctttgttttttttttgntnggtttgnttttttttcagaaaattacccagcctcaggtnttcnttaacancncaaaggggctaaaacacagggtcntagggatagcaggcccctgngccaanccaaancttaaatntcaactgttaatgcaggangattngtattgaaccatnaattttacactgcctctcaatgnnggngncagcatttaagggtatttaaaaaatacancctgaaggttcataaaggttcatttaaaaaa

SEQ ID NO: 8969 - DNA, 383 bp, Homo sapiens
gtggccatcaagccaatgcctttgttattttcctggactcaccttggattggagaaaagttaatcagtttccagaaaggtaagagacccagtggagcagggccttttgagaatgaaaactgaccttttctttcactgttattgttgtgatttccctggaaatatattcacccccagttttcctgggccaatataaagttgttcattttgctggcttggaaatgttattctctctccttgttttgaagtgttaaatgtgtggttttcaaaatgcatttctcaaaccactctacggaaagacagcaaataatctgataaaaaaatgttcaaggatgcctgtaatcccagcactttgggagggaggccgaggtgggcaaatggctt

SEQ ID NO: 8970 - DNA, 372 bp, Homo sapiens
  misc_feature 359: n = A,T,C or G
cgacagcaacggatctgttatctcaacttgagctttcccaaagcctaaggacggtccttgcctgtaaactccaagatgtcattttctctgtttccatcacacccacttcatcagtcgctttccctaattctcagggagccccagagcatgtgcccttccccaccttgccttactcagccgctcctggactgtctgtccaacctcatgactcagccgggcttcacaccagcgccctcagcaaacaaacaccaattggaactcttgaccagaatatttctaaatgtcagcttgtcctcaccctccacgcagctgttgcttctgttcccaggagcccattattccacatggttatgactcanggcactgaatcgt

SEQ ID NO: 8971 - DNA, 392 bp, Homo sapiens
gagatgatggctgatgaagaggaagaagtcaagccgatcttgcagaaattgcaggaactcgtggatcagctctactcatttcgagactgctatttcgagacacatagtgttgaggatgctgggaggaagcaacaggatgtgcggaaggagatggagaaaaccctacagcagatggaagaagtagtgggttctgtccagggcaaggcacaagttctaatgctaactgggaaagcactaaatgtgactcctgactatagccctaaggctgaggagcttctgtcaaaggctgtgaagctggagcccgagctggtggaagcctggaaccagctgggtgaggtgtactggaaaaaaggggatgttgcagctgccacacctgcttctcaggagccctc

SEQ ID NO: 8972 - DNA, 396 bp, Homo sapiens
gctttacttctgattgagctctgttattctctggcacagtcttcctaagaccaattaatagtgatcatggcagtcagcctgttatcttaggattcaaagaaaatatctacataaatatagcagtcaatccattgaagtagtgactacaatactgaacctgaataaaatttagtttactaaatgaagatatgcagattcaataaatgattatggaccaacatttcatcagcaactgctataaatgtgaaaaatcattatttttcatatatacacatgatcatcagacccactaaaggtaattcatgtgaccaaaactttctgctgctaagagattaaaatgcatgttaatcagtagaatttaagaaagccagagtaaaatgtaaattgtgatgaaat

SEQ ID NO: 8973 - DNA, 415 bp, Homo sapiens
gtgtgtgtgtgtgtgtgtgtgtgagagagagagagagagaaagaggtgtgtatctgggttatgagtcatcatacagcagcttagcttagccctaagtgggcattctcagagttacaagagcagcaagagggcgagccccagtggccagatgcaatggtgcttttgaagtctgcataggtcatgtttgttattctcatgtggccaagtccagagtcagtgtggatttacccaagtgcttggatacagagagacatgaacaaatttggggccatcactatgtcagtctacctcaaaagctcttccaatttttaattgttggtaactaataaaaattaataagattttaggtgctaacattgcaggttaaacaaaacctgcagtgggctagatctgccttgggtaaccattttatcat

SEQ ID NO: 8974 - DNA, 419 bp, Homo sapiens
atcaccactaattccagaacattgacatcccagtaagaaaccccatacccattagtcactccccattcctccctactcccagccgctggctaccactaatttactttctgtctctatggatttgctgattctggacgttgcatataactaggaacataacaacatgctactagcttctttcacttaacataatagttgcaaggctcatccatgctgtagtatgtttcagtactttcttcctccccctacccattataccatttactgatgatagaattatactggaaaactgtcacaaaagaacaatctttgaatagaaccgtttactaagtgaaacatttcttgaaatataacatgcgaaagattgtcaaacatgtcagcatagaagcccttggatttatataaagactctcgcgagg

SEQ ID NO: 8975 - DNA, 408 bp, Homo sapiens
cttaatataggatataagagttttcttggactttgaactgtggacaaaatctacaggaaggggaagaggtgaatattccaaatcagacactggcaagagcgaaggtgcagagacaggtatgttcgtggatttctgggctatggttaacgaatagaccatctggagcacatggttgattttggcgtcagtagaaggctaagttggaaaggcaggattacatcagattttggagggcttgaatgttaagggtgggagggaagtctttcacttttatcctgcaggcaatagagagccattgaaaatttttattttcggtagtttattaggaagatgaatctgccgagtgggttggaaacaagaaagattggaagataaaccaactggatagggtcgtctggatttcaaata

SEQ ID NO: 8976 - DNA, 404 bp, Homo sapiens
gacgtggcctgtggcacaggcctagtggctgccgagctgcgggctccaggcttcctccagctgcatggggtggatgggagcccagggatgctggaacaggcccaggcccccggcctctatcagcgcctcagcctctgcaccctgggccaggagcctctgcccagcccggaagggaccttcgacgcggtgctgatagtcggtgccctcagtgacggccaggtgccctgcaatgcgatacctgagctacatgtcaccaagccaggtgggctggtgtgtctgaccaccaggaccaactcgtccaaccttcaatacaaggaggctctggaggccaccctggacaggctggagcaggctgggatgtgggaaggcctggtggctgcctgtggaccgctgtggaccgctgg

SEQ ID NO: 8977 - DNA, 421 bp, Homo sapiens
ctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcatactggagctacaggcgagaggcaa

SEQ ID NO: 8978 - DNA, 475 bp, Homo sapiens
  misc_feature 7, 11, 14, 15, 16, 32, 40: n = A,T,C or G
ccgattnttcnatnnnacttctggaaatcccncaggattnatcgattcgaacccgttgctgtcggcaccattgcactccagcctgggccacaagaatgaaactccatctcaatcagtcagtcaatcttgcagatattggagtgtttcagatttcagatttggggtacttaaactgtacgtgaaaattagctgctggggaggagaggaattggaatatgtaacatggactcccacattttaaggatttttctaggactgcatctttctcttaataagtcagatccttatttggttgaaaatgtttactgcatgactatcactgactatgtaagatgctgatgtacaactctatgacttgaagattgagttgcttctatgggaatatgacaccatttgaattaatttggtctcaatattttaaagaagtttaatgaattctgttcatataaaatcaaggtcaataatgcgggctttt

SEQ ID NO: 8979 - DNA, 485 bp, Homo sapiens
  misc_feature 23, 25, 35, 39, 465: n = A,T,C or G
tttgaactccataatacaagctntnagatcctttngccngatcccatcgattcgggcttccgttatggtcttttcccattttttttttgacttctaaatcctttgcattttcgtataaaatttgaagtcaacttctatcaacttcaggccaggcccgtggctcgtgcctgtataatcccagcactttgggaggccgaggcaggcggatcacttgaggtcaggagttcaagaccagcctggccaggatggtgaggccccatctctactaaaaatgcaaaagagttggccaggcgtggtggcaggcgcctgtaaaatcccagctactcgggaggctggggcaggaaaattgcttgaacctgggaggtggaggtttcagtgagctgagatcgtggcattgcactctagcctgggcaaccaagagtgaaactgtctcaaaaaaacaacttttatcaatgctgcaaaaanaaagcttctgggatttataa

SEQ ID NO: 8980 - DNA, 397 bp, Homo sapiens
ggcggctcacgcctgtaatcacagcactttcagaggctgagtcgggcggattacttgagatttggtctcaatctcctgacctcgtgatccgcctgcctcagcctcccaaagtgctgggattacaggtgtaagccaccgcccttggcctgtttttgtttttaagagatgaggtctcactgtgttgcccaggctggacttgaactcctgggctcaagtggtcctcccacctcagccttccaagtagctgggatttataggcacaggtgtgtgccaccgtgcctggctgtggagggttcttcagaggcagagccctgggttggtttgaatccttcatgctttgtgctgctaccttggttcacttagtacagagggcagggggagtggaaagggagaagtg

SEQ ID NO: 8981 - DNA, 399 bp, Homo sapiens
  misc_feature 118, 139, 142, 150, 151, 168, 183, 188, 196, 210, 246, 258,271, 284, 285, 286, 289, 298, 302, 312, 314, 317, 321, 330,331, 333, 336, 338, 344, 345, 353, 361, 362, 363, 368, 369,371, 373, 380, 381, 390, 391, 393: n = A,T,C or G
attcgacattgcaccacgaaatgcagtgttcctgttggtctctcacagatgccgtctatcaggctggggaggtttctttctgcctcgtttgctgagagttttaaatttcatgatgtanttgtccactgcagaaacctancanaaaactanncaaattacaccccaaancaatagaattaaatngattntcaaatgntaaaccaactctgntcctgatgtcttggtgggcttggctcgctgtttctnaaaactcttganttcacattccttnacgatgttggaannnaantttttgtgntttncatttgttangnagnattntttaatggnntnttncnaactannccagttgntttttaannnaccannancnctcccanncctattttnntngtggga

SEQ ID NO: 8982 - DNA, 370 bp, Homo sapiens
  misc_feature 233, 236, 243, 248, 250, 252, 254, 256, 257, 262, 264, 266,267, 272, 278, 279, 280, 283, 285, 286, 287, 303, 305, 307,308, 310, 311, 313, 314, 315, 317, 320, 321, 329, 331, 333,339, 347, 348, 351, 352, 355, 357, 361, 363, 365: n = A,T,C or G
gcccaaaagcgggccagcctgctggagcggcagcagcggcgagcagaggaggcgcggcggcgcaagcagtggcaggaggtggagaaggaacagcggagggaggaggccgcgaggctggcccaagaggaggccccgggcccagccccgcttgtgtccgcagtcccgatggcgactccagcccctgctgcccgggctccagccgaggaggaggtgggcccccggaagggggaagngtnggaagtnttttntnancncnntcccnangnnctttnttctcnnngancnnncatttgtactttttantntnncnncnnnanctnntattcatntntncaaaanccaccatnntcnngtntntaanancnttaac

SEQ ID NO: 8983 - DNA, 418 bp, Homo sapiens
ggcccttcttcacagcagatgtatgatgattcctggacagtggtcaggatattgcctttttgtggaacttttaacagaaaaggtaactgaaggtttgagcatgtcccctttacaggggccatctttcccccacctgtgtagaggtacatgggtctttcagcggctcaaacaacacacctaagtgtccttgagtctcaccttattgtgagtgttgcttgtaagcagtgttgtcactaaatttatttcttctttaatttggtaatttaccagaatatcttcttttctagcctcgatgattatagctcgttgaaatgcctgaagcatttttgatttcttctctcttgctcatgagaattattccaaaaaaaaattttggcttccaccagtgttaaaaattggtctgtacctaaggttacag

SEQ ID NO: 8984 - DNA, 404 bp, Homo sapiens
gcattttgtaaagtgaaaaaaagctggtgaaatgatgaacagtggttaaaactgaacatgagagggaacaaggaataccttgtggtgtaaaatctctgtgcttagctgtgccaaagaatttttttcaggaaaacttgcacaagatcttggcagtggtgtcttgggctttatctttttaagtaagtgttcattactgcttacatcattgttgctattattattttgataagtgtgcattgccaaggatgctctgtgtcaggggttctccaactcccatgtgcacgagaatcacacacagggcttgtgaaaatcgcagagtccataactcccccagagaactggattctgcaggtcttgtcttggaagctgcaattttggcctttgcattaattaaaatttcttgg

SEQ ID NO: 8985 - DNA, 367 bp, Homo sapiens
gtgacatctgaggaattaaatcatacttccagatggtttggtctaatgtatacagtttaggaaagtttattcttttttattttattttatttttttaaatttcttttagaaactgggttttgctctgttgcccaggctgatcttaaactcctggcctcagatgtggagacccagctgggactacaggcatgagccaccacgctcagtagaaagtttgttctttttcagttctgtcattgaaattctctaagtgattggatttttaaaccccttccccttttcatgaaattaaacatcaaataaataaaactacattatataattatttagtcagaaatgactgttgccctctctttttttttttttt

SEQ ID NO: 8986 - DNA, 392 bp, Homo sapiens
  misc_feature 322, 362: n = A,T,C or G
gacagttgaagacgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatagaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaanaaatactatgataaattatttaaggaatactgcatagcanatctcagtaaatataaagaaaataagtttg

SEQ ID NO: 8987 - DNA, 376 bp, Homo sapiens
  misc_feature 164, 194, 222, 227, 239, 253, 254, 257, 259, 263, 264, 265,266, 271, 275, 277, 279, 285, 291, 301, 302, 308, 309, 311,316, 319, 320, 325, 330, 332, 336, 339, 340, 341, 343, 345,352, 355, 356, 359, 361, 362, 364, 368, 369, 370: n = A,T,C or G
attcctttgagacacaagccaagttttcgccctgtctcctgagaccatttccctacgctttgctgctgctgagagttacctgaggcacttgttaaaaattcagactcccaggtccctcccctcggagaggctgataaactgggtctgggaaggagcctggggantttaattattcacaagatgccccagatganactcatcaccaagcaaattttggaaaangctgncaacagcgcccntaaatcggaaacannttngnagannnnatatngaanananaatcangggcgntatttagctnncaaggnntnaagancanncaggncggananggancannngncnagagacnacnnttntnnangacnnncaaaca

SEQ ID NO: 8988 - DNA, 388 bp, Homo sapiens
ccgttgctgtcgcactgaagtccccaaacttgtcttgattggcctcctctcttcagggaaattgagaagaatgagagaaccagtgattaaagaggagatggagggaagaaagagcctaaggatatggaagaataaaggaagaaagtatgtgatttaaagaagaggagaaaggagagagagaggcagttaaatctggggatgtgggataatagacttctaattttgggctgagtagaaggtatattttgggagaagttcacacttgttttctttacttgcccaggaacccatggtgtggctcattgtgtgatttgaaagggtgaaatgcagggttatgtatgatcagaatggccaacacacatatagccaggagtgttctagagacctt

SEQ ID NO: 8989 - DNA, 408 bp, Homo sapiens
gctgaacgcgtgccgcgcggccctcacggtgcttaggctgggtgcaacctagaacggaggttcctttcgtaccgtacatccaggtttgcacagcgcgcttatgtccctcctccaatctgatcttgcaccagctctgcagtagtttttcttattatcctcattttacggaggagagggagctgtggcttaaagaagttaagagacgtgtccaaattcatacaacctgttgggcacctctttatcccgaacgctgttctaggggatagggttagtgaacaaaaaacgcaaaagcccctgaccgcctgggccttacatctattaggaggaggaagacagataaactaaggctcgtgcaaaggagaaaaataaagcaaggtgactttctgcagacttcggactcaccagtgg

SEQ ID NO: 8990 - DNA, 450 bp, Homo sapiens
  misc_feature 5, 6, 9, 11, 15, 17, 27: n = A,T,C or G
tttgnnccntnaaancngctacttganctttttgcaggatcccatcgattcgcttgagaactcatcattgtttgaagggcccttgccatagaacttgtctctaaattctcaagctctgagagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagt

SEQ ID NO: 8991 - DNA, 401 bp, Homo sapiens
cattaaagtcactaagaataaccattttttccagtatatatggaatatacaccaaaaaagaccttatcctggaccatagatacattttaacaaattcccaaagatttatattttcagagactgttttctgaataataataataaattagaagtaaaaaaaattggaaaattcctaattatttggaacttaaacatcatgtttgtaaatatccctgagtgaaaataggtctaacaaaaaatctactaaaataagtctaataaataaatttagaacatattttgaattaactgataatgagaatataccagtgataatttgagatgaaaccaaagcattcttagaaaaaaattaataactttaaaaatcctggcaagtcagagtggctcatgcctgtaatccc

SEQ ID NO: 8992 - DNA, 410 bp, Homo sapiens
  misc_feature 327, 330: n = A,T,C or G
ttccttgtgtattttggatattaaccccttaccagatgtatggtttgcaaacattttctcacttaaatgtgtatgttttatgtaaggagattgcaattataatttactatattgttcttcattattgtttgagctaaaaattgttaaatacgcatatgaacttgaatatattatacattcacatttatgttatgtatttacttatatcttgttataaatcacgtgaacacaaatttactcttaaactcagttaactaccaaaacttgaagtgtttggaaatcaaatttgtgtgttttccatgtgttctgttgtatttttttaatggntgntccagaactaagcgagttgcatattcacagggccaagaacagctgagaaacctatcttgagtaattgggaagaactgagt

SEQ ID NO: 8993 - DNA, 373 bp, Homo sapiens
  misc_feature 73, 80, 86, 90, 94, 100, 124, 132, 141, 154, 167, 175, 179,189, 191, 194, 207, 216, 223, 232, 247, 260, 265, 266, 273,301, 304, 307, 308, 311, 313, 315, 316, 326, 327, 328, 332,334, 340, 343, 345, 346, 349, 353, 355, 360, 363, 364: n = A,T,C or G
  misc_feature 365, 366: n = A,T,C or G
caagatttcatctattgaatttgggtacatggtatgttttagcagcgtttttgtttttttttttcttcctacncccaggnaaaaangctntagnatttgngaatgttggcagcaaatgactgtnccttacanagggttctntgtctccccaagnacccaaatgtggngacctggnggcntcaggacagngnggntcaccccaggaanccggggganaacccgntgcactaangctgtggttgccttnggaggttgccctnacttnnaggccanctaaccttgcctcccctgtttaaaaaanccnttnnatncnannggggaacccnnncaantncccctnaantnnaantctngnccctnttnnnnttccccc

SEQ ID NO: 8994 - DNA, 368 bp, Homo sapiens
  misc_feature 136, 139, 142, 143, 151, 152, 165, 176, 180, 183, 208, 211,234, 237, 239, 242, 245, 249, 252, 254, 255, 279, 285, 286,289, 294, 295, 296, 297, 299, 302, 305, 307, 309, 310, 313,314, 318, 321, 328, 329, 332, 335, 336, 337, 347, 358: n = A,T,C or G
  misc_feature 361, 363: n = A,T,C or G
gaagactcaataatgtcatgtcagttctttccaacataaccatatattctgtgcagtttatggacttgctaaattgagatgcatttaatatacccaatcaaaatcccagcaaatgattttgtggatatctccatangcntannacacctannaaacccagaatanctaatacatcnttgnaanttggaatacgacactacctgacttnaanatttactgtacgctgccttaatnatngnttnacngtcnggngnnttaatatacatctaaatctttatntctttnnttnaaatnnnnanatnttnancnnccnnttcntcntttgatnnttnctnnnaagcttatgnttttctttatnaananttcct

SEQ ID NO: 8995 - DNA, 380 bp, Homo sapiens
  misc_feature 232, 234, 243, 245, 247, 252, 258, 260, 264, 270, 279, 285,287, 290, 291, 300, 303, 305, 307, 308, 309, 310, 311, 325,326, 332, 333, 336, 340, 341, 350, 360, 364, 365, 368: n = A,T,C or G
gaaaatatttctaaaagcatcaaagagattctagatatgtgaacttccatgtaaataatggtcattatttacaattaagaaatcctggccgggcgcggtggctcatgcctataatcccagcactttgggaggccgaggtgagtggatcatgaggtcaagagattgagaccctcctggccaacatggtgaaactctgtctccaaaaatacaaaaattagctgggtgtggtggngngcacttgtngncncggtncttganangctnaggcangaaaattgntttaancntgnngggggaatnccnantnnnnngccccaaaaaaaanntttttnnggnaatnnggggggggntccttttttncccnntcntttttttttttt

SEQ ID NO: 8996 - DNA, 461 bp, Homo sapiens
  misc_feature 6, 7, 11, 14, 19, 20, 28, 213, 219, 220, 224, 225, 231, 232,235, 237, 238, 242, 243, 252, 253, 257, 262, 263, 268, 278,290, 294, 299, 301, 308, 311, 313, 315, 321, 325, 329, 330,332, 335, 337, 338, 340, 342, 349, 350, 351, 352: n = A,T,C or G
  misc_feature 354, 355, 356, 358, 360, 364, 367, 375, 377, 378, 380, 387,391, 392, 393, 398, 400, 403, 408, 412, 416, 420, 421, 422,435, 439, 440, 443, 445, 447, 448, 455, 456, 457: n = A,T,C or G
tcgaannactncgnaaacnnctacttgntctttttgcaggatcccatcgattcggttcatctgcagcccttgcctgaggataaggtttatgattgggtaaagatcagaataccagggccagctaaggcaacgactccctccccaaacccttgggacctcagccagtcccaaggctgccctgacaatcaggcaggctccccaccgtgaggttantttttnntttnntttcgnnacncnnttcnntcttttttnntttngtggnncacanccttttactntttcattcctcncaangtgtntnttttaanaananancactcnttcngtcnntnggngnnangngtatttnnnncnnntntntaantanaaatagtngnntnggctctncctnnntcagnanaanaaatntggntatnaaannnctccttctatgcngggnnaantnanngcactcnnnaaaa

SEQ ID NO: 8997 - DNA, 403 bp, Homo sapiens
  misc_feature 205, 212, 232, 234, 242, 243, 244, 248, 256, 257, 258, 259,260, 264, 266, 268, 269, 276, 277, 278, 281, 285, 291, 292,294, 303, 309, 312, 315, 319, 322, 323, 324, 325, 326, 327,328, 329, 330, 331, 334, 336, 337, 338, 339, 342, 343: n = A,T,C or G
  misc_feature 345, 355, 356, 358, 359, 363, 372, 373, 377, 378, 379, 380,381, 382, 385, 389, 390, 391, 394, 395: n = A,T,C or G
aactgaaaatgaaggatcagtcattgagaaaactacaacaggaaatggacagtttgacatttcgaaatctgcagcttgccaagagggtagaactacttcaagatgaactagctctaagtgaaccacgaggcaagaaaaacaagaaaagtggagaatcttcttctcagttgagtcaagagcagaagagtgtctttgatgaagatcngcaatcnacgatagaagagaatgaccntntttatacnnntggnttgatctnnnnnatangncnnttttttnnntcntttntgccannanaaaaacttntttttncanttncccnccnnnnnnnnnnttntnnnnggnntnctcataaaannannttantttcttttnnaacnnnnnnttntttnnnccnntttttttg

SEQ ID NO: 8998 - DNA, 407 bp, Homo sapiens
aaaatattaaacacaaactaccacctacctcccgggccctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagacccatgtaagatatgtgtgcccttcctcagggtgttctgctggttgtctgatgatggtgtcagggcagctaaggacaggataaaggcctggagagggtgcttgtgcccttatgttatcagcaccgttgtcctaggattcgtgaggggattctggaaccaataagggagttgaactggacctgat

SEQ ID NO: 8999 - DNA, 420 bp, Homo sapiens
ggtatatgcaaacaacatttaaagagctcttcttattaaaaaattttaaattataataagttaaaattataataatctaagtgtttgtattacttccatgctacggataaggaaattgtgtctcacagaggtttcatgcgttggtcaaaattacacaaaaagtaaaaggcagaacctgaaaataagggttcacatcttaggactccaagatggtatacacatttgacttttttgtctttaaacttgctgtgaacatttttccacttttgattcttaagtataaatattaagtgccttctttgtatttcagtattaggcttttaagtcttctacttccaaaaaaaaaattaaaagtaaaatttaacaagcattctaaatattccaattatgaaatatatttcatattatgagaattttctt

SEQ ID NO: 9000 - DNA, 382 bp, Homo sapiens
  misc_feature 66, 68, 70, 74, 84, 103, 108, 112, 123, 128, 141, 150, 151,157, 161, 165, 168, 171, 182, 194, 196, 217, 226, 230, 234,241, 242, 246, 248, 268, 282, 293, 296, 300, 322, 332, 343,345, 367, 372, 374: n = A,T,C or G
ggtaagacttatattccattgtggatgtatgtgggaaactttaaattgtgactttctttttttttngnanacanagttttgctnttgttgcccaaactggagngcagngccnaaattgccccnttgcnctccaccctgggngatggaagnnaaaccntgtntcancancancaacaaatccnttggagtagttnanctaaagtacctaaataagganatttgaggngaangggnggtccannggtntnccaaaggaaaaagtaaaaanatttgggttaaatnttaaccaaagncancaanaaaagaggggagttaaaaaaanacatctaaanaggaggcttancnttatgaaaagtgccggaaatancttgntngtgtttat

SEQ ID NO: 9001 - DNA, 429 bp, Homo sapiens
  misc_feature 262, 265, 270, 276, 282, 286, 294, 297, 299, 303, 310, 317,327, 330, 332, 346, 350, 358, 363, 372, 384, 394, 403, 414: n = A,T,C or G
gtcctgacctcaagtgatccacttgcctcggcctcccaaagtgctgagattacaggtttgagccaccacgcccggccataaacatttttctttttggacaaaaataacattattatagacattttagaaaatacaaaaaaaagaaaagcaaaattaaaacatattcctgagtgaacattttggtttatagtttttgagagttttccgtgtggataaaactcggtggaaaacaaaaacctgaaaaaaaaaaaaactaaaaaanaanctttnggggtnctgagncccnctgaaaanttntngggnggaaatncctattngttttttcangtncntgttactttaaatnaagnttttccancccgnggcccaaanggggcccagganggttttaaangcggcccancataaatgggnaaatttttttaaaac

SEQ ID NO: 9002 - DNA, 420 bp, Homo sapiens
aggactattttcacgttttaatgccgagaggtctctgtgacgattttggttggttgcaattagggattctgtgaagtcagtaatagaggagttgtctgtggaattagtgatggtggtttcggggcatggtgatgggggtctgtgacgtccgttgatggttgtctgtgacagggatttctcgggtcattgatggggctctttgggatgagtgattggggtttgggggtcagtgacgggagtctgtggtcagtgactgagggcctgtagggtcagctatggtggtcggtgaggactgtgatcagcttgctttctgacctgagttgaaagttcagttctttccatttcagcctgtaatataaagattaacaagttttgatgtgtagcaagtttcgtattggtcaaatctaagtgtttaaaaat

SEQ ID NO: 9003 - DNA, 417 bp, Homo sapiens
ataaacttcagacctgcatttcagaataccatccagaaaatccattttgacctcctgtaaccctccagcttagcatgagcaaacctaaactcactgtctcctccagctcacttaacagaatttaatccacctatttttgtaaactagcaattctgaagatgttctgagcttcttctccatcaccatatacactctcttgttcatcaagtactgataaattttttttaagagacggggttttggctgtgttgcccagactggccttgaactcgtaggttcaaacagtcttcctgcctcagcctcccaagtagctgggactacaggcaagtgccactgcgctggcttaattttacttgagtcatgtgtctcaaatctggcctttcatcttggtccacacgcaggccttcatcacctctt

SEQ ID NO: 9004 - DNA, 394 bp, Homo sapiens
atgctgtagactgaattgtgttccccaaaattcatattttgaacccctaatcccccatatgactattgaaaatagggcttcaggtggtaattaagataaaatagagtggaaacctgataagacaggaaggccttataataataataagagataccagagctctctcttccttgtgagaacacaacaagaactcagtttcaccatgcccagctaattttgtatttttagtagagatggagttttattatgttggctaggctggtcttgaactactgaccttaggtgatctgcccaccttggcctcccaaagtgctgggattacagacgtgagctaccatgcccggcctcttccagtctattttctaaccccatttacacttctccctcacactcc

SEQ ID NO: 9005 - DNA, 417 bp, Homo sapiens
  misc_feature 347, 360, 398, 408, 412: n = A,T,C or G
cttcaccctgatctcccaaatacaaatacctatgtaaccatattataataatcaagattaagaaattaacatgaatataatcaggaaatcaggcattactattataaaatctattaactgtacttaaattttaccagttgtcccactgatgtctttcttctggtctaaaacccaattcaggatcacatgttgcatttagttacttttaatctggaacttatgaacactttgacaaatacttgtcagtattttgtatatcctctctcattttggttttgtattgcatttttcatggttaaattcaggttaggcatttttagcaaaacatcaaagtcatgtgcctcagngaatttccatganttggccccttactggtgattttaaccttgatcacttgntaaggggganctgncacat

SEQ ID NO: 9006 - DNA, 493 bp, Homo sapiens
  misc_feature 11, 29, 32, 34: n = A,T,C or G
gaaaaaaaaanttttgaaacccctttggnacncnttaatacaagctacttggtctttttgcaggatcccatcgattcgcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgccaaggaattga

SEQ ID NO: 9007 - DNA, 414 bp, Homo sapiens
ctggctcctactacctgtctcactgtgtttcctactactctcctgccctttctcctcttaataaacactgggctcatggtgtttcctttaacatgccaggcatgcttgaccctgtcctgtctcagggccctgctgttccctctgcctggaacattcttcccatagtgtctgcatggctcgctctctcactgctttggattgctgctcaaaagtcaccttatcaaaggcctttcccaaaggtttaaaaatcattctactataaagacacatgcatacatatgtttattgcagcactattcacaataacaaagacttggaaccaacccaaatgcccatcaatgatagactggataaagaaaatatggcacgtaagcaccatggaatactatgcagcataaaaaagaatgagtcatg

SEQ ID NO: 9008 - DNA, 487 bp, Homo sapiens
  misc_feature 6, 7, 10, 17, 20, 21, 24, 424, 470, 477: n = A,T,C or G
ttggannccntttgagnacnntanaatacaagctacttgttctttttgcaggatcccatcgccttactcttatttgcttagcttggggtttcatcaaagcaggcacatttgcaagaagtcatctacttattgaacaactctcaggaaaagacataaatgtcattttgttttcaccttctatgaatcatagttggtatcttcaacagagacagcaagtgcaaaatgtctggaaaaatctctgagttagaaaagacttacagaaaataagcaaatttaggttaaaaatgccccatctctctctttttctgaaacccagacatacacacacagagtcatcctgtttgcttgcaattttaatctataaaaggtactcataggtaatttaaattctagtgaatcatccctttggaaactaattgaaagnttttttattttgaaatatcaaggcatttttctttaaaattctatangaagtangggcttcagg

SEQ ID NO: 9009 - DNA, 452 bp, Homo sapiens
actatagaatacaagctcttgttctttttgcaggatcccatcgattcgtcataatgtaagagataatttaggccaaatattgacttggagtattaaacagattttgtaaaactgaaaaacaaatggaatcaagtgagtatattttggatactttgaaaacaaaaatacatagtcatatttgggctttgttaactagttacagaatcaagaaagcttgaagaagtttgaaggttacactggctaatcatagttaaaatataatggaaatagaaacataagaagttacattgataattctctaaggttttgtgtaatgggaaaaaaacccaataattttagtgactatcatattccttttactacatctttgggtgtatagtttaacttcgaacactcactgatttcaggccattcagtccctttggcaaaccaacataaaaatcttttttttt

SEQ ID NO: 9010 - DNA, 154 bp, Homo sapiens
actgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtctttttttttttttt

SEQ ID NO: 9011 - DNA, 413 bp, Homo sapiens
gttctggaggctgggaagtccaagatcaaggggctgctctggcaagggccttcttgctgcatcatcccatggtggagagtggaatggcaagacagatcaagaggggacctaactggccttttataaggaacccagttccacagtaatggcattaacccatccatgagagcagagccccatgatctaaacaccttttattaggccctgcttatactgttgcactggggatcaagttgcagcacttggacttcgggcaacacattcaaaccatagcaggcaccttaataaaggtggaaaagggatgtggcagctacagtgggagggaaaaggtggctcccttagtgtgcttgggaggagggtaagagatgcgtttgcagttctcatggccgcagactgaaggggcctggttacct

SEQ ID NO: 9012 - DNA, 460 bp, Homo sapiens
tctagaatacaagctacttgttctttttgcaggatcccatcgattcgcacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcataagtataagttttttctgtaagtcc

SEQ ID NO: 9013 - DNA, 373 bp, Homo sapiens
atcccacagacagcagccagccacgtggactcctccaacgctcttcccagggatgagcagccgcccgctgacatgcttcggcctgacccccgggacaccctctatcgagtgcctctgatccccaagtcgcatctccgccacgtcctgcctgactgtccctacaaacccagctatctggtggatgggcttcctctgcagcgctaccagggactccggtttgttcatctgtcttttgtttaccccaatgactatacccgcctgagccacatggagacccacaataaatgtttctaccaggaaaacgcctactaccaagaccggttcagctttcaggagtacatcaggattgaccagcctgagaagcaggggctgg

SEQ ID NO: 9014 - DNA, 390 bp, Homo sapiens
ctttttttttgtttgtttttcttaatagatgcgctctgactttgttgcccaggctgatcttgaactcctgggctcaagtgatccttcccgccttggcctcccaaagtgctagggtttactgcgtgagccactgtgcctggcccaggttggtcaatctttatctcattgcttagagagaacctcctctggaaatcttcctctctcggtagcttattcctctctagtattgggtcctgagaactccagagtcttagcctccctggacttctttctagccttatctccttgacttacaaaggctcctgaatcccatgtgatttcccccttctttgcaggatagtttggaaacttcagtcagttaaactggtttgatcaaaaagcttacataat

SEQ ID NO: 9015 - DNA, 389 bp, Homo sapiens
gtttcagaagggcatgaaaatcaacatggacaagaatcggaggcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggaatgagtgcagagcacaggtggaccggtttcctgctgccagacttcgtcgtcgtctacactgatggctgctgctccagtaatgggcgtagaaggccgcgagcaggaatcggcgtttactgggggccgggccatcctttaaatgtaggcattagacttcctgggcggcagacaaaccaaagagcggaa

SEQ ID NO: 9016 - DNA, 411 bp, Homo sapiens
  misc_feature 341, 348: n = A,T,C or G
gaccacctgattgcctcctcgtgctagaccttgaaccagaggcactccgctaagctttctgacccacagaaactatgagatcataaatggattgttttaagccactaaagatttgaagtaatttgtcatgcagcataggtaactaatacagtagtgtacttatttgccaaagtaataatttttaaaggaatacagcaaaatataagactccatcataatctggcatgcaataaaaaattactagacaatgaagaagcaggaaaatgtcacctataaccaggggaaaaatcagtcaatagatgcagacctagaacggatagaaatgataggattagcatgcngcaatgnaaatatgatctctgcttaaagtatgtgaagggaagcatgcccagatgaagaaagaaatgaaaa

SEQ ID NO: 9017 - DNA, 449 bp, Homo sapiens
  misc_feature 9: n = A,T,C or G
tagttttgnactatagaatacaagctacttgttctttttgcaggatcccatcgattcggcgcttgcacgctgcaggagccgcaaacgtcagctgttctggaaaccgagagggtcccagagagaggagatacgggcgcatttgagagcaagggcctacttggccgggactgaagcttgcgagttgagctccagttcggccggcagttccatcccgcttcaggaacaggaatccaagggcccacgctctgtctgccaagggccattcctgcccggagcaccctcctttcccttgcgcttgctctccggtacctgttccgcacctgagctcaagggcagggagaggccgggcctctggcagtccacgaaggaagccgtctgccttcggttatgattttaggaacaagtccaacgagggtgttcaagcaagttaatggttgtgctaactcttg

SEQ ID NO: 9018 - DNA, 365 bp, Homo sapiens
  misc_feature 184, 194, 233, 235, 242, 253, 257, 281, 290, 302, 306, 311,315, 317, 318, 319, 320, 322, 327, 330, 333, 343, 347, 350,352, 353, 357, 361: n = A,T,C or G
gagagccgggcggccgaggacggcttccgcaaggcccagaagccctggctgaagaggctgaaggaggttgaggcttcaagaaaagctaccacgcagcccggaaggatgataagaccgcccatacgatggatagccacgcaaaggcaaacggcgccgtctcccaggagcagctgctcaaactgcnagaacgggtngtacgctgtgccaaggaggccgcgaagacaaaagcttantntgatcantccctggcaanctgnatcgctcactccacgctacatggnggacatgtncatgcctttganaccngccangccntnnnncnccagnggnttnttttctttanggtntgntnntcancttnttct

SEQ ID NO: 9019 - DNA, 391 bp, Homo sapiens
agaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatt

SEQ ID NO: 9020 - DNA, 401 bp, Homo sapiens
  misc_feature 397: n = A,T,C or G
gaggattccgctctttctccatcagtttcatagccctggaattgtagaaaagctctggtttcaagaccattgatatccatttctgtcagggtgtcagacaaagagaaaattgaccaacttcaggaagaacttctgcacactcagagcaaaatttggaaggtgtaatgatagaaccttattattatcgatagatgcaaaagctaattgagaaataaggaataaagacagaactagataagtatggagttaactcatttatatgtaaaaacctattttgagtgaatcttatgcccaaaagggagaaagtggcttgccttatataaacttatgcttgcatttttacattgataagctaatcaggtaaagaaattcgagttgggctaccacatcgtctagnggct

SEQ ID NO: 9021 - DNA, 405 bp, Homo sapiens
tgcatatgtgatgagatgaagtgaggtgaggtgaatgattgtaggcgttgtgacataatgtttggctactgttgactctccaacaggatgtcaggaggaggatcatttgattcaggtgatctagatcatcaagtcgtgacagtgttgatagctaaatgtcaggagcaaagagtgtccatgactaacaggcagcatggatatgctgggcaaagggatgattcacatcttgggcagcacaccatgagatttcttcatgctactcataatgacatgcaatttaaaacttataaagtgtttatttctggcatttttaatacttttggaccatggttgactgagggtaactgaaaccaaggaaagcaaaaccacagataaggggtgactactgtgtgcccatttttatta

SEQ ID NO: 9022 - DNA, 408 bp, Homo sapiens
  misc_feature 403: n = A,T,C or G
agaaaaaagggtggatggctgaatacaagctagtctcacttcactagaaatgtccacatcctaatagtgaacctgatttttataagcatttaagtgctctttcatgttccctttctaccacattcagaaattgctacttttcctttaaaaacatttaatttttgttatatagattttcaagatgtggaataaagaactttatgtgagagaacagcaggatgcatatgaattctttactagtctcattgatcagatggatgaatacctcaaggtagtaaaagttgtactttccctctaactccctcaaactctaattatagtatgagaatagtgcttagcatttgggggtactatgaaactgacgaatcagaaattgattatctttaacataagaactattatnggatt

SEQ ID NO: 9023 - DNA, 439 bp, Homo sapiens
  misc_feature 254, 260, 266, 280, 285, 288, 299, 301, 307, 312, 314, 315,324, 325, 344, 347, 351, 362, 364, 365, 381, 392, 402, 404,410: n = A,T,C or G
ccaaagtgctgggattacaggcatgagccaccgtgcccagcctacacgtatgcagatacacacaaatatacacacacactgaaacatgcatgatggtgtgatagggcctaaattattgctgtgtggctattcctaatcttgcccctttctcctggtttctaaggaacatcctcttctgggccagctcccaggttctccttgttgcacagaaccaaactaattcactaataagagcaggggaaaaaaaaaaaaantaagcngggctngggggctcaccccngtaanccnaaaacttcggnanactganccagnannatggtttgnncccaggagttttaaaccanccngganaacaaaggganannctcatttctaaaaaanaaaaaaaaaanttttttttantnaccccnggcggggggaccctgccctttattccacc

SEQ ID NO: 9024 - DNA, 459 bp, Homo sapiens
  misc_feature 6, 17, 131, 134, 136, 143, 146, 151, 154, 156, 160, 167,170, 179, 180, 188, 189, 196, 216, 224, 228, 233, 238, 246,250, 251, 258, 261, 263, 268, 278, 279, 284, 286, 288, 292,306, 308, 309, 310, 311, 318, 319, 320, 322, 324, 325: n = A,T,C or G
  misc_feature 333, 350, 354, 356, 361, 362, 364, 371, 372, 377, 379, 381,382, 397, 398, 399, 401, 404, 406, 417, 423, 424, 426, 427,438, 446, 450: n = A,T,C or G
tttganaccctttgagnaccatagaatacaagctacttgttctttttgcaggatcccatcgattcgaacaacaacaattgcattcattttatgtttcaggttcagggggaggtgtgggaggttttataatnccntnccgttcntgnggccnatncnttgncccatanttnccttcttcnnccattttnnctatttngattggaaccctgatctacnggcactgnagcntaatnaaatngtatcccnttcnncgttccnttntnaaccntgacttttannctcantntntctnctgccgctttttcntnnnntaaaccnnncntnntaccttgntaatcttttaggataanctgnangatcnncncatcttnntaaangncnncccccttgaacgatnnntnatncngtgatccaccnattccnntnngtccccccttnatcggggnctgncagcttccg

SEQ ID NO: 9025 - DNA, 419 bp, Homo sapiens
  misc_feature 378, 394, 406: n = A,T,C or G
gctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctnagcaaccaccccactnaccttttcccanaaggagaaccctc

SEQ ID NO: 9026 - DNA, 397 bp, Homo sapiens
aatctctatggagtggccttcctcctaccctagtgatggcagttcctgccacagttatttattttacctgctatgatcaattaagtgctcttctgagatctaagttaggagaaaatgaaacctgcataccaattgttgctggaattgtagccagatttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcagcaatgtactggtataactatgaaattttaaagaagtggtatgtgagaaatctggtttatatgagcca

SEQ ID NO: 9027 - DNA, 413 bp, Homo sapiens
  misc_feature 279, 397: n = A,T,C or G
ctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggntgaacttgcaaaatttggtttctctaatattactggaattgattactctccttctgcaattcaactttctggaagtattatagaaaaagaaaggttatctaacattaaagttaaaggnagaaaactttttgaat

SEQ ID NO: 9028 - DNA, 394 bp, Homo sapiens
aaattttctatataataataggctcattttaactttaaatataaacactcattatttcaaaagtaaaattaatggttcttttaagtcataagaggaataatgttataattcacttactgaagtgtttgtctcagactttgtaatgaatactttaaaccaaaaattaagttctacatactatctatggataaaaagaagtggtttgtaaatttatctttatttttactaaattaaaaaatttaaagccaaaatgttaggtcaggatttaaaacaagcattgggtggacagggtgttgggcgtaatggttagattgaaactcggtgtcagctggttactgattgcatccccactttaggattttggtaaaattaaagcaattaatgcaaataaagg

SEQ ID NO: 9029 - DNA, 398 bp, Homo sapiens
  misc_feature 87, 89, 90, 93, 98, 100, 102, 103, 106, 108, 109, 120, 121,122, 123, 128, 138, 141, 145, 151, 157, 162, 164, 171, 173,187, 193, 199, 201, 208, 210, 216, 219, 224, 226, 228, 235,236, 238, 242, 246, 254, 255, 262, 266, 276, 284, 294: n = A,T,C or G
  misc_feature 295, 301, 314, 320, 322, 327, 338, 345, 351, 353, 355, 358,378, 379, 382, 387: n = A,T,C or G
gtttaattaaaacaaagcatcgcgaaggcccgcggcgggtgttgacgcgatgtgatttctgcccatttgcgtcattgccccaatgtnannatnatccntntnntanannaccattggaannnnttaanggtatattantanagtncaaaanctcttnattancntacagananggataatttaaatntccaangttggnanattcatntntattangcnatttntntncagatanngncttngacncaagtttnncaactgnaatnttaaagtatncatggttngtacctattnnaagtcngctttgagaaaangagggntnctatngggggtattgnccatctnaccgtnananctngaaaaaaatggactgaatgnntanaaacnggattaattta

SEQ ID NO: 9030 - DNA, 409 bp, Homo sapiens
  misc_feature 391, 396: n = A,T,C or G
attttgatgaatggtttgaataagttttgtattctgctgttcttatgtggactgttctctaagtgtcaattgggtcacgcaggttgatggtgaagttcacatctactatgtcctttctgattatccacttgttctatcaaatattgagagaatattggaaatctccaaccattatactggatttgtctggatagtttttcaatcctatgaacattcttaagctttgttctgagatgcagctaagttccttggaaacagttttgtgcccttaagtcttgcttttatgatttgtttggtgggtgtcgagtagtgctcagtgtagtgctaaccattccccacaactgaggaatgaacgcctgggtattttaacctatgccttatgagttatganttttnctgtctgcttggt

SEQ ID NO: 9031 - DNA, 406 bp, Homo sapiens
  misc_feature 397: n = A,T,C or G
gccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcaagcagccgggacccccggcttgccatccanaatgggttt

SEQ ID NO: 9032 - DNA, 396 bp, Homo sapiens
ctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctggcatggcaatgc

SEQ ID NO: 9033 - DNA, 385 bp, Homo sapiens
ggcagttgaccgaaccggaaagtggcaggagttggagtacccgagccccgcttaccctgcctttgcatgtgggtcaggatattgatctccaaggacatcgtcaagtggctggcaagcaactcggggaggttaaagacctatcagggtgaagatgtaagcatgggcatctggatggctgccataggacctaaaagataccaggacagtctgtggctgtgtgagaagacctgtgagacaggaatgctgtcttctcctcagtattctccgtgggaactgacggaactgtggaaactgaaggaacgaaggtctgacacaggaactttgagaagacgtgacagcaatcccttcaccttttgaattgtcatggagcctatcaaaagacaag

SEQ ID NO: 9034 - DNA, 402 bp, Homo sapiens
  misc_feature 260, 261, 266, 283, 285, 293, 294, 295, 300, 304, 308, 309,310, 314, 317, 320, 322, 325, 331, 338, 346, 348, 357, 373,375, 381, 382, 387, 395, 396: n = A,T,C or G
agtttcttgtgttactattttgtcattgaagagctctttatatattttggaatgtaaattctcgatgtgttaaacatttttctcacgatctggcttgctttgatttaaaaattttttttatttcaataattttgagttataggtggttttggttacattaatgagttcttttgtggtgatttctgagtttttaggtgtacctgagcagtgtacactgtgcccaatatgtagacttatccctcattctttttttttttttnnaaatnggcctttgccccccagncnggagaatnnnggganaatntggnnnacgnccnctncnttngggggntcagganatcttctncnagaacctcngccctcttgagggggnantttcannagggngccccctnntgggtt

SEQ ID NO: 9035 - DNA, 362 bp, Homo sapiens
aggatggcttgagcctgggaggtcaagactatagtgagctgtaatcatgctactgcactccagcatggttgacagagcaagatgctgtctaaaaaagaatacttattgtaaagtttgggtacaggaataatgaagtcattgatagtttatgaacaggctatgaagttgatgcccaaaagaaataaacagtttgtaaattaataacttattttgagttgtgacaagacaatgttgaaagtgatgcatgaagcggcaggcagaccatccacatcagttttacagaaaaaaagttaatcttgttcgtgctgcagtgaagagaacagcaaacaggagaaacaatagtcaggaattcaataatagcc

SEQ ID NO: 9036 - DNA, 404 bp, Homo sapiens
  misc_feature 345, 381, 383, 385: n = A,T,C or G
acacacacacacaacacacacacacacacacatgcacatacagactcgggcccaaaaaaatgtgtccccttagcaggtttagccttccacccaagatgtaagagaggcctggtcaggggagaatttgtcttgtgttgttgttcgttcattttcagaaaagtagcaggcaagtccttgtttaatgtaaggttgtttttggttgatggcatgtgaattgtcccttcagccttgctgagcatcactcatcacaacaaacaagagctatcctaagtagtttgctaatacagcagtttaaggctcaaaagcattaaaggacaataacatctaatacagttataccactgnactggcatgacttactttcacacatattatctgggngngnggggaatcagtaatccatt

SEQ ID NO: 9037 - DNA, 396 bp, Homo sapiens
cggagggttctgccgcacggcatgggccggggcctcttgacccggaggccaggcacgcgcagaggaggcttttctctggactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaactggagagcagacgaggtgctattcgagtgctagtggtggaacgggaccacacgtattcacaggcctccactgggctctcagtaggtgggatttgtcagcagttctcattgcctgagaacatccagctctccctcttttaaccagcttttt

SEQ ID NO: 9038 - DNA, 407 bp, Homo sapiens
  misc_feature 370: n = A,T,C or G
atgaatttgaagatgaagaaatgctggatgaagaaggtagaaccaggttaaaattaaaggtagaaaatactataagatggaggatacgccgagatgaagaaggaaatgaaattaaagaaagcaatgctcggatagtcaagtggtcagatggaagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattangaatcttgccaatggctggtcgtgatcctgaatgcca

SEQ ID NO: 9039 - DNA, 371 bp, Homo sapiens
  misc_feature 101, 105, 107, 108, 114, 120, 126, 129, 137, 141, 165, 170,171, 176, 178, 181, 182, 190, 194, 195, 220, 229, 235, 241,243, 244, 250, 256, 257, 259, 265, 277, 279, 284, 285, 288,302, 304, 306, 309, 319, 321, 322, 325, 326, 328, 332: n = A,T,C or G
  misc_feature 334, 337, 338, 341, 348, 351, 352, 353, 356, 357, 358, 360,364, 367: n = A,T,C or G
gaagacgagacgcaccccaacatcgacacggccagtctcttccgctggcggcatcaggcccgggtggaacgcatggagcagacctctatgaaaatgattancccngnntgttangtgtgntttaanaancaccatgntggntatgactattttatctattcagantcgcnnattgntnttnncaagaaangctnnatcctgttcttataatgacatttgnagtgttganataggntttttntnntcatanaacagnngngatcanttttctcttgantnactcnnttnatttctttttcacntngnganatttcatgantnncanncntctnanaannaantctttgngannngcnnntnattnatngtgc

SEQ ID NO: 9040 - DNA, 447 bp, Homo sapiens
  misc_feature 7, 8, 9, 17, 188, 198, 207, 208, 213, 216, 221, 222, 233,237, 240, 246, 249, 261, 262, 264, 265, 269, 272, 273, 274,283, 295, 304, 313, 316, 317, 318, 321, 329, 330, 331, 333,336, 338, 341, 347, 351, 363, 370, 372, 373, 379, 397: n = A,T,C or G
  misc_feature 401, 403, 407, 408, 409, 418, 419, 430, 434, 435, 439, 441: n = A,T,C or G
gaaaccnnnaactctanaatacaagctacttgttctttttgcaggatcccatcgattcgaaagaaagtaggtaaaaaaagaaaagggtagataatctttcgtatgcaaacttttcccttatattttgtctttctttcctttttgactttagtagcatcctccacacatttgtgtgcctgatttgaaangaagccggancacccaccnngtttnttnttttnngaattaaaacngganctnacgccncanggcccacttgcnnanngganccnnnccccccgcnctggagttcctncattttacnccccaacanggnnnccngaccctgnnncnctnangangatcgncccntcaaattccacnaaaaaancnngttttnttttccaaaagcccccanacgngngggnnntcaaaggtnngaactttcctnttgnngaancnggtccc

SEQ ID NO: 9041 - DNA, 406 bp, Homo sapiens
ctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttctctttgggatctctttt

SEQ ID NO: 9042 - DNA, 400 bp, Homo sapiens
  misc_feature 343, 380: n = A,T,C or G
gaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatgcacattcgccacttcttctctggattgaccattcctgatgggggccgtgcatattgtanggggcgaactgggtgaggctttcatcgttttttgccnctgatgaaaatgcaaggctt

SEQ ID NO: 9043 - DNA, 404 bp, Homo sapiens
  misc_feature 370, 371, 375, 376, 378, 379, 382, 390, 392, 396, 397: n = A,T,C or G
gtgcatttttagtagagatggggtttcaccatgttggccaggatggtctcaatctcctgacctcgtgatccacccacctcagcctcccaatgtgctgggattacaggtgtgagccaccacacctgggcctttttatttctttttaattttgtgtggacttcaatggtagaagttatagttgatttgaccagaaagggacatgtgaaaaaccttcctaaaatatttcctttttttttcttgtgctgtttgctctatctgtaatcattagtacccccctttctatgttcatgttagttttgctccttctgtgtttttttctgaaccatatccatgttgctgacttttccaaataaaggttttcactcctccnntaannanncanacacccancntaanntggaaaa

SEQ ID NO: 9044 - DNA, 413 bp, Homo sapiens
ccaaggtatatcttaaatgtacttgattgatgtctcatgtctccctaaaatgtataaaaccaaactgtgctctgactaccttgggtacatgttctgagggtctcctgaaggctgtgtcacaggccatggtctttcatatttggcttaaaacaaatctcttcaaatattttatgtagtttgactcttttcctcaatagaactcatcatttaaccagttaagtattttgagttagtttgggattaaacacgagagttttgacagggagctgaaacaatagtagtttcatcaaaagttgatgctatctacgtagatccagacatgataagatacattgatgagtttggcaaaccacaactagaatgcagtgaaaaaaatgctttatttgtgaaatttgtgatgctattgctttatt

SEQ ID NO: 9045 - DNA, 483 bp, Homo sapiens
  misc_feature 12, 14: n = A,T,C or G
ttgttggcctcnanaaacaagctacttgttctttttgcaggatcccatgcagaggactatttctctttcttcctctcattacattcataaacaatagccagagatgctttgactatctcagttctgttctgattatctgttgctgtatgttccacagtgagcaggtctatgcaaacctaacctcaaaggctgagggagttgagaggctgaagaaagagactgacaaatgcagtttctctgagaggaacgtttaagagaaatttaggaacagaagccgtgtcttgggatggcctctagacagtggatccccatacctgccctccagagagtattccttatttagcaagctttttttggtaaaatgtgcaactggtcatgtcttcaaccctcttgtgaaactcaccactggggaagttaagttaagtgtttttatgagggattatctatgctacaggcattgcttctttatgaggggttatttat

SEQ ID NO: 9046 - DNA, 416 bp, Homo sapiens
  misc_feature 303, 306: n = A,T,C or G
tctttatccattttgaattaatttttgtatgtggtgtaagtaagggtccgacttcattctttttcacgtggatattggatttcccagtaccatttgttgaaaagactgtcctttcctctctgtatagtattggcccccttgtcaaacaccatttgactagaaatgcatgggtttattattgggctatctatattttgtttcattggtttatatgtctttttatgctggcaccattgttgtcttgattactatttgtatttaagtatgttttgaaatcaggacatgtaaggcctccaactttgntgntctttttcaagtttgttttggctctatggggcctttgagattccatatgaatttaaggataggttttcctgtttctgcaaaaatgccattgggactttgacagggatttg

SEQ ID NO: 9047 - DNA, 416 bp, Homo sapiens
gtgggccgtaggggcgacattgttgccgttttctttccccccccagtcccggggatggagatgtcgggactcagcttttcagagatggagggctgccgtaacctacttggcctactggacaacgacgagatcatggccctatgcgacaccgtcaccaaccgcctggtgcagcctcaggaccgccaagatgctgttcatgcaatattagcatacagtcaaagtgcagaagaacttctgaggcgtagaaaagtccaccgagaagttatatttaagtacttggcaacacaggggattgttatacctccagctactgaaaaacacaatcttattcagcatgcaaaagattactggcaaaagcaaccacaactgaaattgaaggaacgccagaccagttccaagacagaggacattcacct

SEQ ID NO: 9048 - DNA, 397 bp, Homo sapiens
gttaagatgaacagtctgtgctaacagtaaaccagtatcattaaataaaacaaaaggttcttgtaattgtaggcatcaaaactgctattacatgcatttagaaaccaagatacaagtaaaaatactagtaatttgtcatttaagtagctggaatctattgtatattttcaaggccttaaaagatttcctcctgactctgtagctgcctttggtgatagggtttcctttattttagtgttttattttaaaatgtaaataggattccaagtatggatatagagtttcctttcttttagtatttaattttaaaatgtaaataggatttcaagtatggatcagaagcctgttcttttatctaaaaaaattttttaaataatctgaaataatgattaagagt

SEQ ID NO: 9049 - DNA, 406 bp, Homo sapiens
  misc_feature 365: n = A,T,C or G
gtgggccgtaggggcgacattgttgccgtcgtttttccccccccagtcccggggatggagatgtcgggactcagcttttcagagatggagggctgccgtaacctacttggcctactggacaacgacgagatcatggccctatgcgacaccgtcaccaaccgcctggtgcagcctcaggaccgccaagatgctgttcatgcaatattagcatacagtcaaagtgcagaagaacttctgaggcgtagaaaagtccaccgagaagttatatttaagtacttggcaacacaggggattgttatacctccagctactgaaaaacacaatcttattcagcatgcaaaagattactggcaaaagcaaccacnactgaaattgaaggaaacgccagagccagttacaaagacag

SEQ ID NO: 9050 - DNA, 401 bp, Homo sapiens
cacttgcacactcaaagccacattggactcattttttctgctacctttataaaccttcaaactgttcaagagtcaatggtatgtatcatcttccgttatcaatcatcatgttttgttttgtttggtttggtttggtttggtttggtttttgacaaagtctcgctctgtcgcgcaggctggagtgcagtggcactgtcttggctcactgcaacctccccctcctgggttcaagcgattcttctgcctcagcctcttgagtggctgggattacaggcgtgtgctactacgcctggctaattgtatttttagtagagatgggatttccactgtgttacccagcctggtctggaacttctgacctcaaatgatccacctgctttggactcccaaagtgctagtat

SEQ ID NO: 9051 - DNA, 412 bp, Homo sapiens
gggtgaccaagtagggcctgtgacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctaactgccccagggagctctgctgccttgctggcctgccttcc

SEQ ID NO: 9052 - DNA, 418 bp, Homo sapiens
  misc_feature 411: n = A,T,C or G
gtgagagaggatgtgtgctgggccttggaggaagggggccgagaccgggccttacttctgtaacgatactgtgaggcatcggaaggccagcctgttgtgtccgttttgaaggtcggtgggctagactggctggccttctaggggtgtggagacttcccaactctgcccttgtgctttcctggaatccccaatatgcctgtagtcccagcactttgggaggctgaggcgggcggatcatgaagtcaggagatcgagaccatcctggctaacgtggtgaaaccccgtctctactaagaatacaaaaaaaatattaacccggcatggtggcaggcgcctgtagtcccagctatttgggaggctgaggtaggagaatggcgtgaacctgggaggcggagcttgcagtgagctganattgtgc

SEQ ID NO: 9053 - DNA, 383 bp, Homo sapiens
cccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatggg

SEQ ID NO: 9054 - DNA, 370 bp, Homo sapiens
  misc_feature 103, 112, 115, 125, 131, 135, 144, 153, 155, 158, 160, 162,166, 168, 169, 171, 176, 177, 178, 197, 198, 204, 211, 212,216, 221, 223, 230, 232, 234, 241, 256, 267, 277, 282, 287,291, 294, 298, 299, 302, 309, 313, 315, 317, 322, 326: n = A,T,C or G
  misc_feature 328, 332, 344, 345, 348, 356, 359, 362: n = A,T,C or G
ctctcttgagtgcgtctccctggccagttatggcctcgctctgctgcatccccagggcttcgaggtcgcactgggtgctcacgtggtggccgatgtggggcanagcgctgancanccacaggctnatatgncagnaccatctcngctacctantnacntncngggncnncnaatcnnnttatctgggggatgggcannctctgnaacgctnncagngactncnggtgttnancnacttttntttaccccaatgacnatacccgctgntcacatgganacccnaatanaagnttntacnnggnaaacccnaatncnanaactnttananttgnggagtactttanngantgaccaanacnganaacagggg

SEQ ID NO: 9055 - DNA, 440 bp, Homo sapiens
  misc_feature 8, 10, 11, 14, 16, 19, 238, 241, 246, 261, 263, 265, 268,274, 278, 280, 281, 290, 291, 294, 295, 296, 298, 299, 303,306, 312, 315, 316, 324, 325, 326, 328, 329, 330, 336, 338,339, 341, 342, 344, 347, 348, 351, 352, 354, 355, 356: n = A,T,C or G
  misc_feature 358, 360, 361, 365, 369, 375, 376, 377, 378, 385, 391, 407,415, 416, 417, 418, 421, 428, 433: n = A,T,C or G
gaaactcntnnacncntanacaagctacttgttctttttgcaggatcccatcgattcgtggaaagttgatgagcatcttttcctgtgcttattaaccatccgtttatcttctttggtgaaacgtctagtcaaaaattctctctcagtcatatgatttgcaactataaatttttcccagtctctggcttgccttctcattttcttaatagtgtcccttggaatataaacattttaattntgntaaanccactttaccaattncncnttntatggncaancnntaactgttnnggnnntnnaccnttntttttnttnngcctacannncnnncattgncnncnngnttnnatnntnnnananncccncccncatatnnnnttttttnttattnaggctttatttttttnaaaaaaannnngtntattttnccccnctggttt

SEQ ID NO: 9056 - DNA, 414 bp, Homo sapiens
  misc_feature 163, 170, 175, 178, 179, 183, 187, 201, 211, 215, 219, 227,250, 254, 255, 260, 279, 286, 289, 291, 294, 310, 334, 339,341, 342, 343, 354, 361, 366, 374, 382, 386, 408: n = A,T,C or G
gttgcctggcagcagacgggcaagcctggacttaggcggcgcgcaggacggtccgacttcgtgcggaggcctccctgaggtccgggtccttgcggccactgcggccactgaagcggcggcggcggctggcccatgaggaagaagtccagcccatgctatttcntgttccntagtnagnnaaangctnctccgtacgacgcnggattcgcgnatcnatantttctaanagaagaaagggaggccacatatngctnnacaangcactatacaaaccctgangattaanganancanctgtatgctgagaatnataccgccacgaaaaaataggacnataanannntggttatgttnctgtggncaacnccaaatangagaaaanatcnatttactcagattaagtgacgntgatga

SEQ ID NO: 9057 - DNA, 420 bp, Homo sapiens
  misc_feature 416: n = A,T,C or G
gacggacggtagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaaagtagaattctctaaaagggttgctcttaatggtttctttgntttg

SEQ ID NO: 9058 - DNA, 192 bp, Homo sapiens
gtgactgtatggtagagactgtgatctgggaactttttgctgtacaaatctgtttaaaaaaaaaaaagtaactcattgaattaacttgcaggggggggtttgattcttttttaaactggcttcagcattgggcagtttaaaaataagtaagtaacttacataaatcttcaattgtatgaaaaaaaaaaaaaa

SEQ ID NO: 9059 - DNA, 400 bp, Homo sapiens
gtggttttcaacctctcagtttgtggtaatttgttaacagccccaataggaaacaactactcatgcatccaggggacacctcatgaaccacccgatctcactaagttctgccttcctgtgaccacattgctatttcaggtccctgtcagcacttataaatgtggctgcctcttgctagggtggcctttatagcacatctgaaacagcactccttggctttttgattgttatgtttttagagacagggtgttactgtcacccagtaggggtgacaacatctctctacactggagtacagtggtgtgatcatagctcactgcagccttgaactcctgggttcaagtgatcctcccacctcagctcctaagtagctgggtctacaggagtgcaccacttcacc

SEQ ID NO: 9060 - DNA, 399 bp, Homo sapiens
  misc_feature 213, 218, 219, 221, 222, 225, 226, 231, 233, 237, 238, 240,241, 242, 248, 254, 259, 260, 261, 264, 271, 275, 276, 277,279, 283, 284, 285, 292, 297, 298, 299, 302, 309, 316, 319,323, 324, 327, 332, 335, 344, 349, 350, 351, 361, 366: n = A,T,C or G
  misc_feature 377, 381, 385, 386, 387, 388, 389, 393, 394: n = A,T,C or G
ggaggcgctgggattacaggcatgagccaccgcatctggcctggccttccttgtttttgtagcttcctgcctgtccccctatagattttaaacaatgaatccaacttctgtaataattatgggaccatttaggttttctgtttcttcttgagtaatttttttattgtgggaaaaaatacataacacaaaatttgccatctttttttttttttnaaaanngnnttnnttttntncccnngnnngggggncagggnaaaannnttngaacccnaaannncngggnnnaaaaaanttttnnngcntaacccnccggggnggngggnnttntgggnttnccccccctnccccnnnaaattttaantaaantttttttttgnaaanaaannnnntttnnccccc

SEQ ID NO: 9061 - DNA, 392 bp, Homo sapiens
taaccacaaggactgtatgttaaacattaaacctacatttaaataaccaaatcatattttcttgaatccaaaattattctgaaaaacaaaacaaagaaatttaaagtctcaaggctcctaacgtcacaacaatgcttctgtaaaaattttcagctatttaggggggaaatactagttctagtaagttttccaaaataaagatgtaatgaaaaatagtatctcagagtccatcccagtcttaagattttaatactctacataaaccattcttgtaggcattttgaaaatatgacctactatgttaaaacagggatattctcaaggatctaaaactatcaggcaggttagggattccaaactaaacttgggcaatgagcctaagcaaatttcaa

SEQ ID NO: 9062 - DNA, 398 bp, Homo sapiens
gaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggt

SEQ ID NO: 9063 - DNA, 376 bp, Homo sapiens
  misc_feature 141, 147, 155, 161, 168, 170, 181, 183, 184, 216, 223, 230,260, 262, 268, 269, 271, 274, 289, 310, 312, 315, 320, 333,335, 340, 344, 351, 357, 359, 360, 364: n = A,T,C or G
ggagtgcaggtggaaaccatctccccaggagacgggcgcaccttccccatgcgcggccagacctgcgtggtgcactacaccgggatgcttgaagatggatagaaatttgattcctcccggtactgaaacaagccctttaantttatnctaggcangcaggnggtgatncnaggctgggaananngttttgcccagatgagtgtgtaatttattgcntatttgnttttatntttttgcttatggttattattcttattttntntatctnntntancatttttctatttcnctttgttttttttaaatttgntnacntttgnatttttttcattntntgctntttntttccantttgtnanntttnttctttttttct

SEQ ID NO: 9064 - DNA, 400 bp, Homo sapiens
  misc_feature 302, 306, 309, 312, 315, 322, 328, 335, 339, 341, 343, 345,347, 348, 351, 352, 357, 367, 375, 377, 381, 383, 384, 385,388, 390, 391, 396: n = A,T,C or G
agcgcccggtcgcgcgccgggaccggggtccggtgcggagtgcccttcgtcctgggaaacggggcgcggccggaaaggaagaattcgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgggggaatttcaactnttcntgnctnccntctttgngaactnccacttngaananananannccnntatgngggatgatgnatcctcangnttgntnnnccngnnggttnattt

SEQ ID NO: 9065 - DNA, 381 bp, Homo sapiens
  misc_feature 296, 307, 309, 310, 311, 312, 313, 314, 315, 316, 317, 318,321, 322, 323, 324, 325, 326, 327, 328, 329, 330, 331, 332,333, 334, 335, 336, 337, 338, 339, 340, 341, 345, 346, 348,349, 350, 351, 352, 353, 354, 356, 357, 359, 360, 361: n = A,T,C or G
  misc_feature 362, 363, 364, 365, 366, 367, 368, 369, 370, 371, 372, 373,374, 375, 377: n = A,T,C or G
gaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgcgcttctgcaatccaagccgactgatgactggagaggatggctactatttcaccaatctggtgagtaagtgagttcttggcgttgtggagaaggactaggaagggtgnggttttggggngnnnnnnnnnnctnnnnnnnnnnnnnnnnnnnnngctnntnnnnnnnanngnnnnnnnnnnnnnnnnntncttt

SEQ ID NO: 9066 - DNA, 402 bp, Homo sapiens
gagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatt

SEQ ID NO: 9067 - DNA, 393 bp, Homo sapiens
gagctatggcggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgccgaggctagatgtgaaacatctgattcttgtagtaaattatagcttg

SEQ ID NO: 9068 - DNA, 382 bp, Homo sapiens
gtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgcctgg

SEQ ID NO: 9069 - DNA, 381 bp, Homo sapiens
ggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagattttggttcgagtgtcttatttggaaatatataatggaaagttcgtgaccttttgggcaaggatcagacacaaaggttagag

SEQ ID NO: 9070 - DNA, 416 bp, Homo sapiens
  misc_feature 203, 209, 218, 227, 229, 232, 235, 247, 251, 258, 268, 274,283, 287, 302, 306, 312, 327, 329, 330, 333, 347, 360, 367,371, 376, 385, 389, 398, 401: n = A,T,C or G
aattcggcacgagcccatctctactaaaaaatacaaaaaaaaattagccaggcgtggttgcaggagcctgtaatcccagctacctgggaggctgaggcacaagaattgcttgaacccaagaggcagaggttgcagtgagccgagatggcaccactgcactccagcctgggcaacagagcgagattctgtctcaaaaaaaaaanggaatntgagggggnaaaaaaaantnaanggngccacatgctcnttcntgccacnggaacttttnatatgntttccccanttcnttttttgtcccccantttnacattnttaactccccaatcntnnttnttttttgaccgagncaaacccctactntgggctnttgngccanactttcctnaggnaaaattttncantttggggggggtatg

SEQ ID NO: 9071 - DNA, 396 bp, Homo sapiens
  misc_feature 97, 108, 109, 111, 112, 115, 116, 118, 120, 123, 129, 130,140, 155, 159, 160, 164, 166, 168, 169, 176, 191, 195, 201,206, 208, 210, 212, 220, 222, 231, 239, 242, 245, 247, 256,266, 272, 274, 275, 278, 282, 288, 289, 290, 294, 298: n = A,T,C or G
  misc_feature 300, 304, 306, 313, 314, 319, 322, 330, 332, 338, 339, 341,352, 355, 359, 360, 361, 378, 379, 383, 386, 390: n = A,T,C or G
aattcggcacgaggtccaggagttattttgcagtgagccgagattgcactactgcactccagcctgagtgacagagcgagactctaaaaaaaaaaanaaaaaaaaaanntnnggnnananaancgggcnnatccaaaaantcccacccccttttngggnncaanantnncccaggnaaccgggggccaaangggnaacccnaaaangnancnggcaaatngntaaaggctnaggggggncanctntnaaaaaaaantccagggggncccggncnnggnaggnccccannntttngggngntttncntccaggnnctttnttnggtcctgncngggaanntnaaaaaaaaatntcnttgnnnttttggcaggaggaagnnaaanggncccntttgaa

SEQ ID NO: 9072 - DNA, 421 bp, Homo sapiens
  misc_feature 248, 251, 254, 258, 264, 282, 297, 305, 342: n = A,T,C or G
gtgcacctcttcattcagtaaagggaggtcaccaagagaatttgatgaaccttaccttcaaagttcctgggcacagtggctcacacctgtaatcccagagctttgggaggctgaggtaggaggattgcttgaacccaggagttcaagtttgcagtgcgctatgattgtcccactacactctagcctgagcaacagaccaagaccgtattgccaaaataccaaaaaaaaaaagttcatggagagccacntanacntganaccacncttcagcctgaatttttntaaaacacagttgtntcaagcanattactccacacgtttttccacactgaactctccagnccttccacttccttaattctgcaaatggaggggggggggactcttgggaaactactcctgtaaaattgaagttggaggg

SEQ ID NO: 9073 - DNA, 386 bp, Homo sapiens
atcgcttgaatccgggaggcggaggttgcagtgggccgagttagcaccattgcactccagcctgggcgacagagtgagactccgtctcaaaaaataataaatgaagtaacaatggtgaagtttgaagtaactcaggtgaagtaacacctaagtggaaattccatactccactcagtaaaccatgcccggcccccctcaaatggttttatctgtcacactggtgctcctgcaatggacaaaggagacgtttcctgtaggaccagcatctctttactcaggtttttcaatcttggaactgctgacattttgggccaagtaattctttgttgcagggactgtcctgtgcatttcaggatgtttaacagcatctttgtcctctacccatt

SEQ ID NO: 9074 - DNA, 396 bp, Homo sapiens
  misc_feature 151, 165, 166, 176, 190, 196, 199, 201, 233, 243, 247, 249,250, 275, 281, 283, 285, 292, 297, 303, 304, 306, 311, 312,313, 315, 322, 328, 329, 330, 331, 334, 338, 339, 342, 343,351, 352, 354, 357, 367, 380, 382, 384, 385, 387, 389: n = A,T,C or G
gaaaaaagtatgaataagttcataccaataatacctgtcttgctgggtggttataaaagagaattatgtccagtacctaacccagtgcctggcaaaggtactcaaatcctggtggtgatattattaaagtttaaaacttatcctggcaaangattcccttcatannttcacccatnacttctattccagngccccnttntncccaccccaaaacacagtcgctgatcttaccntgcctttgcnggcntnngttattcaactcccttctgacttgntaactntnanctttgantcttntgctcnnanttgtnnncntcttganatttannnnacntcgnnccnnctcttatnncnctncctcttactnattctactatatntncnntncnatatctc

SEQ ID NO: 9075 - DNA, 378 bp, Homo sapiens
  misc_feature 238, 253, 257, 261, 263, 266, 278, 281, 289, 299, 303, 304,307, 309, 310, 320, 328, 329, 333, 334, 341, 343, 344, 347,360, 362, 366: n = A,T,C or G
ttcctggcctgatatttcactggggacccatcatgattctgcaactattctcgctcaacagaacattaccaccttgagttaaagaggctaagaagctaaggttaatcattattaatgattcaaggtgggcaaacaccatgtgggcacaatgcatcctttcatggattaattactctccaatgattgtacatttcattcctgctaccggtctctattaccctgcttttttttttttcancctgaccaggggggnaaanccancnctnttttgccaaaanaanattttctnagggagaaancatnnaancnntttttttttncccccaannagtnncagggantnntangggggggttttgntngccngaaaaaaccttt

SEQ ID NO: 9076 - DNA, 200 bp, Homo sapiens
  misc_feature 59, 66, 68, 84, 90, 101, 102, 103, 104, 105, 107, 108, 110,111, 112, 113, 114, 116, 122, 127, 133, 140, 141, 147, 148,149, 150, 156, 157, 160, 165, 166, 167, 168, 169, 172, 173,176, 177: n = A,T,C or G
aattcaaggcctcctcgagggctttttttttttttttttttttttttttttttttaaanggggggncntttttttaaaaaaaangggggnaaaaaaaaaannnnnanntnnnnncnaaaaanttttncccccnttttttnngggggnnnntttttnnaanaaaannnnnttnnttnngggttttttaaaaaaaaaaaaaa

SEQ ID NO: 9077 - DNA, 393 bp, Homo sapiens
  misc_feature 384: n = A,T,C or G
aattcggcacgagggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatantgttcaatt

SEQ ID NO: 9078 - DNA, 412 bp, Homo sapiens
  misc_feature 142, 145, 158, 159, 161, 164, 169, 178, 181, 184, 193, 195,196, 198, 204, 212, 213, 214, 215, 217, 219, 224, 225, 228,230, 231, 232, 233, 235, 242, 243, 244, 247, 248, 249, 255,261, 262, 265, 266, 268, 271, 291, 293, 294, 297, 300: n = A,T,C or G
  misc_feature 305, 317, 322, 323, 326, 327, 328, 330, 339, 340, 343, 346,349, 350, 351, 352, 357, 360, 362, 363, 364, 372, 375, 380,386, 390, 405: n = A,T,C or G
gggcatggtggcaggcgcctataatcccagctactcaggaggctgaggcaggagaattgcttgaccccggcaagtgtaggttgcacctagcaaccactccactgcactccagcctgagcgacagagcgagactctgtctcanaanaaaaaaaaaaagnntntanccccnagggttttnttnggnccttggaancnntngccgcngggtttgnnnncnangggtnngtngnnnnancccaaannnaannnttggcntttttnnaanntnagnggggaaaaaaaaaaaccccntnntcnttnacccnttttataacccngggannaannntntatttttanngtngcnaannnnacttngtnannngggggttnacntgcantttttnaccnacggaattttttttnttttttt

SEQ ID NO: 9079 - DNA, 411 bp, Homo sapiens
  misc_feature 378: n = A,T,C or G
aattcggcacgaggcataagtaaggtttgttcctggccttggtgaactgacaaaggcgaggaaagaatggacagattttggtaagtgttaaaataataaccagctggtggtgaaccagtgtcctgaaccttgtgcttaagtctcctcacctacctgggctccttacccttacccgttagagggccgggtcccatgtccttgaagacctggtctctctgggtggtcagtatgcagtagtatggcagtgtataatttgatcaccctctatagtccccgtggattggagaaaaaatctgatttaatgccacgttccccctttctacgattggatgccacagatggcacaggtggagaagtcaagagactgagaaaagtcanacagttggcgactcatcttcctcaaatggtaaa

SEQ ID NO: 9080 - DNA, 417 bp, Homo sapiens
aattcggcacgagggcagacactgcacgtgttctacagagaagaaagaggatgatggtaaagcagactgcagtcttcaggcctggagcagagaagggagagttcctgctctagagaaaagattttgccacgttggctaggctgctctggaactcttgacctcaggtgatctgcctgccacccaacctactgggattacagtagccagtcctgccagggttctggctgtgccgggacagtgaatggccactccgtcccagatgagctgcaggaagcgtttcgatgtcatgtggagcaggagccgccgagtgattgatgggccccagcttgaatggaaagtccagattccagcaacacagcttaagagatgaaggttgcttgagcaggaaatccacccatggcccaaagaggaaagatc

SEQ ID NO: 9081 - DNA, 407 bp, Homo sapiens
aattcggcacgagaaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatgg

SEQ ID NO: 9082 - DNA, 408 bp, Homo sapiens
aattcggcacgaggacaggcacagctctgctgtcagcactgctgtgggggtgactgtagccccagtctgccctggtgtttttctctcgctcttctccatgccggcctttgcctctagactgagaaaccggggttgactcaagtggcacctgcaaaagtgatcatggcagttcacttagcctgcaggtgacagggactgtgaatctagtccctggcgagcctggaaagaggggcaaggtagaggctctggctgccggggtttctttggtgagtccgttcactcggctggacacagacggatcaggaaagattcctgttgctactcggctggtggccagagggagagaggacgtgtccgtaactgaagcaaggtggataagcttcgggaacgagcgaggcacagattctg

SEQ ID NO: 9083 - DNA, 401 bp, Homo sapiens
  misc_feature 384, 395: n = A,T,C or G
gatggcttaatctgccctcagcagggatgactcaacaccgccctcaacagggatgactcagcactgcccctcaacagggatgactcaacaggggatgactcaacactgtcccttatcagcgatgacacaagcaaggatgactcagcactgcccctcaccaaggatgactcagcactgccgctcaacagacatgactcagggatggcttagtactgcccctcagcagggatgactcagcagggatgactcagcaccacccctcaacagggatgactcagcagggatgactcagcactgccctcaacagggatgactgcagggatgactcaacactgccctcagcagggatgactcacactgccctcagcagggatgactcaacanggatgactcancaccgc

SEQ ID NO: 9084 - DNA, 398 bp, Homo sapiens
ctgctggaggccttgcagtccggggctgccttccgcgacagaagaaaaaggacaccgatgccaaaagatgttcggcagagtctcagtccaatgtctcagaggcctgttctgaaagtttgtaaccatgaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaact

SEQ ID NO: 9085 - DNA, 420 bp, Homo sapiens
gtgagcccgaaagaaaaaaattttctgtaaagtgaagaaggatgctggttcctggggctgctctggggccagaccttaccctcctgctcggggccactgaaggcagagcagggcccgagactgggccttgtggtgttaccgctgccttgagagcaagagacagggctgacgtgcagaactaggcaggctccaggcaagcttggcgtcagcgctggcagccttggtggcgtgggcacaggtgacaggagcctggtgaagggggtgagcaaagcatccgggctactgagctgcatggccttgggcacttcagtgccctctctgggcctgggtgttttccttctagccctgctgagtgcggcaggtgggctttacccctgagaccgctgtgtcttctaatgagaagccatccaatatgctttt

SEQ ID NO: 9086 - DNA, 407 bp, Homo sapiens
aattcggcacgagggtctgaagactgaaagagtcgaatggtttgttggcagggtgtcctggtggattggtttctgtaagttcagattctcataaatcgtgtgagcgtcgccgacacctctgagataaaagggcccctttcgactagcctctgctgaaaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatagctcagcttacgctgtcatccctagcagaacatcatgaagtcttgacaga

SEQ ID NO: 9087 - DNA, 377 bp, Homo sapiens
  misc_feature 367: n = A,T,C or G
atccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagncagtcttaaa

SEQ ID NO: 9088 - DNA, 385 bp, Homo sapiens
  misc_feature 284, 286, 327, 343, 352, 361, 364, 366: n = A,T,C or G
aattcggcacgaggcggcgtggggttagacaggtaccggtcagattacggtgacacaggcggcgtggggttagacaggtaccggtcagattacggtggcacaggctgcgtggggttagacaggtaccggtcagattacggtggcacaggcggcgtggggttagacaggtactggtcagatgcacgggctccctaaacccctgctgtggcttcggcagtaaagacaggacgcacccatgtcacaagaggagcacaggcaggggtgttggtgttggggcagtcctnanggtcttcagaccccagccccactcacacagcacctaggaangaatgcagagtcccangtgtcagcntggtgggtnttnangggctgtccttcctggaag

SEQ ID NO: 9089 - DNA, 428 bp, Homo sapiens
tctttattgactttttgccctaaattgctaggtgtgacccagcaatcttttaggaagagattttacagtggtgctttatttatatcaataatccagtatagttaggctgttcattcctcataatagagtacataacagaaaagtgggactttcacattttcatatttaggcacgttccaatttaattccaaaaatactctgtaattctacatctaaaaaaaccgattccctaattcgaatttattggtaccaaagctctctttggctatagacaattaagagttgaccttttaagttaatgtatatgcttaaaaacagttttaggaaaatatttggtagacaaagagtttcaactttaaatgttcactatgtcatttagtgccaactttacggataggttgctatctaaataggcatttttagtcatt

SEQ ID NO: 9090 - DNA, 428 bp, Homo sapiens
  misc_feature 360, 366, 367, 384, 394: n = A,T,C or G
aattcggcacgagataatctggaacatccaacaactcaaaactgaagctgcctcctgtgtgcccacaagatgtgataagcaccatacctgacaccagatttgcaaagaagctgctccactgcacccatcttgctgcatttagattctctgtcctattgttaatgcagatatagttgcacattaaaacctattgtttgtaggccgggcgtggtggctcacacctgtaatcccagcactttgggaggctgaggaaggagaattgcttgaacctgggagggggaggttgcagtgagccaaaattgtgcaccattgcactccagcctagacagcaagagcgagactccatatcataaaaaaacnaaacannacaaaaaactattgttngtattctcgntttaagattgtcttataaaaggtttctgtcagga

SEQ ID NO: 9091 - DNA, 427 bp, Homo sapiens
aattcggcacgagcagagatgagtgcagaattcagcttggaggtcctggaaacttctagtttactgatgtttatgcttttgctcatgcacccacagttcctgggacacagaatgctcacctgggggtttgtaccccagccaagaaggtgtcttcacagactcccctccttttagcaacttcatgcagatggagcttgggtggatggatcctggcacagtgttcagaacagtggccctgccagtgtgtgggcgccgcttgtgcagagcccctgtgggttctggtcctcaagggcaggggcgctcactgacagcggaacccatagtaccagcccatctttggtgggctgtttccaccccattcatccctgcttagctcttcataagacagcctgtgctggcagaaaattgccccccagtcaagactaag

SEQ ID NO: 9092 - DNA, 432 bp, Homo sapiens
gtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagtc

SEQ ID NO: 9093 - DNA, 436 bp, Homo sapiens
  misc_feature 417: n = A,T,C or G
aattcggcacgaggcagaatttgtttggcataaactctctggatccatgttgtcagcagagagtttatgccaaacaaattctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgcatctccatcttcttcgagtcagagctagagtagcagatcgactctatggtgtatataaagnacatgggaattatggccag

SEQ ID NO: 9094 - DNA, 412 bp, Homo sapiens
  misc_feature 332, 334, 344, 352, 364, 366, 370, 373, 378, 408: n = A,T,C or G
caactctgaatcccagtttctagtgagcaccatgtgtaagacttgcttgatgtgtgtttcatttgtttgtttcattcattgtatcaatggtttcctctcccactttgccttctactcccaagtactgtcaaaagatgatgtaccttttccatagtcatcactcgccaaaggaataaaaacctggagtgtcagtctctatagtctgtgtgagcagcactcccatcctacaaagaattccattgccttgtaattatgatttgcgatagggtacaatatgtacccagatatcaagtccaccgttggcgtccctcttccccctgcaacaccgcaangnggtgtacttnaaggaganttttggggcagntncccnaantcaantgccattgcttgcctgaacttgctttaaancaag

SEQ ID NO: 9095 - DNA, 410 bp, Homo sapiens
actttttgaggaactgccagttttctaaagcaggcgcccgcaccatttgacattcccatcagctgtgtgagggttccagtgttcccacatccagtacttactattttctgtctttttgattataggtatctttgtgggtgtgaaatgatatctcattgtaattttgatttgtttctaatgactagtttcattgagcatcttttcatatacttaactggccatgtgccccaattgctaaaacttagcactctgttttgtgataatttcctagtttgcctcctttgctaactagaatttctgggagcagaacttatgctttttttttttaatcttcatgaccctgacagcaggacagcacttggtactaatgggctctaaaataattcaattggaaaaggaatagtatcctt

SEQ ID NO: 9096 - DNA, 421 bp, Homo sapiens
cagcagtaaatggcagctgcccactcccgtgatcagagggctctgggtgcgagctgcagcagggcgtggtggaaactgccatgagatgcaggaccctccaattatctagggggccaggcccatctcagaggagcagctccagaggtgagcgcacaccactgctaattctgcagagggtccggtctgactcctacctcccacccagccaaggctctcacctgtgtaccctctcctgtctctgaggcttccaggtgatggaagtttatcctttcccttgcctatttgcgttatgggcggatttatgattgctttttagcccgttttatggaaatctttctaagatgtactaggagcacctcctttttccagatcaacgtagaagtgtcttgtaaacttcgatgactcggtgctgtggaaaaat

SEQ ID NO: 9097 - DNA, 411 bp, Homo sapiens
ttagcaagcatcattatatttttagaaatgttttcttttctccttgcccgtcagttagccaagcctcctaccactcactttctgttgtgtagttctgattttccgaacaggtgtttagatgatgaggggttatattaagaaagtactaaagaatacgtcttatcacgtgaatcagtatctttttattcaacatggatggagtgggagtggagaccaatctgttttatattcctgcaatctgatgagggtaagaaaaagttcatgctgttcatattagctagccagcctctttctctctttccctcccttccttctttcttctttattttttctttctttcttttgctaatacctaattccttatctcatttttgggattttgagagaataattttcatgtggggcgacaga

SEQ ID NO: 9098 - DNA, 409 bp, Homo sapiens
  misc_feature 188, 192, 196, 200, 205, 208, 220, 222, 226, 237, 257, 259,264, 267, 268, 274, 283, 299, 325, 339, 376, 380, 395: n = A,T,C or G
aattcggcacgagggaggaagaggcggtagggggtacgggggctggtcccagaagatggcggaggcgggggatttctggtaggtcctactttaggacaagatgtggtaccgttgaagcgtcagtctttgattcacagacagttgagcttttcagctgggaagcctttccattttttttttttaacggntttntgancctntgaanccntggcaaaaggananacanagtcccctggncccaaaaaggggggcccatntntttcnttnncactanccaaagggngaacttgatgattcgnggagtagggctattttttattggagnatttcttgcattangggtaaatttacttcaaattcaaaaaaatgggccctntttnccccgagggggatgnaagcattttttttt

SEQ ID NO: 9099 - DNA, 426 bp, Homo sapiens
  misc_feature 414: n = A,T,C or G
tgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaaaaagagaaaacatatgcgttgtattttgcttcaattataaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggttgcagaatgaaaganaagatgaagcca

SEQ ID NO: 9100 - DNA, 419 bp, Homo sapiens
aattcggcacgagacgtagagcatcaggggtttcttccaggtagggcttcacttagagtccctcctccatcagcaaatatagatgggttttcacatcttctctccatacatttatctctgcttctgatccacaaataagggctgaaatgcaggtatctccacagagtggtttgtagaaaccatatggtccaaatccattcttggacaagaagcatttctccagagttaacagagtctgcagagatgtaattttgcctaggctttacagctgtggtcttgtaacaatctttatttcataagctctttgcataattaaactgcctattcggccagtcttcctaggatgaagaaattgtctccacaaagtaagtagtattcagtttctacaaagagatagtctattgccaaaggatatccac

SEQ ID NO: 9101 - DNA, 424 bp, Homo sapiens
aattcggcacgagaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaaagtcaaaagaacttcctcattgggtgctgcagctatgaagtgtttggcaaattggcccaactgttctgatttgaagcacctatgtcttgggatttgaaaa

SEQ ID NO: 9102 - DNA, 422 bp, Homo sapiens
aattcggcacgagctgagcagtaggctctttttgtttaccatttgcaccatgagagcttctccattcaaaggcataaaatgttattggaatctacctgcaaaatgaattggctgattgttttctgttcagacacagatacagcaaattgccactaagaatctgcttttgcgtataccgttggctgtaatttatgtagcaactggttcttgggaatttcaagaagaaacttgttttcttatcctcacctataaagtaagcaccaaaatttaaattataaggcagataacctaagtcctttacctctatctcaaccttcaaggcctgtttcttggtactcttgcctgtttcataggattcttaccgtttgtgggaggcttggagggagtagtgaggaaccagttcctgaggatgtctcaataaa

SEQ ID NO: 9103 - DNA, 407 bp, Homo sapiens
  misc_feature 356, 402: n = A,T,C or G
ctggatttcagatttctagctttcaaaactgagacagaataagtttctgttgttttaagctcccccctcccatttgtggtagcttgttacggcagccctaggaaaataatagggcaaagcagagtttcctgcccagtatgtccccttgctcactactggcctgcagtcctggtggtcagacttatccttctcgctctgtgccttgctagtcacaacccccctcagcaaaatgatgtgcaagagaagttagagaaaagacctttcatgcaactgagaacacagccccgaagcctgacttggttcacaccttgcccaagtctaatttgccaaagaccttgaaagtgaccttaggatgntaaagatacattttggtagagagagagagagagagagagagagacncttcc

SEQ ID NO: 9104 - DNA, 417 bp, Homo sapiens
  misc_feature 247, 252, 282, 287, 292: n = A,T,C or G
ggatcgcgtcattgcactccagcctgagcaacaagagcgaaacaaaaacaaacaaacaaacaaaaaaaacccacccaaatccttttttttaatgtagtagggtttatatagatatactaatataattgcatttggagaattaaagtatgtatggagcccacacatactgtgatataaagtgtatatacagatatttggatattttctagtttgcatgatgattaagagaaccacatgggaaaatacnatctncaaagtgatgtttatcctggaattacccantttanattanagaggttgttcaaatttaactagataactctagtttgtactgtataggtgcagttatgacagtaaaaaaatagcctcttggctcatacctgtaatcccccactttgggaggccaaggtgggagga

SEQ ID NO: 9105 - DNA, 419 bp, Homo sapiens
  misc_feature 353, 355, 357, 367, 378, 389, 404: n = A,T,C or G
aattcggcacgaggagccttcttgtaaggccttctggtgcgatccctggtgggctgcttggcctacctgttgctgtgcccgccttgcaactgaggcgcagccaagatgaagctggagtcggcacaggtggtgaggagggaggacggagagaccctgtgcctttgatgacaatgctggcagctgcctctgtcctctcttgttatcttagcaaaacgaatcctaaccctgttttatgctctgctggttgagttttgtgttcctaactgatggactttaggaagctgagggcttcttacccgaggtagacgttaaactgtgaatgctaaaaccaaaccaagtgtccatgtgagtgngngngaactttaanacatgtacagntattatcaccnccacgttatattcangtctgacacttaatc

SEQ ID NO: 9106 - DNA, 416 bp, Homo sapiens
  misc_feature 412: n = A,T,C or G
aattcggcacgaggaagtactgtggctgtatacagaacctgtatgctggttgttcttttgcgggtccagataaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattancagt

SEQ ID NO: 9107 - DNA, 389 bp, Homo sapiens
aaaaaaacacaaaagcccccctttataaataaacctaaaccacacacacacaaagtttggtgaatgagtatatatataccactgatgaaaggaaggtgaaatgtttgccatacatatttttatgatcgtttacctgaaattaaccttttaaattacataaccaattgttctaaatcacattagataaaagggtttttactgcataatatccataatatataaagagctcctaaagatcaataagagaaaggtacccactacaaaaagcaaaaagtggcagaagattatacatgggcatttcccaggaaaagaagtactggtgaataaaaaagaaaagatgttcaaattgactctggttattagggaaatgtaaaccgtttttcaccaga

SEQ ID NO: 9108 - DNA, 405 bp, Homo sapiens
aattccgttgctgtcggtggtggctcacacctgtaatcccagctactagggaggctgaggcaggagaatcgcttgaacctgggaggcggaggttgcagtgagctgagatcacgccactgcactagagcctagacatgagagcaagattccatctcaaaaaaaaaagaaaagaaaaagagagctctgaacaagcgcctttagggtcacagagaaagtgcaacctgctggaggctgagagttacaggtctggaaggcgcctctgtgaggagaggaagccccaggcgcgagcgctcattttcagtcatcttaaaatagagcaaaccaggctgggtgcggtagctcatgcctataatcccagcactttgggaggctgaggcaggcgggtcacttgaggtcaggagttct

SEQ ID NO: 9109 - DNA, 396 bp, Homo sapiens
  misc_feature 351, 386: n = A,T,C or G
aattccgttgctgtcggtgaagctggcatggctaagggacaccaaaaaggtcactgtggttagcttggaatgaatgaggggtggtaaaaatggaagtggtgagaatgagcacatttgagatatattttgaaagtagaggcaacagagaaagagatggctccttatttgtcctgaacaagtaaaagaggaggagttatagttagcacagatgaagaagactgtgtgtggagaaattatattattttattttattattggtggtagatggactcagagtttagttttggatatgttaactttgaagtgtcttattaattattgcagtgtgaaaccactttatcagacagtagnaaaaatctctcttataaagggaaacaaaggagtanaatgtttgtc

SEQ ID NO: 9110 - DNA, 406 bp, Homo sapiens
  misc_feature 348: n = A,T,C or G
aaaaaaatagacaaactcttggtatataccaggctatcttggtttgctgcagctgatcaaatgaaacagtttgttatggttttacgaatgagaatatcacagactctcttctaatttaaagcccctgtgtgaaaatgttcagtcaggtcgcagcagtatatttcaagaggatgaaatattcagccaaggtctctctgcagtccaggcagacagctggaaaggtgcgctctgagttctgattaaactgtgtccccataccaggggcttcctgtttcttgcatcctttacctgagaggggacaatagttctttctaacttaactgagctgattggcatcttcccggaaancttttaattacgtgtggcaccctaaaaagggggatgaccaccgaaccatcaccctgag

SEQ ID NO: 9111 - DNA, 404 bp, Homo sapiens
  misc_feature 377: n = A,T,C or G
aattcggcacgagaaacattctgttttagtcatccttgaggatcgttttaactccttgatctgtaaaactgtcttaagcatcttaacatgttacatcacagggttttagctcagatttccaaagagccatattttttgatgcatatttccagttgaattccagtgtgaatttccagttgtactttgcattctgattctttgatatttgaacttggccatctgtgggtgctactctcgtaagactaaaaggcacctactaaatacgaacaaggataaccagttctaccaaaaacattaccaaccaaacctcccctgttcttttttcagactttccttttgctttcaacctcttaaactgtaaaggagagatttaatgnttccctattattctgctttgactcaca

SEQ ID NO: 9112 - DNA, 396 bp, Homo sapiens
aattcggcacgagggattacaggcacgtgccaccatgcctggctaatttttgtatttttagtagagatggggtttcaccatcttggtcaggctggtctcaaactcctggtgatccacctgcctctgcctcccaaagtgctgggattacagccatgagccactgcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggct

SEQ ID NO: 9113 - DNA, 420 bp, Homo sapiens
cacttcccatgctcctagggttaggaatagtttcaaacatgattggcagacataacaacggcaaatactcggactggggcataggactccagagtaggaaaaagacaaaagatttggcagcctgacacaggcaacctacccctctctctccagcctctttatgaaactgtttgtttgccagtcctgccctaaggcagaagatgaattgaagatgctgcgcatgtttcctaagtccttgagcaatcatggtggtgacaattgccacaagggatatgaggccagtgccaccatagggtggtgccaagtgccacatcccttccgatccattcccctctgcatcctcggagcaccccagtttgcctttgatgtgccgctgtgtatgttagctgaattttgatgagcaaaatttcctgagcgaaa

SEQ ID NO: 9114 - DNA, 429 bp, Homo sapiens
  misc_feature 401, 417: n = A,T,C or G
aattcggcacgagatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttaaggtcgtttgccttccatgggaacttggctagacttanaaaaagctgttgttgngctaatgtaaaa

SEQ ID NO: 9115 - DNA, 386 bp, Homo sapiens
acgctctcgggagcagttctgttaatccctgctgggagcagagactgcgaaaagctgagtccgccgatcgtgcccgggacaaggctgccttccactcgccgcatctacctggtaggcggcatgcgcacgggcttagaggcttgagagcctctggaagagaaagggtcccaggaaggaaacctgcccccggcctaagtgtcggcgcccagatcaccacgaaccccgcacctaggcgccgcccaccaagttccaaagaagtccgaggcgacctgggagtcggtcggatcccagccgagaaaagaaacaagcaggatagcaattcttatgggagccaccctgggagttttaggcagcgtttgcctttccctggttttcttaccaagccc

SEQ ID NO: 9116 - DNA, 406 bp, Homo sapiens
gggaaatggggccctaggagggtgggggcgggaaggaggggcaaggtctttcaggaaccagacccaacaggcccttctgtagcctcccccttgccctcaaagggggagtgggggccagctttacctcacccactgtgacccgccgcttccccttcagcctgggaccaggctttcctagatcccagcacagctctgagcttgttcctttgaggcatagagagccagagtctggcttccagagcattgacttcctcttcctagacttgaggccttttctctggctttcctcctttgccctgcagtagcaactggtgctgggacaagttgacccacctctcacagtcatgggtgtggccacttgtgggagtttcctgtccacctcccaaagacggccacccagcgggtc

SEQ ID NO: 9117 - DNA, 395 bp, Homo sapiens
acagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcacccaagaattca

SEQ ID NO: 9118 - DNA, 391 bp, Homo sapiens
aattcggcacgaggtgagggctgtgcaagggggaacactgagcagatacctttggccccttccagcttttactgacagagagttccaggctagacaccataaaaaccaccccttgttctgaggggctgaggctggaaatagattgtacagacaagcaagggttgagtggtggttcccacacgaagtcatctcttaatcatcattagcaatagcagttcccttccaaggcctcccctcactcccgaaacacttacgtcccatgcaggcccaatgcaaaaaaaaacatttgagcttttttcccgcagggccatgaagtccccttaagttcccatatctaagatggttgactgaccctctccccttatgtacagaagaggaaactgattctcaa

SEQ ID NO: 9119 - DNA, 377 bp, Homo sapiens
  misc_feature 325: n = A,T,C or G
gtaaaggaggggtggtgctagacgtttcgggcagagctcggccgctgcggaggacaaggaactctccctctcccactagtctgacttcttccaaaatgagcggcctggatgggggcaacaagctccctctcgcccaaaccggcggcctggctgctcccgaccatgcctcaggagatccggacctagaccagtgccaagggctccgtgaagaaaccgaggcgacacaggtgatggctaacacaggtgggggcagcctggagaccgttgcggaggggggtgcatcccaggatcctgtcgactgtggccccgcgctccgcgtcccaantgccgggagtcgcggcggtgcagtgaccaaagccgggcaggaggatgctcca

SEQ ID NO: 9120 - DNA, 329 bp, Homo sapiens
cctttttgaacttcccttctattaaacttaaaacagatgtcttaattaatcaggctgtcttggaagggtattgtattgggagacaaggggcggtggtggacctcaccttcaatccaagttttcaaagatattttctcaataactctaaaagggaggtgcttgggattaaggtgacagtccacttgatccttttctttgttttagtgtgaatttcagcagctccatctgtcttcatgattgtacttgagcagtattagctgtatgagttaattttattcagattgaagatggagggcgggttctgctcactcagtctttttttttttttt

SEQ ID NO: 9121 - DNA, 243 bp, Homo sapiens
aattcggcacgagcctggatgtcaaagtcctagagccagaaatatattctctcatccctcttagcattctcttgctccctcattcactagggcaaatgtctaaatgaagaaaagtctctctcaacacctcgttcatgcaatcagcattagaatttgtaaggaaggaaggggggtggcatgaaaatttccattcttggggtatatgactgtcctgtttcccccaggccactttttttttttttt

SEQ ID NO: 9122 - DNA, 433 bp, Homo sapiens
cggaccagaactgtcttagcttttccctctgcggctgctctggttggttactttgagcctgcctcctcagcgccgcaggagagacttaacagcaaaaatgactgtgtcctgagttcagcccccactgctctgggagcttccccctggtttctgcacctgaagaatgtcatcccagccgaaggttcttaggagcggggagcgacaaagaaaaacaaagaaaagcagacctgaaaattgggacctgggagaaatgtaagacatgtgcttaatttgaggcacagaccaaaagaagctgagtctgagggccctctaaaagtgtcctcgtgcttgggcagcttacattcttggcggcagtagtgttatgaagaggaccttcggagccaggtctgtccattcttagggctccagccactgctgagcatcaaacgaagtg

SEQ ID NO: 9123 - DNA, 426 bp, Homo sapiens
aattcggcacgagacaggatgatgggcaagttttactcccaaatctttaaatctacagtttatactgaaaaactaaactatgtaaaattcatcagtcacctcataaacattaagataccttgggaaactcatacaaaagtaatggtttaaacatgacttcagacttagtaaatcatccttttagttttgcaaaacaaagtaaaacatccattatatttaacatctctattatatcaaatgtggggcacatcagacaactgaaatgtcaccagcctcaagcagcccacggagaagcgtgtgtgttgagagtcctgctggcagaggtgcacgggggctccatctctgagtacgtttcacagcttgtaccatttacatgtcaccgccttaaggcagagctctcattccccttcttaagcaggtagttgg

SEQ ID NO: 9124 - DNA, 430 bp, Homo sapiens
  misc_feature 323, 339, 425: n = A,T,C or G
aattcggcacgaggatgagtgatcaagaattagagtgccctggaggtcactcacaagtcctcatggagactctgccgtgacctcgcgcatgcgagcaccttcctgtctctcattttcaccatctgactggggctaggtttggttagagggcggctgtagagcaccctcaggagaagtggcgccgcaggggtcacgcatggtccagccctcaggtgggagggaagtccttgttggcagagggatgtggggcgggaatgaggaaaggggagggcatgatcctggcaaatagtctttccttttccgtaattacagagaaccaggantttttttaattattgntattataattataattattattattattgacatgaggaaacctaacactggcagagggcaccttctctgcttttaatctttcaggnttgac

SEQ ID NO: 9125 - DNA, 423 bp, Homo sapiens
aattcggcacgaggccatcagaactgtgaaagaaaataacattttttctctctttttagaaagacacaggttcagaatggtgttgtcagggatcacaagctcccagccccgtgattagcaaattgaccctgctgccctgtctgctggctgctttcttattctgagaattgtgttgacaagaccctcttttcctacagagctctctcttaatgttgcttggaatagccttgtgtcctggagacagttttaggtctggcaggatctgagaacaggagtggggatcttggaatgggatctgcatccctgagcttcatccacaaagggtgggaatgtggcttgggctgtggggtggaggtagatgaacagctggacttgcaggtctatcttctgttgtttctcaataaagtagacaaagtccatctg

SEQ ID NO: 9126 - DNA, 421 bp, Homo sapiens
  misc_feature 400, 404, 406, 407, 408, 409: n = A,T,C or G
aattcggcacgaggtggaaggacagcatcgatgaactctcctggaggtcactgcaaagggtggcagaccctgctgaggtccctgaatctgcagcctccagacaataaactgaaccttacccagaaggctggcacaaagcccccagctctgtgggtaggatctccccttcactgccctctctctgagaaaggacagcacacccttgggaaagggggaggagagagactgagcacaaatccactgctggaaattactattcagcagagaagctgggtcttgggctgtgaatcactgcaggcctcctgataagctgctgcctccagccctgcacagctgtctgttgagagataacagcctcataagcttctctgccaactccaagccagctgggggggggggngctntnnnngctggaaaactc

SEQ ID NO: 9127 - DNA, 425 bp, Homo sapiens
  misc_feature 379: n = A,T,C or G
aattcggcacgagaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaggagcgaagggactcaccctgagggaacatatggagagcaacttggtcctgagctgtgcaaccaatcagagtccaggggagaagatttcttcctgaagtccaggctccaagaacaagatgtcntggagaagatccacttctttctatacccacatgtgcaacccctggg

SEQ ID NO: 9128 - DNA, 421 bp, Homo sapiens
acatcttacaaacaaggctggagaggaaagagaaggggtcagagtacagatggcctctcatttcaggcagagaggttgggtctgtacatggaaggcagtagggagcccttgacaactactgagcagagattggcagaactaattggtgttttagaatgagcagctgggaaaactccgtagaagggaccagaagaggcaagtctgaaatcaaggagccacatggggagttgctttaacagtagaaggtcactcacagctttacccctgtgcaaagagaaccttggtgcaaaggttgacacagccacttaccagccataggaccttgagccagttttaaatcttcctgtacctccttgccgtatcttgcatctagggatgctcgtgtcattcattcgttcaaccctaaaagggcccgtttcag

SEQ ID NO: 9129 - DNA, 419 bp, Homo sapiens
agcactttgggaggccgaggcgggtggatcacgaggtcaggagatggagaccatcccggccaacatagtgaaacctcatctgtgctaaaatacaaaaaattagccaggcttggtggtgtgcacctgtggtcccagctacttgggaggctgaggcaggggatttcttgaacccagaaggcggaggttgcagtgagttgagatcgcgccactgcactctagcctgacaacagagcaagacttcgtctcaaaaaaacaaacaaaaaaagaaattacattagttgaggacctgctgtatgtgatatgaacaatgaggatcaactctttttgtaatagtttttttacatatgttatttcatttgtttatttcctctgtgagggtaagtattgatagtccagtcatagactggtaacacaggcac

SEQ ID NO: 9130 - DNA, 416 bp, Homo sapiens
aattcggcacgagggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcagggtgagtgttttc

SEQ ID NO: 9131 - DNA, 415 bp, Homo sapiens
aaattgtctattaaatgcaagacgtggtaatatacagaatttatcaggcattaccaagtctaggcacatataggaaatgcagcactcagaatggtttcaatgtagtagttgatgcttgtaaggtaggggagcttattcagacatagtagatagtttctctaatgctgtctcaattgctggcctttggctacctgtacttccccattatggcagcccatttgcgctttttgttctctctgggacaccttatgctctgaaatcatgagcgaggctgattcaattggtgatttgggtagaaagcagtatgttttgctgacattaagatgtaggttatagataggtttagcccttaagtgtatgtttttatactttaaaataagaaatataaccttttaagctattcccctctccccag

SEQ ID NO: 9132 - DNA, 417 bp, Homo sapiens
  misc_feature 75, 270, 305, 369, 374: n = A,T,C or G
aattcggcacgagggaaaaaccaaaccctctcctggtaagttgtgcctgccagccctagaaactgtcaagtgtgncactttccatcttacctaggaatagtccatttattttcgagcctagctttttgtgtttctgtggttagctgcactcacacgtaccaatttttagattcacgtcagctacatatggaggggatcgtttgagtctagatctcactgtctgttccttttcgagggaagcaagttttctctcaagaaggattttgatgnctccgataaaaatagctatcttattaatctaatanttggaagttagaggttctgtgtgtggagtgggttgtttggtggaacattcgataagcagctggnaaagnttcctttctgagtgggctgtaccttggaaatggttcacacaac

SEQ ID NO: 9133 - DNA, 416 bp, Homo sapiens
  misc_feature 400, 408: n = A,T,C or G
aattcggcacgaggttgcggggtgggagggcggccaagacgtctgagcagtatcccaggcaccccttccagcccagggtgacctcgaaagcagcagagagaacggggactggaggcgggtgggccctggaaatcctctcatggtgcgggtgggggggtatggggggtggactgtcacaggtggaggcagcaaggcagctcctggcagcaggaagaggcccaggtgcagcaggaaaccccgtccctggtgctcactggtgaccgtgggcagaggagaggacaagtctctccacacagcagcctggggccatggggtacagccatcttttgcaattgtcttcttttatttattctgcaaaatgcccattcccaaaggcttctgcatcctgtccatcaaacangacagtcngtgccttt

SEQ ID NO: 9134 - DNA, 419 bp, Homo sapiens
aattcggcacgagaagccgtggggacgcgcccagcggagctaatcagattacctggctggtgtttgcttgttctggagtgatcttctgactggaaaagaactatgtcatggatcaaggaaggagacctctcactcctgcctggtgttccaacccgttctgtggccagagtatacattttggaacctcttcgaggccatcctgcagttccagatgaaccatagcatgcttcagaaggcccgaaacacattgcattcataatggacgggaaccgtcgctatgccaagaagtgccaggtggagcggcaggaaggccactcacagggcttcaacaagctagctgagactctgcggtggtgtttgaacctgggcattctagaggtgacaagtctacgcattcagcattgagaacttcaaacgct

SEQ ID NO: 9135 - DNA, 419 bp, Homo sapiens
  misc_feature 382, 384, 395, 407: n = A,T,C or G
aattcggcacgagaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacnangagctgaaacnagagattatgantgagactttgaa

SEQ ID NO: 9136 - DNA, 415 bp, Homo sapiens
  misc_feature 403: n = A,T,C or G
aattcggcacgaggtgcccccagccagggtgagcccctttcccagaactgcctcaccacccagcccttgtgtgatcctcatgtctcctgccccaggaccacatcctgagcttgggtgccgacttcaccttgatctccctcggcagcaccaggagaaagtggagcggctgttagaggtgtcacgtgaacctgacaagggctggcggggactggcagaccatctgggctaccaagctgaggctgtagaaatcatggcccaaggccaggtgtgagcctacacactgctgagggactgggctatccaagaagacagtggtgccacccacaaggtgctagagaatgccctggttgccatgggccacgaaaatgtggtccaagtcctgggcccccaagctgagggctgnctgtggtgtgag

SEQ ID NO: 9137 - DNA, 413 bp, Homo sapiens
  misc_feature 295, 349, 356: n = A,T,C or G
cttctgctgggactggccattatctcagggcttctgttgcattatagccctgtgttctgctggaaagtaggaaacacttccaggggacaaaacatggatgatgtcatggttttggtggattcagaagaggaagaggaggaggaggaggaggaagatgctgccgtaggggaacaggagggagcacgtgagagagaggagttgccaaaagaaatacctaagcaggaccacattcacagagtgaccgccttggtgaatgggaacatagaacagatgggaaatggattcaggatcttcnagatgacagcagtcaggagcaaagtgacattgttcaagaagaagacaggcccantctgaanaagaagatgggccatggttgtcttctctgaaagcttggagagctacatttgaagacg

SEQ ID NO: 9138 - DNA, 409 bp, Homo sapiens
gtcggcccagctccggccatttgcccggaggcctcctctgggcctttcaacttcctaagcacctttcaggttgggtggtccgagatctcgcgagcgctcccgacctctttcctttcgcgagatcccctctcctccccctcctagtctcctcggcaacggcacagatctcgcgagcttctcctacttctctagcgctgtggctcactgaagcgtactacgccggatgtcttaagatatcgcgagacctttacctctggtttcttacacatcctttagaaactggaatttagcgagaatacattctttcatactgcctcctcccttgtttttctgtctcagagagatagtctgtcctaaatatcccatgtagcccaggccactgaattaaaacggagcgtattcgttctct

SEQ ID NO: 9139 - DNA, 434 bp, Homo sapiens
aattcggcacgagggtgggtgtcctgagtttggcctgggagtcaggtgaggcagtggagtgtttgaagagagggtgaggggtatgggcgacccgcacagacttgaatcccaggggctcctcagcagtgctgtgaaagggctgtcgctggctgggactggccttaacagaagggaaatgcactatctcgtgtcctgcgatctgggtcagcagctcggtcgtgtcatctgggatgcaggctcctttcctctttctcctcctccatttcatagctccaggttcaccactgcacagtaatggccagagcaagaaagggaccattgtgccctgtgcccccttctcaggcaccaggtagactttcctctgtctcgttgaccaggactaagtcaaagtatgtatccttagtagggaatgtgatgagcctaatggcatgggc

SEQ ID NO: 9140 - DNA, 410 bp, Homo sapiens
aagaaaggaaccaaacaaggcgtgagtgtgttggggaaccttcccagtggagcaaacccccttaacacaccagctgttgggaacagctgcccctaaatccaattaaaccctcatctccctggtgctgaacagtctacactggcccaggaagctaacgtctgagccgcttggagagctttggtaaacagaagacactggaagcccactcggtcagcagctgggcatgaggatgtcaggggcctttggacttgaggaaggacagtccaggtgcatggaatcctaatgggcctcatgcagacactggaagcagcccagccccctgcccaataccacagccctggggtgtcccctgacattcctggaggtccctgggcaaatgcatttcctgcctgggttctcagggtaggaaa

SEQ ID NO: 9141 - DNA, 410 bp, Homo sapiens
  misc_feature 362: n = A,T,C or G
aattcggcacgaggctaccagagtttgatgaaagtagccccactaaaaacatctcacgtcctttattctaattctgacccaccaaaaagccttctaagtcaatgacacaatgtctggagtgcctctgtatgttatgaaagattgctctagacatcctacccctgttctttagtcagatgtgttttccagggtaacccaagaatgacattttagcttgtcagtatcttggaagtgattagtaagagctcagtcctaaagactggtttgttgtgagtaaacaaataaagctggatttctgaaacagcaaagctgagactccagaccagtaatgctcaaccttctttctgtcgagcatgcctggnagtaacagtggctcacatggaagtaaaggagtttgttttttgaagggg

SEQ ID NO: 9142 - DNA, 413 bp, Homo sapiens
aattcggcacgaggctggaggcattcgaaagggactcccgatgtggtgggcggggctgaaccctgtggcttctgaggtccctgccagccagagacttgtgtgagtctttgaatggcttcacatgaacaaaagagcatttctgtcacctttcctctagttttttccaccacacccaccagggagctgaggcaaggttgtttctgttgctgtttccttaggtcagctgaggctgtccattgatgcccaggaccgggttctgctgcttcacagtgagtacggctttgtgcaggctcaccaaggaaggggcgggccactcagcagagcagggccacagaagagttttcctatcttccctcccttctttattccatcctttcttcttttctctatttttctcactcattcatttattc

SEQ ID NO: 9143 - DNA, 410 bp, Homo sapiens
aattcggcacgagggtccttcctccagccgcggggcacccccttctcccaccttgcccttcccccagccctgcagccccagagtgagcatggcccaggaggagggtgggagcctgcccgaggtgcgggcgcgggtcagggccgcgcatggcatccccgacctggcccaaaagctccatttctatgaccgctgggctccggactacgaccaggatgtggccaccctgctgtaccgtgcgccccgcctcgcagtggactgcctcacacaagcccttccaggcccgccccacagtgccctgatcctggacgtggcctgtggcacaggcctagtggctgccgagggaccttcgacgcggtgctgatagtcggtgccctcagtgacggcaggtgccctgcaatgcgatacctgac

SEQ ID NO: 9144 - DNA, 413 bp, Homo sapiens
aattcggcacgaggatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccacaat

SEQ ID NO: 9145 - DNA, 410 bp, Homo sapiens
cccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcgggggcaacttcctcaatggctcccagagcagcggctttgagctgagctacctggagaaggtgtcagaggtgaaggacacggtgccgtcgacagtcactgctacaccatctctgctccctagtgctccagacccggcctgagtcctctgacctctattcagaaatccctgccctgacccgctgtgcc

SEQ ID NO: 9146 - DNA, 405 bp, Homo sapiens
aattcggcacgagcccagctaatttttttgtattttcagtagagatgggggtttcaccatgtcggccaggctgatctcaaactcctgacctcaggtgatccacctgcctcagcctcccaaagcgctgggattacaggcatgagccatcacacccagcgaaaagttttgtttgaataaacaatatccgaaagacaattagtttcttcagatgtattttgaaattctcctaaagagctagtgtttctattcattttcacaatttaaaaacagctcttaacattgctgaagttgggagaactttccatctcttcttaataacagtgcaagattttgtaaattcttttttgtgtttaatgtttaataaaacgagtattaagcttaaattactgaagtacctgggagaag

SEQ ID NO: 9147 - DNA, 403 bp, Homo sapiens
cctgagtgtacagaatgaacaaacctgaaagcctaagtactatcttggtccgtctagctcccacacctagcttgagagtagcctctcatatcaatgcttccctgctatcctttcaaaactctttttgatgggataagtgggcaaagatcatgccatcgtctcaaatgctaacttcctttgacaagacagtttctcccagggatatcccccacaggcctaggccaaatctctgactcactgcaaaggtccatgtacactgaactgatagacatcactatttttattggaaaacacaatttatataacactcttcctctggaataatactctttttgtggacaaataccgagttggtcctctcttctcccagcacaccccacccccctccccatgactgtgttaa

SEQ ID NO: 9148 - DNA, 401 bp, Homo sapiens
aattcgccacgagattgccctttaccccatgcccaatactgcaatggcaccttaggctgtgtgtgtgtcagacagaaaaataaaacatcagatttttgttaattttgggtgatgagtgaggtcagggatagttattattttgagactgctatttttttttctcttttttaaaaacagatggggctgggcacaatggctcatacctgtaatcccagcactttgggaggctgagggaggtggattatttgaggccaggagttcaagaccaccctggccacacggtgaaaccccgtctctactaaaaatacaaaaattagccaggcgccgtggtgcatgccagtaatcccagctactcaggaggctgaggcacaagaatcacctgaacccaggagacgaggctg

SEQ ID NO: 9149 - DNA, 404 bp, Homo sapiens
  misc_feature 255, 256, 262, 264, 265, 268, 274, 277, 287, 294, 297, 298,300, 302, 306, 310, 311, 316, 334, 343, 346, 347, 350, 351,361, 367, 374, 375, 377, 382, 385, 386, 388, 389, 391, 393,400: n = A,T,C or G
cacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggaggtgtgggaggttttttttattnncttttnannaancaacgnttncttcaattanatggganatnngnancccngganncttcntcatgaaagtccttgaancattaaagncannttnnctgctggtgntctttntggcaannanttatnttnncnncncnctcactnaaac

SEQ ID NO: 9150 - DNA, 405 bp, Homo sapiens
tttaaaagtaaaatgtattttaatgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctctagtggctaggagaaataaataaaagggccataatggtttgttctctttcagacataatttagtaggggacaagaagtctgttcttcagtgagtacactagagatttactctggtgactgcttttgagttatgggtgaagtaaggtatggctttaccataaccttgattcattcacccttgat

SEQ ID NO: 9151 - DNA, 403 bp, Homo sapiens
ctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataaagttcctttttaacacc

SEQ ID NO: 9152 - DNA, 406 bp, Homo sapiens
aattcggcacgagcatcattcagcaaggtggctgggtatgagctgttatatattaaaaatattttcttgaaaaaaaattaggtttgttgtttttcttaagagatgggttcttgctgtgttacccgggctggagtgcagtgtctaattgctggcactatcatggcaggcttcggtctcaaactcctgggctcaagtgatcctgcctcaggtcctgaatagccaagagcacaggctgggactataggtgcccaccactgtgccgtgctctatcccgtactttttgatatgtaattattattattattcagttggttcagttgtttataaattttccttatatgttctttgacccttgaattacttagaaatgtattttttaatttctaaatacttacaggtttaaaaa

SEQ ID NO: 9153 - DNA, 401 bp, Homo sapiens
ctgctgctctgaaagccttccgaaggctggtgaactcccaggggcagctgcgggtgcccgtggtttttgttacaaatgctgggaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccg

SEQ ID NO: 9154 - DNA, 421 bp, Homo sapiens
  misc_feature 396: n = A,T,C or G
caaaaaaagaaaagaaaagagtagactggccactgacaatactgggcctaatggaactccctctaccaaatctgtcactgcactttgccttcatcccttttttccctaacagcagccacgatgaaataaagtgaagttgtaggacctccatagttgggttataagcccagccccagcaacaaaggtgggttggggtgacttctggggcaccaacagcttatacaaagtatacacttcactatcctctttccacaaggattttgctataattcagttaccaaaactagtatatgcctttatctgtgatcagaggcataaattggaccataggataagttcttttttagctgacattgggtttttttggttttggttttggtttattttggtttgagnttagttgataacatttaaagagtag

SEQ ID NO: 9155 - DNA, 396 bp, Homo sapiens
aagacttcagctaaggcccttgatatttaattatgattagagacttttggaccttctggatcatggtcatgtttctgttctatgaaagtgacttaacttgaagcctggcagaacccaactgttttctttctgttatcaaagctggtagttttgaaatagcaccaataataacccagggaaatgtcatgtaatttttattttccattatgacaggtgtctaatgcatgtcagcacaaaagtgtcatcactgctgtgtcatccctcttggttttcactatgcatctataattttttaagtttgcaggttttgtgggggtttttgtttgtttgtttttaaactggaaaaactagccattttgagagaaggaaggttctaggctatgagcatgaaggcct

SEQ ID NO: 9156 - DNA, 397 bp, Homo sapiens
ggtagctgggactataggcacacaccaccacgcccggctaattttttatgttttttgtagagacagggttttgccatgttgcccaggctggtcttgaactgctgggttcaagcgatctgttctgctcagcctcccaaagtcctgtgattacaggtgtgagctaccatgcctggcccctttttacagatttgaggatggttttatatcacctcaatttctgagaacctcaagctatgaacttcgtttaaggtagttccaagtttaaggtagaaccagttccaggttcctaaccccactcccagatacctggcagaatcaaagatgaatctccggaggagggcaccttcttcctaattttcaagggcaatgagcaagtacaggcagaaataacaaagcg

SEQ ID NO: 9157 - DNA, 398 bp, Homo sapiens
tgcaagcacctaaacagtttgccaaggaatgtttctcctgagtttgttccttgtgaaggtgaaggaggctttggtttgcacaagaagaaagacctactcagtgataatggttctgaatcacttccgcattcagctgcatacccctttcttggaaccttaggaaataaaccctcacctagatgtacccctggtccttctgaatcaggatgcatgcatataacctttcgcgattctaatgaaagacttggtttaaaagtatataaatgcaatccactaatggaaagtgaaaatgctgcatctgagaaaagtcaaggtttggatgttcaggaacctccagtaaaagatggaggggaccttagtgactgcttgggctggccttccagcagtgcaaccttatc

SEQ ID NO: 9158 - DNA, 395 bp, Homo sapiens
cttctgctgggactggccattatctcagggcttctgttgcattatagccctgtgttctgctggaaagtaggaaacacttccaggggacaaaacatggatgatgtcatggttttggtggattcagaagaggaagaggaggaggaggaggaggaagatgctgcagtaggggaacaggagggagcacgtgagagagaggagttgccaaaagaaatacctaagcaggaccacattcacagagtgaccgccttggtgaatgggaacatagaacagatgggaaatggattccaggatcttcaagatgacagcagtcaggagcaaagtgacattgttcaagaagaagacaggccagtctgaagaagaggatggtccatggttgtcttgctctgaaagcttga

SEQ ID NO: 9159 - DNA, 394 bp, Homo sapiens
cttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcaacacaccatggtgtccttcctcaaacctgtcctgaagcagatcataatggctggcaagtcgatgcagctgctgaagaacctgcagtgtgcgg

SEQ ID NO: 9160 - DNA, 393 bp, Homo sapiens
gacttagcgaaatgtcagcagtctatactgacacaccagcctcatttacaaaaaggagatattaaaacagtgacagtattttttttttaagctctttacaaatccacgttttatgtattttttaatgacatgagctctccaggaaatgtacctcatccccgcagttttcctccaaggggattcatttgggagcaaactgcagtcactttcacaagagtcctctttgatgtcaggagggatcacgaaaccttgcaatgccatgaactggccatggttatcatcaaaagttccatgctaagtgcataacttggagctcactataacctttgtggatttccctaaccataaaaccttgccgctatttttttgaggctttttctttttttttttttt

SEQ ID NO: 9161 - DNA, 417 bp, Homo sapiens
  misc_feature 238, 250, 262, 267, 270, 280, 283, 290, 323, 341, 351, 368,370, 372, 387: n = A,T,C or G
tttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaangaaaaagaaaangagggttaatcnttcanttntggagggggnatnaataaancttgtttgatgttaaagggggtaaggagggagnggccttgaaacacttgtnttccaaactntcctggaggtttccagnancnctactgttcctaaangggtttcatttttaacttcatctgttttgg

SEQ ID NO: 9162 - DNA, 393 bp, Homo sapiens
aattcggcacgaggggagaagcctgagatctgcagagaagtctgccaggcggcctgggactaaaagctgcagaagatggggcatgaggaagcagtgggcaggcagaaggagtgggcaggtggtctgctgctgcctcggggatgcagcttgagctggactttctgcctggctccgtcttgtcaccgagttcgcagcataaacgtcatccctcagagacgctgactcgatctctaataaaagctatcagcctgtccccctttactacgagacccctcttagctctgcagagcatccatcacagttaggcatttttgcctttttttccatccacccacgcttccaccccaccaggacgtgagcttggacttcatcttgtcatcccagcagcaaggg

SEQ ID NO: 9163 - DNA, 393 bp, Homo sapiens
  misc_feature 386: n = A,T,C or G
gtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaaagtccctgacagctncgtgtaa

SEQ ID NO: 9164 - DNA, 383 bp, Homo sapiens
  misc_feature 296, 298, 308, 311, 313, 318, 328, 336, 337, 344, 347, 350,353, 354, 355, 358, 372, 373, 375, 377: n = A,T,C or G
tttgaatctatgatctgtttccttgagggatttttgctaatctgtatttcaatttcccaggtcctagaatttatgatttttttttttaaaaggttagtacctaacagggagaggcagcctcattgtttttagtttctagttggggggaactcagccctagggttgtatacttattaatcccattttagggctttgcacatatccattgttattcagggtttttctctgggcccttccagtttattttcttccttaactggactcttttaaaaaaaaaaacaaaaaaaaactttttngntttttttttnggnanaaagnaaaaaaaaanggcccctnnttttttnggncanttnnnccnttacaaaaggcccnncnanagaaac

SEQ ID NO: 9165 - DNA, 406 bp, Homo sapiens
  misc_feature 155, 164, 165, 175, 191, 195, 201, 203, 204, 207, 209, 216,224, 237, 255, 259, 260, 278, 295, 299, 302, 308, 309, 320,328, 331, 333, 339, 343, 345, 350, 355, 357, 371, 373, 387,398, 402: n = A,T,C or G
aattcggcacgaggttggccaggctagtcttgaatttctgacctcaagtgattcatctcccaaagtgctgggattacaggcgtgagccaccacggccggctaatttttgtattttttagtagtgactggtttcgcggtgttgaccaggctgattnattaactgnntgattttggngaactgcctgagagcntttnctatgncnnccngnaccaccncctttgantaattcttttttnagaatcaagttggttgangcannaaattgccctaatgcttnttggaccacactgcttncctnacngaaacnnaaggaatattnttttgcanctnantgtcanactntnaattnctacngnaaaaaccttttacngnctggcaacatgganaattctgtctntccnaaaa

SEQ ID NO: 9166 - DNA, 407 bp, Homo sapiens
  misc_feature 335, 372, 381, 396: n = A,T,C or G
aattcggcacgaggaagccatctgggagccagcacagaaatcttgacagccaagtactcagcaggccggaaagcagaagatggaccctggagggactgactgtgtgtcaggcacagggttagggactagggataagatctggtccccactcttaagcttagacccatggaggagctctgaatggttgtaccctgttaagcttaggcagaggattcaaagggtgctgtgaggcaaggtgggaggttgggtgggttatattagtattctgaagagtaatagaaccaatagggtgtgcgtgtgtgtgtgtaccatatgtaggtagagggtggggttgntaaggaattagcttatgcagcatggaggcccgagaantcccaaaanctgcaccacccatangttccaggttg

SEQ ID NO: 9167 - DNA, 407 bp, Homo sapiens
aattcggcacgaggaaggccagaagtgtgcctgaaagatagcggcggctggtggccctgggatcagccaaggcttgcctgactgacagtaggacccagaaggataaagagtttgctgaaaacactgaaaacttgaaaaccaaaatgtcagaactaagactctgctgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagattgcaaatgcagccttcacctctgagctgctctaccacactccaccaggatcaccacagctggcatgctcaagtcagcaagatgaaacatctattatc

SEQ ID NO: 9168 - DNA, 410 bp, Homo sapiens
gcattgtatctgcaatttgctacacagtccctaagtcagctatgggaagtagcctctatgctctagaatcaggctctgattttaaatctagagggatgtctgccgcgagtcgtgtgatattcgggcctggtgtgaccatgtccacctgtgatgtcatgcttattgatgacagcgagtatgaagaggaagaagagtttgagattgccttggcagatgcctctgacaatgtccgcattggaagggtggcgacagccaaggtgctcattagtggtcccaacgatgcctcgactgtgtccctgggcaacacggctttcactgtcagtgaggatgcaggcacagtaaagattccagttatccgccatggtactgacctctctactttcgcatctgtctggtgtgcaacgcggccc

SEQ ID NO: 9169 - DNA, 412 bp, Homo sapiens
  misc_feature 400: n = A,T,C or G
ctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaagggcaaactctttgattctacaatagctgatgagggaacatggactttggaggacagaaaaatggttcgtattgttcttacaaagacaaagagagatgcagcaaattgttggacttctctactataatctgaatatgcagcggatccttgggtgcaagaccaaatgcanagaaagcttact

SEQ ID NO: 9170 - DNA, 408 bp, Homo sapiens
aattcggcacgagtgatcacagatgatggaattcgtcacctggggaatggggcctgcgcccatgaccagctggaggtgattgagctggacaactgcccactaatcacagatgcatccctggagcacttgaagagctgtcatagccttgagcggatagaactctatgactgccagcaaatcacacgggctggaatcaagagactcaggacccatttacccaatattaaagtccacgcctacttcgcacctgtcactccacccccatcagtagggggcagcagacagcgcttctgcagatgctgcatcatcctatgacaatggaggtggtcaaccttggcgaactgagtatttaatgacacttctagagctaccgtggagtctctccagtggaagcaaccccagtgttct

SEQ ID NO: 9171 - DNA, 483 bp, Homo sapiens
  misc_feature 13, 20, 26, 36, 37, 38, 41, 44, 45, 52, 65, 328: n = A,T,C or G
ttttgaactcccntatacanctactnggtttttgannnccnatnncaacgantcgctagttgcanggaagacacaaataagaaaactatatagtatgctagagggtgacatgctctaagaaagaagataaggcaggaaagaggattgggaggcacagaaattgagaggacaatattacaaaggtcacggaagaccttgataagaagggaggcaaggaagggatcgttgtatgtagcttctccaggcagaaagaagagtgaatgcataagtattacaacaggaacacccctggtgtgttcaagtaccattacaggacagccccactaanctagttcagagacagaccaggagagattaagaggaaatggggtcaaagcaggaaagaagccagatcctgtagtgtaatgtaggcacaggcaggggcactgactttcactcgactaaaatgggatcccctgggaaacttggagcagaaggggaacc

SEQ ID NO: 9172 - DNA, 455 bp, Homo sapiens
  misc_feature 13, 50: n = A,T,C or G
ccccttgaccccncttgactttcgcggaccatcgaacgctgcctaaaaancaaaaattagccgggcgtggactctatctcaagacaaataaaaaaataataaagacttggcttcaccacatagtcactggggaactgtaggcaaattgcttttttgtggacatccacaattatcccagtactgtttattgaaaagctgttgtcctttctccactgtacttcaatgccaccttggtcataaagcaactgtcctttcctgtgagggtctgtccctggactctattctagttcatggctttatttatctatcgttgtcccactaccatactgtacctttttactgaaacttggtctttttttattgagtgtcttggctcttgcatttccataagaactttacaatcagcctctcaagagccaccaaaaaaccccaccataatcaccccactttttgag

SEQ ID NO: 9173 - DNA, 465 bp, Homo sapiens
  misc_feature 16, 18, 25, 31, 34, 38, 43: n = A,T,C or G
tttaaacacctcttgntntttctgnaggatnccntcgnatccnattcggcacgagggaggctgaggcaggagaatcacttgccacgatgcccggctaatttttgtatttttagtagaggcagggtttctccattttggctaggcttgtctcgaactcttgaccacagatgatccgcccgcctcagcctcccaaagtgctgggattacagacatgagccactgcacccagcctgaaaattcaattttatgcaatccactcactcggaactcaaaatgctaaatatatattattatatgctttaagttgctttatgcattgcttatacatggatgcatataattgaatggagttacaaaccttgcatattattcttgataggtaatgtaaagatgttccaaagtggttttcatcatatgtcactttcaaattacataattttagaagccaatcactgaataaaatgt

SEQ ID NO: 9174 - DNA, 426 bp, Homo sapiens
aattcggcacgaggcaaggtcaaaaatttacatcaggtatctgaatgtgtagcatatacaactgagtgttgaaagaagacaaaatcgttttcatcacgaagaatatgtgctcagtaagaatcagaatgttcaattgtgtgaaggtgggagatgggaagattggtattatggcctggatccagaaatcagtcttccactataggaaatgggaatttaaagatgatcagaagacagttgggagcagagtgagaataagaaccctcaactgctgtctcacctttcagatcacgaagaagttttttacaatgagcagaacactcaacctgaaagcagaatggattgagtcactgcagcgtggcagtggaatggtgtttgatgttggcaaaggaaacatgtacttctagactggcagttttcccttaattt

SEQ ID NO: 9175 - DNA, 426 bp, Homo sapiens
aattcggcacgaggcgaggggcaggctgtgtccaacctctcggggcagggcaagcacgggaagaagcaggtggacccgctcaccatctacggcatccggtgtcaccttttctataaatttggcatcacagaatccgactggtaccgaatcaagcagagcattgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagcgacatccaggttcaagtacgtgcagctggcgccagtgagtgaccacacggtcggggcacagacgggcgaagccctgcagcccacgctcaagccggagatgcactcgagcaccg

SEQ ID NO: 9176 - DNA, 426 bp, Homo sapiens
  misc_feature 365, 375, 405: n = A,T,C or G
aattcggcacgagacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctgcccttgaaaaagatattaaacacaatgaggaacttcttaaaaggngccaactacnttattaagaactaaagatgaaaataagaanaaatatttctgaaattcggga

SEQ ID NO: 9177 - DNA, 414 bp, Homo sapiens
aattcggcacgagataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggcggggtgtctaacaactaaaaactatcactaaatctcaaagagaaagttcttgcaaaatatgtaaagttcacaaggtgcagacattttccttctttaggcttttatctaaggaagg

SEQ ID NO: 9178 - DNA, 419 bp, Homo sapiens
  misc_feature 411: n = A,T,C or G
aattcggcacgagaaaggaactaaatagtctcaaaggacattatcatccaagttatgatagtgatttcgctttctttaaaaaaaaaattattacagatagagtttcttgatgttgcccaggctggcctcaaactcctgggctcaagcagtcctccagcctcagcctcccgagtagctgggactatgagaatatgccaccatgcccagctttattttgctttctaatgtgcctttttgtagttcctgcaaagcataagcatgccttcatctgtggtaccctttccaatattttatttatctcacatcactaataagataaatttatacagccactgctctgtgccagacattatttaagaagttatttcacgcattatctcatctgccttccaaaacaactcttaaataggnatcacctc

SEQ ID NO: 9179 - DNA, 409 bp, Homo sapiens
aattcggcacgagcttgagcccaggagcagaaggttgcagtgagccaagagcctgccactgcactccagcccaggtgacagtgcgagactctgtttcaaaaagcaaaacaaaaccatctgggtgactttaaagataatccagttctggccaggcacgatggctcacgcctgtcatcccaaagtgctgaaattacaagtgtgagtcaccacgccaggcccctctgctctttagatgtgtagtagtttgatttttttgtcctctagtgatgctgcagctcagagacaaaggcagaatctttatcctgatgggcaacaccgtgtcatctggcttctgtgacctcattggtttcttgactctggaacagggagggctgtgtcaaaggggtctccttcccctgtggctctcatt

SEQ ID NO: 9180 - DNA, 419 bp, Homo sapiens
aattcggcacgaggaggaagatgccttcttggcctgataatgtgacagccacctgctgtcactcatttttttcagtgctctgaagatgaccagaacctggtcatcaggtctcctttaaaaagaacaaaacacagacatgcataaaatcatacagcataaaaggatgatgtcattctcagggagacagggcagcatgtgcctgtgttcctcatctactcttgaaggcatcaggtctcttctatttcacactgccagttgctacctaaaagagggaacttctcgaggagagatggactttcatgctcagtgacttagaaactgtgttagagctgactgctatcaaataagcataagactgctataaataaaatagataaatatcaaacaagcacaaataaataagcaaatacataagcaat

SEQ ID NO: 9181 - DNA, 420 bp, Homo sapiens
aattcggcacgagctcaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaagagaaggactcttgggttttgtgttgccatgttaagcatggagagggatgcttgacagcatg

SEQ ID NO: 9182 - DNA, 409 bp, Homo sapiens
  misc_feature 285: n = A,T,C or G
aattcggcacgagatagtcacctacattcagagaactcaggacataaaatcagatgctggtatgcagccaagttcaggctcgtacaggtggaagcagtgaaggtcattccgtagggagggagaagtaagtagatttcatctggaaagaagcatagatgagaaatgcagctctggagagagggcagccatccacatgcagagcaaaaatctggatgcctaaagactttccaggtgtgggcctgtttggagttcttggagtggtctagtaccctttcagttaactcngtttttatgtaagctttctgttattttcagccgaaataactttgagttagacttaatacagagctctgcacagcacttgtaaaatttgaaatttagaatcatcttgtcagggatcatggctctt

SEQ ID NO: 9183 - DNA, 424 bp, Homo sapiens
  misc_feature 406: n = A,T,C or G
aattcggcacgaggaattcccttagcattttgtttctcgctctataaagacctataatgtaataacatctttatagtatttgagaacttattttctcctctaaatttataagcaatgttaaggtaagcccttcatctttgcttatcctctaataccaaacaaacttccataaaaatagaaggatctcaaaaactaaattgaaaaagcagtctagttgaaaaatagaggtgctaaagtaagttgatggctcttaaatgatgccaggacattcttagagtagtgatggctctttgggtttggtggtaacttagaagggaaaaaaaaaatctgcaggaccacatgaccgctagggaaacaggcatcaccaaccattccagaaagctgctttgaacaagccttatataanaaagagagaaagcacttt

SEQ ID NO: 9184 - DNA, 411 bp, Homo sapiens
aattcggcacgaggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcacc

SEQ ID NO: 9185 - DNA, 416 bp, Homo sapiens
aattcggcacgaggcctgctggcctactcatgtgccattctcagtgataagtcctttgcatgtgtcacacaactaatgatggagagtcgggattcagaccccaggaatttgacttaagatctcatgttcttaaccactttcccatactggctccttcatggcaaaaaggctcatgacaaggaaaaaaacctatcacaaagtctgtgtaccaagatgcaagcattgtacttctgtgtgtaaagagacagtatctgcacaccttacttagatccttttccctcttactctgagacacaatatcaacaaaattggtaatctttatatcccatgtctcagtatgtgaagagtattaactaggagaatttcaagtagaggccagctggtaactaccagctacatgaaaggctgatggagag

SEQ ID NO: 9186 - DNA, 415 bp, Homo sapiens
aattcggcacgagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccag

SEQ ID NO: 9187 - DNA, 406 bp, Homo sapiens
aattcggcacgaggagattttgtactatttctgtatttctttcttctcagaacaaccagtgtcaccaggtatgagggcagagttttagcttgtttgctgagccccattcttgaagctcatttatttattcacctatctgtccatcaatccaacaaatatactgaatgctgctatgtgccaggtactggcactgttctaggtactggggcaatgacagttaagataatacccaatgaccctgctctgtacccttaagagcagactcagttgggaatgagttatccaaatatagggtgtacatgtagtcaggagagagcctcatacagctttgcctttggcagaatccttcaaacctctttgtcttcctacttcttgatattacaaatcatgagcctttcacatgcat

SEQ ID NO: 9188 - DNA, 392 bp, Homo sapiens
  misc_feature 313, 318, 328, 335, 353, 358, 362, 366, 370, 383: n = A,T,C or G
ctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttctttttttttttnggggnggggccaaanctttaanctacttttccagtagttngccantttntccnaggnagttgggctgctntttcagaaa

SEQ ID NO: 9189 - DNA, 396 bp, Homo sapiens
aaaaaaacaaaaaagccccccatttataaataaaccttaaccacacacacacaaagtttgttgaatgagtatatatataccactgatgaaaggaaggtgaaatgtttgccatacatatttttatgatcgtttacctgaaattaaccttttaaattacataaccaattgttctaaatcacattagataaaagggtttctactgcataatatccataatatataaagagctcctaaagatcaataagagaaaggtcccactacaaaaagcaaaaagtggcagaagattatacatgggcatttcccaggaaaagaagtactggtgaataaaaaagaaaagatgttcaaattgactctggttattagggaaatgtaaaccgtttttcaccagacagattg

SEQ ID NO: 9190 - DNA, 402 bp, Homo sapiens
  misc_feature 328, 347, 378: n = A,T,C or G
aattcggcacgagcctcaccttacctcaagtgttctcctgaggacccttaggtcagacagagaagctttctctttctgatgggaagggtcaaagtggaaatctcttatctctagtgtgaaatgattttctgctttttcatactccctgccctctttcttttccttaataaatcttccatgtttaagatgttggcctgaagatctgtcccattcataccatgcaccagctgggactgtccctatctgatcagaggggagattaaagaatcaatgttcccaggggaaagggccttaaattgtttggcttttcaatggctgacactgtctncaactctcccttctccttnttctcaagcttctatgcaccctactttccanccaggatggttggcactgatccca

SEQ ID NO: 9191 - DNA, 406 bp, Homo sapiens
aattcggcacgaggttccctttggggggaagatgttggacctttattatttgtggtaaccagccgaggctggttgtcaggacagcaggtgagccactttagggaagaaagtgcaggggtgggtggatgcccagattaccaaggccagccaccctgatggggtagggtctggttatctgtgttcaagaagcaaatcccaccccagccccagcactagctctctatgtatgtattttccctgtacaatgttttataaaagagatcattaatttatctgctatgttaaggctcgaggggtggggcgtagactctcagctgtatattgctctggggtgggcagggaaggctgagtctcacttgacttggaagataaacaggccagtttggactggcctccactccgtggc

SEQ ID NO: 9192 - DNA, 403 bp, Homo sapiens
  misc_feature 170, 188, 191, 210, 212, 226, 231, 248, 258, 267, 271, 273,276, 285, 294, 301, 312, 325, 339, 344, 351, 359, 360, 370,378, 387, 391, 398: n = A,T,C or G
aattcggcacgagatctctattgatgcttttaatgcattgcctgccttcaggttttcttcttaccccacccctcaataagatttggtgaattgtaattctagtaaaacatgtcataccattggttttcctaaattatcaactttctttcattaaaaaaaaaaaagcccancatggtttgactggatanacncccataatttattatgaananaaatttccatgttngtttntgttcctaaaccaaagnacgaggtccntgggaattnaagnanctncccattatntattattanactgcangttcctgcaanaactgtttagttnacagccccgtttcnccagnggagttntgggcagnnattgctgccnaaggcatnactgcgttngctnactctanacttg

SEQ ID NO: 9193 - DNA, 399 bp, Homo sapiens
aattcggcacgagaattcacagtttgcataaactgtaacatttcatactatgattcaaagtactactttaaaaaataagggccactcagcagtaactttaacaattgggattccaccacagaagagctcttgacttctgtgtgtacattctttcacagagtgaatcctttcccagtttcaagtatccctttctatctctcactctgtagtgagttaagaaaggagaaaaaaaagacctccccatttttcctttcgtgagcacaacgacgaccacaaagccattcctcctccccgctgtgcaatcgaaaatgaaaaggctgggtggatgaatagagtcccgagggttccttttcttctggtagtgctcaaaggttcactttcaacctggcgcagactttt

SEQ ID NO: 9194 - DNA, 432 bp, Homo sapiens
aattcggcacgaggtatagtcagtgatggggaatagtccagaaaggctgaaacacagcatgtgatgtgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtcctgtgccagggatttcat

SEQ ID NO: 9195 - DNA, 416 bp, Homo sapiens
  misc_feature 361: n = A,T,C or G
aattcggcacgaggtgacggtgagtgctcccttgtccttgtccctgggagataaaaagtctgttttctacagctgatgttcccaaagtgcagtggacaaaaataaccaactgggcttcccagtgggcggtacccttcccccatccagaggggctttgagacgtgtccatcactcctctaaccagtcaccctttctctttagttctggtcttagggaagccatactgaagagctgccctcggtcgtgagccctaatgagcccatgtctcttctgagagtggattacagtctttgtcctgtgcaacccccctccctttctgtcccccttaggcagaggtgcagcctcagtgtggaagagccgngggattctcttcaggcactgaaaacccacatggagtgaaggctgcaccagggggc

SEQ ID NO: 9196 - DNA, 417 bp, Homo sapiens
ctttattgtggtgggctactgggaacgttatttggaaacattcctgtggaaaaccactcttctcttccccacaatgttgctcacagtatatttgtattggctgtgtagatgggaatttactctgctttactcactttggagaacaggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatggcagcaatgaaatgttgctggcagcagcatctactgatgggaaagtgtggatcttggaatctcagagtggacaattgcaaagtg

SEQ ID NO: 9197 - DNA, 378 bp, Homo sapiens
aaactgtcctactgtatgtagtgacctacttgaagttccccttagggcaacatatataaaaggtgaaaagtattatgatttgtgatacatacacaggcttatttagtttgaagtgtttgtactgtttactttgacctattatctgtcataccttttaggtgtgataattcaacttaattttctttaccaagatccacaaaccccaaataattactttttctcttcccatttcctccagggcatacacaaattgcagtgtgttctaaggcattacaaagtaacaaaataatactgttagatttataaaatgagtcctaataagacatttcagggacatgttgaagcatcatcagttgtaagttagcactattaaaggat

SEQ ID NO: 9198 - DNA, 384 bp, Homo sapiens
ggtcttctcttccattttttaaaaaagaattttgacctacaccaagcaaggcagagaccagagtcagtcccccttggggagcagtctgtggttttgataatcaccaccttgggatgaacatggctggtgagctgcagagcagttgatttgacttttggggatggttctaggctggatgtgatacagggcaggttttgtctctagagaaagttctcatgaccttcaggtctaatgagattcagatcatcactttggtttggtttgaaatttctttgtttatccagtgaattacaagtagaataaagatctggttctaaattgtcttttggtggtgaagtgccatagaccatttcggaccatttctatgatgtaccagcagccccc

SEQ ID NO: 9199 - DNA, 404 bp, Homo sapiens
aattcggcacgaggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattccagtccagaagaaaatgaaaacaaccaacaaaacaaggactatgctgccgtggcttagaagatttttaaaaagaga

SEQ ID NO: 9200 - DNA, 279 bp, Homo sapiens
aattcggcacgagtgaccttgctttgtcatctgatgttaacaggagtctgtaatattcatgccaccacccaagagtcccatttacaaaggagcagacttctggtcttctttagccttttttgtttcttccaacaaaaatccaggctggagtggattagggcaatctcagctcactgaaacctctgcctcccaggctcaagtgattcccttgcttcagcctccgagtagctgggattacaggcactccaccaccacatctggctaatttttttttttttt

SEQ ID NO: 9201 - DNA, 199 bp, Homo sapiens
aattcggcacgaggtcatttatataaacattttaaaaatgacaggaacagtctaattacgttaagtcaattaagttttttttttgcttgattgtttaatgctcttatgaaaaacacatatttgtaaaagaaattatttgcctagaaaaatttaccatgcaatatatttcatcatattggagttcctttttttttttttt

SEQ ID NO: 9202 - DNA, 475 bp, Homo sapiens
  misc_feature 10, 15, 42, 420: n = A,T,C or G
cctcattggnacctnagaccgctcttggactttatgcagganccctcgattcgaattcggcacgagactgccttacaaccttattcctcttcattttgtcttctcacttacctgcagaaacccagtttatttttgttctccctttaccacaccagccttgtaactgttatgaatgaccctcaatctcactggaatctgaatcactcaggaattcaagcaaactggatgttttaaccactgttcagctttcttatggaatgacagagaacttgtaaagataaaacaccagtttgcaggaagaaaggaagagaatggaaattgcttctggaaaatactagttttacaatatgttttgtttgctgctctcttaaataaacttaatcctataaacattttttaagaactagccattaagactgntaagttctcaattataaaggaataaaatggtttaaggaggattatttgccttgct

SEQ ID NO: 9203 - DNA, 438 bp, Homo sapiens
  misc_feature 408, 419, 420: n = A,T,C or G
ctcgggtaactgaaaccacagaaagcaaaacatggataaagtggggtctactgtaggggcaatgtttaaaagcatttgaattgctcttgtatgccttactttgagattaattgtataagttttcagaattattgatcatatcgaaatttaaatttgatgtgaaggaagtatcttaggagaagctaaaaaatacataaatgaacgaagactggaagaatcttcaagatgttaaaaactcatataaccacagaaataaaaactccaattgttaaagtcatagtaaagagaaggaagcaaatcataataggtcaaaatataaagataaaatgaccactgaaaggataataaagattgtgaaaatcaggacactctcaaacagaaaccaaaagcggaagagagatgaaagcnagagcaaagtnngacacaatttgtacgatc

SEQ ID NO: 9204 - DNA, 435 bp, Homo sapiens
aattcggcacgaggagctctctttcctgccagagtgtggtacatttatttaaaacaagtttttgtgtgtcttatacgtgtttaaaatacatacagaactctgattagggagtgttgtgaacatctggtttctgagaatgaatttaggtttcaatagcaaaagtcattgtggccgctcctttaggaaagtcatttttctcctatgagtagtcatccccggtagacttgactgaaatcctgtgttttaggaggatttggggggtgcccctgtcctcccttcctctcattacattgggtcaaattagttttgggttttttttttcccacaagcttcgcttttctaagaagtacacatttggcccaaattcaccgggataagtgagaacagccagaagcataaaatgtgatgaaggtttctcctgggaccttattttac

SEQ ID NO: 9205 - DNA, 423 bp, Homo sapiens
aattcggcacgaggcaagatacaggcttggaccattagctggaaatatggtgagaacagacacagacaccctggggtcgtcagctagcgataccagcatcagttttccccagctgagaaggcaaggaaggagcagggacagtcctgagagctgtggacacgccacacccgctgttgggcctggttaatgccattgaacacctgagcaagggcaggcccagggaggctgaataagtctagattcccatgttgagtaattaaaagaactgacttttaccagatgaaggccagtttcaaagttgggctgcttctgtgttaccactgcccttttgctgtggtctgaatgtttgcgtccccacaaaattcatatgttgaaacctaacccccagatgatggaattaagagatgaggcctttggcaagtg

SEQ ID NO: 9206 - DNA, 420 bp, Homo sapiens
aattcggcacgagctgggatgatgatactgaatagtctggaatgtggcattctttgtctcaaagagagtctttaaaaaaatctgtgttctgatggtagagttccaattttggcattttgccttctgtgataatagatagactttgactctaggtaaatttgtggtggagcaaaagttcgtttggggttgttccacttaccccttactctttgccctccctagtcatgtttgtcctcttttctttctttataggcaatggcctgatactcatagtcaggaataaataaatagttatggtttaaaatattattcttgagagtattttcatctttgtctgggaacaaacatgcttatttgtacttgagttcttgccttctaccatcatcactggaaaaacatctctgggtagtcactgcctcc

SEQ ID NO: 9207 - DNA, 406 bp, Homo sapiens
aattcggcacgagagaagatagaacaattggatgagttacagaaagcaagcaattacatatttgcattaaagtatattttctttctatttaacctagactaagaactatgctaatgatatatttcaaataataaataaaatatcatctatagcctgagagagaggaaaaagaaagaggttagaaggatggaatacttgagggagaagggaaagtgagcatagagttggtcaaaggcaatgagatactgctcgtggtcatggaaggtaacatcacgccctcaataccaatgccctataacagaagtccatttaaaggacttaacccagaaaaattgagaaatgtcaagaatcttacagagcttctgtttgtatactgagaatcagggaatgatcagacaagtgtatc

SEQ ID NO: 9208 - DNA, 408 bp, Homo sapiens
aattcggcacgaggggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaat

SEQ ID NO: 9209 - DNA, 399 bp, Homo sapiens
  misc_feature 383, 384: n = A,T,C or G
aattcggcacgagacaagactctgtctcaaaacaaaacaaaacaaaaaactgggaagttatgagctaatacataaaccttcattgcacagtcttttaaaatttgttgtttctactttctgaaaatgaaaatattaaatccttcctgaaaacagaaaatatcaaaaacttaactgcattagacagagatatatgttaactttgagtgcatttaattttgtattcttgagtactgtttaaagtgtcttttaaaagttctctcttattggggctatttattttattctgtttgcagtttttatgccaactttacacatttgtaaatagaatatttaaaaagaattttttttgagggattgatctctaacttcttggggacttatanntggtcttttgggtgg

SEQ ID NO: 9210 - DNA, 403 bp, Homo sapiens
ccattgcttatcttatattctaattcccagagcaccctacttgaaagccagttgtttagttgatcactagatatcaaagtgaaatgatcaatattagttgcacttgccttttttggtcagaaatgttggaggcaattttgggtggtagaagcagtagttcgtttggtgggattgaatgtctccatgtttacttgtttcatttcttattatgcagcagaaatgtgatggggcctggttgtgtgtgtatagtataagtgttgtcagttccttctaagacatgcgtttactgtctaagggaattttgaacctcattcccatttaccatgccaaaacatatatatctattttatgttgccttgtttttagcataagaagtatatttacttaacgttgcttgcttatt

SEQ ID NO: 9211 - DNA, 398 bp, Homo sapiens
ctccacaaaccacaggcctcggcgggggaagagcccggcgggcgccagcgaagcggaaccaaacggagccgcggcacgcaggcgcaaaggctggcgttcgaggttcgtttacgcgccgcttcgccgtgcaggtggtggcgaagcgctcctccgaaaggtttcggaagctggtggtagctctgaagataacgctgcgttagggcatactgcggcggaggatggaactccgattgaaagcagttgctggagtggagcacgaatttcaacaagccgcatgttgaagtgtgaggcgtgaaagggtatgtctgatatttgctttaaaatgctccagcaaagaaattaagggatggatgaagcaaaagagccaggtatggtggctcatgcctctaatctcagca

SEQ ID NO: 9212 - DNA, 397 bp, Homo sapiens
  misc_feature 17: n = A,T,C or G
aattcggcacgaggtgnctgttaattgtattaactaacatactagtgtctgttaattgtattaattaatgtgtgtacatttctttttattatagattctaaagcaaactactacacgtaggccatcatgttccaagtttttgaaagttcatctttttcatcttgttgataaatttcatcaacttttatgtaggtaattcaaatagaaatttgggataaattggactgattttttgggattattgagtatttttatttcagctcgttttacagcactgaaagctggagtaaaagacattagatatccctagtcacttgagacttcattttaaaagccagttgtactggctttgccatggctttgtcttggttttgatttctaccacatttcctcctct

SEQ ID NO: 9213 - DNA, 393 bp, Homo sapiens
caagcaccctcccaaaccttgtcttccctcttctgttgcatcctttccctacccttccctcccaggtgctcggtactttacctagtttctatatatcagtgttttatgttggaatttttccttgtttttattttactagttggtaaaccctgtttatgctgaaacaaataaggaaatggtatatttgaccatatgtgttattcatagaagacagtatgatcaaatgtgccaaaaacaagcaaacaaaacttaattcctgagaagtatgccttatttttattgatctgctttgtcttacaattaaggtccaagagcttggttaaactgtattatttgcctaagtataaaagaaaacttgaactgcattgcaatattgacgttctttaaaatgag

SEQ ID NO: 9214 - DNA, 396 bp, Homo sapiens
aattcggcacgagctcattcccatttaccatgccaaaacatatatatctattttatgttgccttgtttttagcataagagtatatttacttaacgttgcttgtcttattatgagtccttgggcaaaacaagaggcaattgtactttgttctttgttggatgggtggcagttttcagaaatgcaacagatttttaaatttcaaaatagcaaacaatggggtctatctttcctctgttttggggaagtaagaataataattattttctctcctagcttttaaagatgaaaatcagtttttatttgatattgtaatttaggacatcattttaataattttatatcatatgcttgtctcataaataatatactatacaataaaatttaatgaggacccac

SEQ ID NO: 9215 - DNA, 396 bp, Homo sapiens
  misc_feature 324, 334, 356: n = A,T,C or G
ggaaaacctaacctgattagagccttgactattttgaagattaaatgcacactttttatataatgtgaccagtttaaatgtagtttgtattgtactgggggaccttttgttgttgttgtttgcttaaactgtgattttttttcccctccctaatttcaggggtgagattgactttgggaagacagattagttctttgtcaggccaacaagtgatggagtgcgggagagagaacttggcacccaaatatatcaaactattccgtgccgtggatgttttcattgccaacgagggtgtaatgatttgcttctgcaccttggtctagngctggtttgnggtgtttttgtttgtaaattancctcactgcctccctgaaagtgcacagtcagcccaggtct

SEQ ID NO: 9216 - DNA, 412 bp, Homo sapiens
  misc_feature 393, 401: n = A,T,C or G
aattcggcacgagatttcctacaaaagcttgatgccatagagctcttactgctttaggtgagaatttgagtctttgaattatttgttttgaacttttattttggcagaaatacctttttagaacaatggttagctctaacttaggactttggttttcctacgtcgctttattttcctttgttaaggttcgtggttaaaataccatatatcaggtttaaatgcttacaagatttctttggtgctgaaattctggcgctggactgtggctgataaaatattattgtggtttctttcactagaagaaacttttcatctgtagaacttcgtttttagttgaagtcattgagcctttctttacttgaaaagaaaattaagtacttttcttccatcctntgaaaagntaaatgaaaag

SEQ ID NO: 9217 - DNA, 387 bp, Homo sapiens
gttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggt

SEQ ID NO: 9218 - DNA, 392 bp, Homo sapiens
  misc_feature 365, 370, 382: n = A,T,C or G
agagaagaaagagctgcaaatccaggtggagcactacgagttccagacgcgccagctggagctgaaggccaagaactatgccgatcatagtaagtggctggcgggagcctggaggcgcgcttgatgggcgctgctctgggacggctctggttggggtgggcatggagcgccttccacacaaggggacgagaggaagcccattgggagcctcagccatgtattccagctctttgtactgctgcctgtttctgtaatgggccccagattgtgtgtggaaataagtaaatcaggccactgtggcccatagcacttttgcttcagagtgaattctgacccccagatcacaagtctgtggtcctgaaggnccttnctgaatcttttnaacagagctc

SEQ ID NO: 9219 - DNA, 409 bp, Homo sapiens
aattcggcacgaggatatgttgagacaatgactttgggtcaagaggaaattacatagctgaaatattaagaccttgaacatagcagaaacataaacctatgaacaacttgtgttttgtgtgaaagctagggtagctgataggattagcagatattggtagaattaagagtcaatatttaaattattgctaaagattaaaatccctcatcttatagtttgtaggggattccatgatggtaaggtatagattgaaattaaatttagtaactaggcatttctgaccataccatataaaaaataattgtaatatggtataaacactgattaaaagtaattatggattttcatgcctgaagaacctttcagtattcttacagcactgtatcttctttattggtgagaatatcag

SEQ ID NO: 9220 - DNA, 409 bp, Homo sapiens
  misc_feature 404: n = A,T,C or G
ggaaatggaggtgagtgttgccaaggcaattgatgaccttattgttgacctgcttgaccaaaagagaataaattattccaaaataagaaccttggctctttttgctgggctatggttgtgttccattttaaagttatttagaaaactaaacacttgcaagaatctttgttcttagaaggactgtattcatagaataagtgaaatctactttgatttccgacttacccactcccatttttctcagatatttatcaagtaatgtggtttgtaatccaaacaaaaaaaagtgccttaatccagaacatacacatggagacaataacagcagactgatggtgtttgtactttactaaaacattgagatcttctctaaaacagagtggttgagaacatagtgctaaagngaaag

SEQ ID NO: 9221 - DNA, 402 bp, Homo sapiens
  misc_feature 381, 383: n = A,T,C or G
cacatcccaccctgcctccgggaaggggcctctcctggacatgtctcctgcagctgctgctgagccagatggggaccagcaggacagacacgtcagcaaactcatcctctgcttctttgtcttcggcgccgtcttgttgtgtgtgggagtcctgctctccatctttgggttccaggcatgccaatataagcccctcccagactgccccatggtgctcaaggtggcggggcctgcatgtgccgtggttgggcttggggctgtgatcctggcccgctcccgggcgcaacttcagctccgtgcagggctgcagagaggtcagcagatggaccccgaccgagccttcatctgtggagagagccgccagtttgcccagtgccttanantttggtttctgttcttgac

SEQ ID NO: 9222 - DNA, 388 bp, Homo sapiens
aattcggcacgaggcagtgtctccatcagcagtttgctctccatgggcacacgatgacaaaatatcctgaagcgaaccactagtctgacctcagtagcaggattggaagcttcatgccatgggagctgtcaagaaaggcatcccaaagagaactgaaatttaaaaataataatagaccttcaggaataggtgattgtccccatatactggggatgaaatacccaatgtaaccaaattccccagtaagatcacttagtttggcaatagtcttttcttttgagcatgttgaagtttatttgctcaatgaaggctgaaattataagtcagtatatatgtattactaagtagaacttgaggtaattatatgttttagtcaaaagcagtttct

SEQ ID NO: 9223 - DNA, 455 bp, Homo sapiens
  misc_feature 5, 12, 14, 20, 32, 45, 47, 52, 55, 56: n = A,T,C or G
tttgnctttganancgcacncggcttttgccntttgcaggatccncnattcnaanncggcacgagatcactctcattatcactgctcatgcttcttctctcccactgccagttatgattttggaggagtggggactatgacatgtttctttgtatcatctctagcacaatagtttgctcattgtcagtgccctaaatgtatgcataaaatgaatgtgtgaatgaatttgacataaatgaatattgtttttggtacctcagccattctttcctttaatcgctttccagtttccccaggcttcttttgcatttatgttctccttccagtccctcatataaaaccctcctttcaggaaagaattgggtgagcatactcaacccaagatattaatggccaaaaaatgttagacttttgtggtatacgcatttaaaagtgtagaactcggccgggcgcgg

SEQ ID NO: 9224 - DNA, 429 bp, Homo sapiens
  misc_feature 365, 392: n = A,T,C or G
aattcggcacgagaaaagaaatagggttgaattctgataaaaagtgacctattagaaaagtatttctattcctctagggacatccgttcaatttttgttgttgcttcattgatttttgtaaaaaggtgttgccttttaaaaatcattttagaaaggcaatgtcatttttaatgacattactaccatgcatagttttgtgagaaacctggctatgttaaagccatttcatttgagatacattttgaattgaaagttattctgttgttcttgttttcagaagcagataattttggcgatgtctgggccttcttgctgctctttatctgtttacctacctgcttatcacaactaactttctgtccagntttttttaatccttagtaaatcagtgnctaagaatctttagtcactcagttttgaggatgactg

SEQ ID NO: 9225 - DNA, 407 bp, Homo sapiens
ttttttttgaattattgagaatatttctttggacccacaactataaaatgtgaaaaaaaataaaaagtatgccaaaagggccacgtgtttctacaacacacgaaagtaaagaataatactgcatgtctaatatgcaaataaaatgtctctgccaaaatatcacaacttaaaatgccattatgaaacaaaccacagaaagaccttatttgtgttacataccaggaacataccaaaatttgaatgtctgatccacacagtgattcacataagatgataaagaaacaaatggatattttgtgacacaaacgtattgtgaagccttaatatcacagatttatatgcatttaattaaccatataggctatctgaaaattattgatacatcacttgtttctagggtctaaaaa

SEQ ID NO: 9226 - DNA, 405 bp, Homo sapiens
  misc_feature 252, 382: n = A,T,C or G
aattcggcacgagattacctctaaaatatagacaggaatatgacattcttatttgaaggaaatggaaggtaattcttttcacaaacttaagaatctttccatgacataaataaatcgagttttatttataagtaccctagtagctagtcacatttctggtaacctcagccaaaaaataaatctgccaattccttgagtcattaaaatatcttttacatttatattctgcatatttactttaatgatatctgnattttactgcacttagcacacaagtttaacaaaattttcccaggccacaagaagataaaatatgacaaagagtaacccagttttgaaaaatgaagaaatgaatactctattgaagcaagtcagaatgccnaagtcaacaatttatgaattttt

SEQ ID NO: 9227 - DNA, 408 bp, Homo sapiens
aattcggcacgaggttagatatagcgattgggtagtggaatgggtgttggatgcaacaggatcttggaaaatatttctgggggttagaggataggctgagaatattatagatgtttggaaacatttgtgccaacctgaagatggtgtttctttgtctctcccaattagcacagctgtgttctgttggtcatctggtagagtgatcaatctagagttagaatacctagggatgacataaaggaatatgacagtccggaaatctaccagatgaagagccagtctgagctcagaggggattttgagccaaggcatggcattttatttttagatggagctgaacattgtgatagtaaccagcactagatgaactaaagttcaggaggaaaagcggaactatccaaggtgaac

SEQ ID NO: 9228 - DNA, 419 bp, Homo sapiens
gtccccaggggccgactcttcgcttttgactcagagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgattacttgccccaagggccacccgaggaagcagtattatctgcggtggggggaggagatataggacaggaaaaccacgtgctccactccagctccctgcagtgcagtgactctgcagggaaagactgcaaggaggctcaagtgcttccatctgtggtgactggaatgggac

SEQ ID NO: 9229 - DNA, 399 bp, Homo sapiens
aattcggcacgaggttaatgctttcgtctcttgtaaggtaaggcatatactgcttgcttacacaagaactattggcattttctttttttcgtttgaaacaaatatgaaaaatagtattttggttttaagaaatttttattttagcatacaacatataactgacatttgttttttcttttttgtcttgtaaacttaattcttaaaacttaggaaaatttttggataggacaacttggtgattcagctataacagatcttatttcaataataactttctgcaatatgtattcatacattttcaaatgtgtgccttaggaaatcacaagtgcttttatagtgtgaagtgttaatggctgaatccaactgaatcaccaactagtaagtgggggtctggttgat

SEQ ID NO: 9230 - DNA, 400 bp, Homo sapiens
aattcggcacgagcccaggagccctgctctcaggatttacaacaccagaatcccaagttttctgagaatcgggcatccaaccctcctgcttcatcatggcaaaaaaaatccctggacctagacccagatatccaggttaagtccctggtcaaaaggaccacacatttccctgatggttatccaccttgccttgccacggtctgtgctcatccctctctctgtccttcattcctctctgacatctttctcccagagtaactgctaacttccagtctaaatcttgctgaggaagaagagataccacctcatgattcatcttggagtggccaagcctccctccacttgtttaaattgccccattcccggagaccttgccctgtgcccagcgctgggctgagca

SEQ ID NO: 9231 - DNA, 403 bp, Homo sapiens
aattcggcacgagggtggcacgtgcctttagttccagctactcaggaggctgaggcaggaggattgcttgagcccaggctgtgtggttcaccataattgtgtttgtgactagctactgcactccaacctgggcaacatagtgggacttcatctctaaaacaaaacaaaacaaaattacacttaagcactattgtttaatttttaattgtcagtttatcattattttgggtaagacattctggggtttcttgaatcttgtccaaaaaccagttgttttggaaaattgctttaaattgagcatatttatgtatattggataaaaatgtactacagagcaaatttcaaatttttcattatatcagtctttttgaaaggatcaacttggataaaataaatatataat

SEQ ID NO: 9232 - DNA, 401 bp, Homo sapiens
cagctttttcatagtggatttgatggtttttaagtaaagaatggaactggtatgcttttgaaatcagtgtggcttaataaaatcctcatgtgtattttagcaccctcatcataactccatacagtatactttttgttccccttttcattttccatttattcctggtttctttgtatgtctatgctgtcctctctactattttcctcttcctctgttttgaactttttcctttctctgaataacctaagtggaatttcaggtggtctcatctagccactcaggtgctaaacactaaatgattttatgcctgcctttatttcccaaagacaaaaagtcacttatgtacaaaagtgaaagtggtgctgatgcaggaaagccaaaatggagtcctaacacttgtc

SEQ ID NO: 9233 - DNA, 416 bp, Homo sapiens
ctgctgaccaccataccccactccagcctcactgagcatttttgtgtaaggttagtggtgcagttcatttagcaataaatactgttgtaccttttgcagtagacaactattaactttcatccttgattctcagttttttccaaaatacaagtgaatacctggtttccccagcaacattgtaagattgagagtaggaattcattgagattttaatgaattccatggattgtcttaagagctatctaaacttggaagaaaaataacttccagagcatctaaaattgaaaataaaagatcagaagcaaatgaaagatcaattccacacagcttttcctctcttagacgtccctcttctgccatatcctgtaaacatctgaagtgttctgagtacatttggagagaatatttaatgatca

SEQ ID NO: 9234 - DNA, 384 bp, Homo sapiens
agcaaccctagcaatagactgactctactacaaaacaatttgggtatttctcttactatttctctattatatctgttgagggaatgttatcatgagcacaggtattagtcctatgcttttaatcggtttagtggtttctttgtgtctcattttattcatttgtaatttttttaaagactataaaacttccacagtttctttagatcattaagttatatgactctttttcatgggggtcagttaacaatacataagaaaacattcgttctaggataatatatgacctaacagtcttttgttagacttagagatatcaatatgctttctatgtttcaggcatattttatattcctggaaattaaacaatatattttaggaccccat

SEQ ID NO: 9235 - DNA, 314 bp, Homo sapiens
aattcggcacgagctgaggtttctgattccatatttaattgactattatcaatagcctgatattgaaaaacatttgtagttttcagtgtgaaactaaggggttgaagaatcactattacaatccctattacagagcatttcgggttttgcttgtattttagattctgatacatacgctgtttcactcaggaactacttctaccagttaatcagcattatccagcacttgtctttaaaattcatttggcgcttgtttgttttcaactgaggaaattgagtatagttcattgaagaatggaatttttttttttttt

SEQ ID NO: 9236 - DNA, 315 bp, Homo sapiens
gatatgctttaaaattaaggtgagtggtattatctctagtttgagacaaagagaagcgaagtaacaaaaggccacataagtgataaatagtggacctggagtttaaacctgggatccccacctaattcagaaatacgaaatcaaccacttttttgatgatccagggtctatgtatatttattacatgtatgtatatatgtatatatatatgcatgtgtatatatgtacatacatacatatagatgtgcttgtctagtgtttttcccaccagataggtagcctttcttctccccttgctcactttttttttttttt

SEQ ID NO: 9237 - DNA, 386 bp, Homo sapiens
  misc_feature 272, 280, 282, 287, 295, 298, 301, 305, 306, 308, 312, 314,317, 318, 324, 328, 334, 338, 341, 342, 344, 345, 347, 349,350, 351, 354, 355, 359, 360, 362, 363, 364, 366, 367, 374,377, 378, 380, 381: n = A,T,C or G
aattcggcacgagatagtcttattttttatttcagtatagctatggttacttttttcattctgtgttttgtatatttgtatccttgatctgtcttgctagaggtttgtctttttaattaacttttgatattgaaaatttccaagcatacataagagagtgtaaaaaacttgcaagcacccattactcaactttaacaactatccatattttgccatatttttttttgccttatctttttaagaaatgtcttatacagtgggtgaggtggacnatgcctgnanttctngcctctgngangcngganncnttcncnacnnttcganctcnccctcntacntgnntnngncnnncanngctnncnnnannccctggntcnntnnctcac

SEQ ID NO: 9238 - DNA, 462 bp, Homo sapiens
  misc_feature 13, 15, 33, 40: n = A,T,C or G
ttggcctttggantntcacacgagcttttgcangatccgntggattcgaattcggcacgaggcttctcctcctcttctccagctcccaggcgaatcatacagaggtgtgctctcaaatgcacacacacatacattcactcagcagataggtgcacactccccagaacaaacccagtctctgagcccccttcaccaccctcccctctcccgagctcactcccaagggccttgcctcagtggaacactgtgatttggacagggaatgcatcctgacttctgcacaccggtatatcacctttcctgcatccttaattaaacaaatcctgagcatttacaattcaaccagtatgcattcagcacctactgtgagccaggcccagttctaggaggcctggagagaagggcggtgacaaaagagaccaaaaatctctcacagagatgataatgtgtcccacatcgccg

SEQ ID NO: 9239 - DNA, 420 bp, Homo sapiens
  misc_feature 410: n = A,T,C or G
aattcggcacgagaatagatgtatagttgctgccatctccccatataaaaactctctttacatcgtttctgagccactttctttgctgtctgcagcatttaaaatatattatttttcctaattagaaaagtcacaggttttagaaaattgggaaaacaaaaagagcataaagaatcatcaatactctggtatagatatagatctttccagtacgtttgtgtatgtgtgtacacgccattatctacaaaaaagttatgttgaacatggtagtttaagctgtctttctggtaaatgctcttatacaatatgatttttagtgactaatattccctaatgtgttcatgccagaattcacataaccagtaccttgtcaaataggaggtttctgattaaatagtagtagagacagnatcctgttac

SEQ ID NO: 9240 - DNA, 415 bp, Homo sapiens
aattcggcacgagactacaaaatgttaacaatgggtgaatgtaggtgaagagtatgtggcagggtgttttttattctcgcaaattttgtgtaggtttgaagttaccacagaatagcaaatataagaatgattcctgcagacacacgagtgatttcaactgttcacagggctcaggcaggaagcagatctcttgccctccctctgatccaggtcacttagtccagtccctgaaagcagtggatggacaaccatgccaccctctttcttccaatacaccttattttgtatcctgccctttttgtgtagcattagatcatgagcattttcctctgctataaatgtcccctcaaatatgttgtttcttgtgactccctagtgtctacccacgatttcctcggctgctccaccttggggg

SEQ ID NO: 9241 - DNA, 407 bp, Homo sapiens
ctctgagctgaggaaacaaggtgtcctccatcccccagtgccttcacatcttgaggatatgcttctgtactttttaaaagcttatagttggtatggaaaacatttttcttatttttaagtgttattaattatatctatggaaaaactattcctgaaatatatacagtcttatgtcccaatcagagtcttttaacctatgatttaaaaatgtataagtaacagaaattaacatattttaatgactttactttttatttctaagaaaagtatttgaaaaatggaataattttaaatcaatgataattctagggatcatgaactcccagaagattttattatttaattgtaaaggtagaggccagacgcagtggctcacgcctgtaattccagcactttgggaggccgag

SEQ ID NO: 9242 - DNA, 405 bp, Homo sapiens
aattcggcacgaggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttctttcttgcacgccccactacgtttgctatcattgaaaacctaaagtattttttggtaaaaaag

SEQ ID NO: 9243 - DNA, 386 bp, Homo sapiens
gatcatagctcactacagccttgaagtcctggactcaagcaatcctcctgcctcagcctcccctgtctcaaaagttaaaaaataaataaattttttttaaaaaaagaattaattacaaggtgaagttaacaaggaaggttatatgttatgaagaatattctactatacgattgtaagtttagacttggtccagtagcaatgtggaggtattgaagtttttaagcaggagaataaaatgatcagattgaggatgatggctctgatggtaaagtataatcaagtttagctttcctaatgtcctttctttgatgcacttaacaatttgaccacggaaattaaacttactgcctttaccctaagaacccatgtagttcttcaaggtctcg

SEQ ID NO: 9244 - DNA, 426 bp, Homo sapiens
aattcggcacgagacaacctgtcccctgtcacagcagcagaacaagggcaaaacagggatgaagtaggaagaataaacacccagatttcctcctaccctcccatctcttgctggtgcctccagtgcataaggaagtccagatgatgcagtcaatagaggtcagcctcccagatgtggagctagagaagagcaaaaagtggcctgggaatatacagaataacgagcacaccatccttagacagtcacatccatccacacatccattcacatttcagttcataccagagatcattgctaatgttatatagaacataataaacataaatcccatttctcactcattctaaacattacatttcaggtacacagtacatcccatcatcatacattctggccacaacctacccttcccacatcacttctact

SEQ ID NO: 9245 - DNA, 408 bp, Homo sapiens
  misc_feature 400, 402: n = A,T,C or G
aattcggcacgagcatagcaatacactgttttattttattgttagttattattgttaatctcttactgtgactgatttataaattaaactttacaataggtacgtacgcataggactaaacagtctatataggctttggtactatccacagtttcaagcatccattggaggtcttggaacatatctcccatggataaggtgggctactgtattggtttaagttcctcagatttcctggactacctgacattaggctctacaattctttcatacatgctacttcaatcagcagcatgcttagcacatagcatgtgtttaataaaagttaaatttaaaataaaaatcaagatttccagttgaactgaagctagggaaacctacacatattttgtgcgttagntngtttgg

SEQ ID NO: 9246 - DNA, 398 bp, Homo sapiens
aattcggcacgagagcaaccctagcaatagactgactctactacaaaacaatttggttatttctcttactatttctctattatatctggtgagggaatgttatcatgagcacaggtattagtcctatgcttttaatcggtttagtggtttctttgtgtctcattttattcatttgtaatttttttaaagactataaaacttccacagtttctttagatcattaagttatatgactctttttcatgggggtcagttaacaatacataagaaaacatttgttctaggataatatatgacctaacagccttttgttagacttagagatatcaatatgctttctatgtttcaggcatatttatattcctggaaattaaacaatatattttaggaccccatac

SEQ ID NO: 9247 - DNA, 396 bp, Homo sapiens
actacttagaggccacgatgaaatattttagctagttttgttaattaaataaaaaatattttaacttaattcgatgggaaatatttcaaagtttctcttacagctaattaagctaagtattaatgtgaatgtgtaaagtgactgatttttaaagctatcaggaaattacactctgccaaatattatactgcagctagaatctagatgatggcaggatatgaaaaccaaaaaactgtctaaaaattttattaaaaatatgagtcagtctcaatcggtttatcaaggcatacattttgttggagtgccagaaaagaccataatgtgtatgtgaacatttgtctttgtgttaaattaattagctttagaataaaaatgtaaaaattatttgcccacctg

SEQ ID NO: 9248 - DNA, 406 bp, Homo sapiens
aattcggcacgagatatagtccagatgaggaaaataaggctgaaggcaagctaaacttgcctgaagccacattgctaggaagtgacagaaccttgtaaacaagatttaagatttgatatactttcttattttctaaaaatttcaatgtgcatgtagttctcagatgctttcctcgaagaaaagggagtgtcatctatttatctgaccttgcaattatgacatttcttagaagtttttttttttaactgaccgtatcttatgaaatggtcttgcgatggtgttgttgaaatgacttttttgctgcagtgtgccttgccctgataattccttcttcctactatgcttcagtgtaattatttctcttactcccactgatactgggggaaggagaggaaactccctgatg

SEQ ID NO: 9249 - DNA, 448 bp, Homo sapiens
  misc_feature 12, 17, 30, 33, 295, 298, 309, 379, 387, 423: n = A,T,C or G
attcggctcttnatctnctcttgttctttngcnggaattcggcacgagagtgtgcttgactccagtggaactcacacagtaaatagcgtccgattacacacaccattctcataactttctctcctgccttctttagcttggtacagctctgtttgcaacaagatcctgagaaaaggtaatattgatctcttttaaatagcacaaaatgtacatgttttacattttatagaagctttgtaacattgcccttccaggagaatacaaatcttttgatcaaaatattgctgctctaaanatntcaatgcttanaacaattagtgggaacaagccaatgagaagaatctggattcaaatcaaaaaaagctgggtgcgggggctnacacctgnaatcccaaacttttggaaggccaagccggtggatgnctgagtcaggagtcaaacccccttg

SEQ ID NO: 9250 - DNA, 418 bp, Homo sapiens
aattcggcacgaggagctgcccccatgattcagttacctcccaccaggtccctttcacaatgcatcggaattatgagagctacaattgaagatgagatttgggtggggacacaggcaaaccatatcagaccccaagatctcttttcagctctataggctgatccctgtgacttgcatcttgcagaagaaaacaatggcttttcagtgccttttttgtaaataatatggctgcatagtcagagaatatgggagacagtgtctcctttattttgaagacataattgtggtttggtggaaagagctctggactaagagacagaaggcctaggttttacttttagcttcaataccatgtggccatgtgaccggaggaaggttgactcttctgaacttcagttcctctacctgagaaacaaga

SEQ ID NO: 9251 - DNA, 416 bp, Homo sapiens
  misc_feature 347, 363, 373, 382: n = A,T,C or G
aattcggcacgagacccctatcaagatacagcacattctcgtcactgccagaaagttgccctttgccccttcctggtcagtacctgctcccagaagcagtcactggcttgccttgtcattgtgggtcagccttgcctcttctagaatttcacagagggggagtcctgccccgtggagtccgttgggttgagcatcttcggctcagcatgatccttttgagatgcagggatgttggtgtgtgtgtatcgggagtgtcttcctttaagaaattctttcccgtgagtatttcttcaagcctggatttctcatgaggctccaaactgcagaagatgaaaagggagggctgnggttcctgtgtctcanctcctggtgngcagtaagngctctgtagatgcttggtgaatgaatggatgggg

SEQ ID NO: 9252 - DNA, 461 bp, Homo sapiens
  misc_feature 7, 12, 30, 31, 32, 33, 36, 43, 56, 451: n = A,T,C or G
tttggcnccttnaatacaagctctttgtgnnnnatncaagaanccatctgagttcnaattcggcgacgagcagacaccgagcttcagcaagctctctccaacggatgaagccccacccgcccttcaggatgccagccttggcaacattgtgagaccctgattctacaaaaagtaaatgagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaaacaaagaaagtggatgcgcgctgctcctgccattggatcatcgcagcatttttcttttctctgatatgcacctttttctcatcgggggggctcacgttttcatagttccctctcactactaggntgggagctgc

SEQ ID NO: 9253 - DNA, 415 bp, Homo sapiens
ctgctagccccatgtgaccatttgaagttgaatttaaatctacattaattaaacttaaataaaacatttgtaaaaattagtctctcagccactagtcacattttgagtgctcagtagccatcccttgcaagtattaggacagtatggaacattcccaccactgcagaaagttctgtggtgcagtgtccatctagatgattctacaaatggaagatttaggggaagaggagaagtaagtagtgaggtgtacctaattgcttctataagttttagtacaaagaacccttcctttaaaatattgatatttggtgaaacattcagatatcacgttttaaagtgatttcatggacactaatcaacagagcaacaacatagatatatcattgctacaaggatggatcaatacttgtctacc

SEQ ID NO: 9254 - DNA, 427 bp, Homo sapiens
aactctggctcttctcgtgaattacatttcactggagtcaggtgttttctgtaaacatcgttaaaccacgagaccaactgcattgaacattttttgcactacattgttttatttcttgctcgtcttttccttgcagagctggggctggggtgaggtgtgtggtgtacctagcactcaaaatgtaaggattctcagagtcatacaggtgcacggtcagcacctgagagtgagccaccctttaacattttgccttctaggtgcttcacttgccttgcccaagcactacccctagattaaataatatgtttctattagttttttaaaattataatattaacaataactagcacttattgagcactcccttatgtgccagcaaatgtgacttacatgtatctgcttatttttccttacatgaaaccctctg

SEQ ID NO: 9255 - DNA, 414 bp, Homo sapiens
aattcggcacgaggtttcaccgtgttagccaggatggtctcgatctcttgacctcgtgatccgcccgcctcagcctcccaaatcgctgggattacaggcgtgagccaccgcgcccggcctgtatctgcctttttgaccacaccattattcgtgggatttaacaggagttaatgagttaataatgttccttttccaaactcagtggttttgattttacaaattatttgacttttcctgatttcaggatcttgacaatttgcctttacttattcaaatgttattataccaaatatttatttaaaaagtttttttttctttgattcctcaagttgtagagagaaatagggatagggaagcagaatcaagtagttaaaaagatagcctcatttgaccctgatttcccaattgggaata

SEQ ID NO: 9256 - DNA, 414 bp, Homo sapiens
caattcggcacgagatgagcctttactgtaagctaccttaaatcttttttggaaagaggtaggatataaattaaacatacacctccccaagatctcagagtgttgatggactgattacagagacggggagcaggtatttcctcattcatcactggaggcagaaaaatcacctccaaatatttgttctctgatagcagttgggaaaagtcctccttaaatgagaggcccacgaagggatgaatagggattttggctgacctccaaagtgaagctaagataatgcctgccttcccagtattacttgaggctaattactcagatataattacttgcactctgtgtttttgcttccaatagggttgggccttgcttttgtttatcttgtatcccccattagactttgagctctttaaa

SEQ ID NO: 9257 - DNA, 408 bp, Homo sapiens
gcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaaaggctccctgaatggtgtccacacagcgaggaagccacgcttgaacctctcatccaggacattctccacactctgccggtcctaactcaggcagcagccataactggtgactcggctgagccatgccagcccccatgcactgtggcaggaccaaggtgttcatgactga

SEQ ID NO: 9258 - DNA, 379 bp, Homo sapiens
gcaacatgtataaaaatagaagtgcaggaccagaagtgagcaaagggggttatatattgggcaaagtgacaaaatatggtagagatatgacatggcggatttccctgacaataagattaccaagaaaatagattccagagacaagcaagcatgtgtatatatgtgggaatttaatatatgatcaaagaagtatttctgatcaaatgtgaaaagatgtattagtcaataaatacctaaggatgactggttatccaattgggaaaaaaataaatccttacctcatatcaaactcaaaagtaaattccagggagattaaagatctgaagataaaagaccattgaagtgttagacagaaatgaaggaaactattattataatt

SEQ ID NO: 9259 - DNA, 406 bp, Homo sapiens
aattcggcacgaggtcagattccagatatatgatgaaagtagacctgcaggacttgttgacagattgggtgtgggaggtgtaagagaggagtcctggcttgagtaatttagaaggatgacatggctatttcctgatgtggggaagactgtgggagaaacacgctggggaggagtggagtcaggagttgagttttagaggtattaagtttgagattcctgacatatccctgtaggcagctgaatatatgagtctggaacccaaggaaggacttagaagggagacattttttgtttggtgatttacagttagaccttgtcctcacattcaagttggaccttgtcctcacatccctgcttcatacgtagaaagttgttgggtctcttctctttcccaagaatgagcaat

SEQ ID NO: 9260 - DNA, 384 bp, Homo sapiens
aattcggcacgagggaggtttctttggagagcttctatcctactggaaacccaggttgggccccatgtggattgatcggcagtgggaatcagctagggctgctgtaactgagttcgcagacccagtggcatagacagcaaagaggtactgccacgtggctttggagaccagaagtctgagaggaaggtgctggcagggctggttccttctgaggctgcaatggaaaacctgtcctggcctctctcctggcatctgctggttatctttggtgttccctgtagacagctgccccctccctgtatcttcatgtcgtcttccttctctgtgtccttctcttcacgtagtctttttaggacgctggtcgtgttgccttagggcccccat

SEQ ID NO: 9261 - DNA, 409 bp, Homo sapiens
aattcggcacgagacaatacatgagtaatctgaaagtatttaggctgttgaaattttctgattgctttagatttgcatctcatgaaaaacagcagtcttccctacctaccttttagtatcctaccctagaggctgttactttcagctcttttagctatttcttctagcattttcctccatgtttacaaataatattcttatattgcactctcattttcttttccatctatttcagacatactgactttctcccatgcagggtcacagtgtggctttcttacaccatttgctgcaacacagacacttctcctgctccttcccatgtggttcgtgtgtgtgtgtgtgtaagtgtatgtaaaatccacccttagagggggaattgctgctgggcatggtggctcatgcctgg

SEQ ID NO: 9262 - DNA, 407 bp, Homo sapiens
cgcaaagaaatattagaatattaaaaagacaagtctgtctcagtatttcattttagccctatcttttattaatgcatggtgtgcaataacaaatcacaataaccagtgtatattgagtgatataatatattatgctgaagttctttcattccatcatctcatttattctcaccttaatgttgtctttattttaaagctgcattttaaagcaaaatctgccaaagttcacccatctagtaaatgacagagctgggactggaaaccaggctagaatatccttgtgtatgaatcagtaatcatggtaaacaagagattggtcagggaaaaattttggttggaataggaggagagagagtccagtatgtaaaatgtgattttgctattttacttgaaaattgtagatttgg

SEQ ID NO: 9263 - DNA, 405 bp, Homo sapiens
aattcggcacgagacatgtaccctggaactataaaaataaaaataaaacaaacaaacaaaaaacatgtgtgcaaacatgtgttaaagacttgtacacaaacatgcatagcagctttatttctgatagctctaaactacaaacaatccagaattccaacaggtacatggttaaattttgttatactcatacaatgcaatagtactcataatgaaaaggaaatatcaatatatttaatgactctcaaaagaatgaaaatccaagaaatgtcaagcatgccataagacaactgcactcaaaggaaactcaaagtgagtgaaaggaaccagacaatagtaatttgtccacactatatggctcaatttcaataaaactgtaggaaatgcaattgaatctatagcaacaga

SEQ ID NO: 9264 - DNA, 168 bp, Homo sapiens
aattcggcacgagggtgtgagccaccatgcttgaccataaagccttactatttcttttggagacacagtcttgctctgtccaagctgagatgggaggatcacttgacctaggagttcaagtcaagcctgggcaacatggcaggaccctatctttaaaaaaaaaaaaaa

SEQ ID NO: 9265 - DNA, 388 bp, Homo sapiens
  misc_feature 302: n = A,T,C or G
aattctgcacgagagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaccccagatcagaagatctggccatgctggggctcacattctcacctagcaacaactggctggagctgggcaccagctctgcctttanaaggggtgtccacttcaccaggtcaccacagcccacactacgccctatcacttcccacaatgaggctgagtgtttgtttctactga

SEQ ID NO: 9266 - DNA, 420 bp, Homo sapiens
  misc_feature 383: n = A,T,C or G
aattcggcacgagggttaagggagagaagaggatgaataggtaatgcacagaggatttttgaggcagtgaattaaaagaaaaaaaactcgatccctgtccttacggatctctggtctagtcggagtcagcaggcacacagaggcctgctgagatggagaatcgatgctcagattcttcctctgtatccagaagaagccagaggagggtactgcctggccctgggaggcttcactagaggttttcgagaggaagatgcaccgtctaaggtgtgacgggaaagggccagaaagagaatgagggaagaacattccaagccacagaaatggcacatggaagaaagcagagatgagaggagaaaccatctgtgacttaagtggctcancagactggagagagtcgggcaattgagttgaacacag

SEQ ID NO: 9267 - DNA, 400 bp, Homo sapiens
  misc_feature 262, 265, 267, 278, 290, 308, 334, 344, 351, 378: n = A,T,C or G
aattcggcacgagtgtttcccctgatagcctctgagtttcttccggataacactgcatcaacaatgctactgagcaccaactgagggcaggatgcagaatgctggatggtgtaggaaatataacagttaagaccagggctgggattataggcgtaagccactgcacctggcccaaaatgttattttaaattcttcacaattacattttttcatttaagggagggcaatttaaagagcaaatcatttgaaagcttggatgctncanangcgtattctgntcattttatggnccattatgagaaccaganagcttatcagcctagtttgtaagcangtttatgagnctggggnttttaagctcttcaaaaaatgtttagnggatggtaaatcccttaagaaa

SEQ ID NO: 9268 - DNA, 420 bp, Homo sapiens
aattcggcacgaggtgcctctagggggtgcataaatgcatatatatgtgcacatacacacgtgcatgcatactcatgcgtacatatacacagccccccaccttgccttttacagagccatgaagcagcagatgcaaccgaatactgtgcagcatgagccacagacgtttacgggaagaaccggcaggaggcgccgggaaactaaagggctccagctctctgagtggtggctttgccattgtggctgtgcgagctcagcctcctggaaacccgccctgagcttggttaacaagcattcactccaggtttaacccagctccaggttatcgcaggcaggactcccgagaacaggttcatgtttgctttttgggaagtgctgcgctaaaatggaaaacaccctgggccgagtgggacctcccag

SEQ ID NO: 9269 - DNA, 413 bp, Homo sapiens
  misc_feature 385, 399, 408: n = A,T,C or G
tatacgctgcgctttcgggtcccgcgcccatcagatggtctccaaggcaaagaagcgcgtgctgctgcccacccgcccagcgccccccacggtggagcaaatcctggaggatgtgcggggtgctgccggcagaggatccagtgttcaccatcctggccccggaaggtagggggagcccggtcccggtgaaaagcggacctgagaccccggcagcaaggggacgggagagaagcacacccctaactcctgaccccacgccctggtaacccccgcaacatgggcacggttcgtatcctctccgagtctccctctactcctccgtagagtgagaccgattttcagagggttcttctgacatgtgtggaagccgggcgctgtggttcangcctgtaagcccancacttttcngaagg

SEQ ID NO: 9270 - DNA, 434 bp, Homo sapiens
  misc_feature 407: n = A,T,C or G
gccgcgatcacaccactgcatgccagcctgggcgacagagtgagaccctgtctcagaaaagaaaaaaaaagtaaaaattgcatgtaagttgacccgcactattcaaatttgtggtgttcaaggttcaactgtaatttcctagcagcattttgtgtgtttgagaatctcttgacactcttcaagtaaatccctaaattacaactttgacatcaaaaaagctagacattcctacatttttgcactacaatacataaaaactcccatgctgatcggttgtgggatcgtgcctgtgaataaccactgcactccagcctgggcaacatagtaagtaagaccttgtctcttaaaaaaaatacattctgaagaaagttctacttatgaatacattttatttataacaaactggngaaaattttagaccaaaccatgtcttt

SEQ ID NO: 9271 - DNA, 413 bp, Homo sapiens
aattcggcacgagagcacaggtacatcagctgctaacgcctgcaagtgccatctcaaacaaagaggcaagcagtggctctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaaggagaagggaagggtgtgtagcctttttactctttctcctttgtttctactagtaaaaatctttagaaagcaactgcaaacatttatttaacctctgctgtgtgccaggtactgtgcttggtgctggggattcaaa

SEQ ID NO: 9272 - DNA, 423 bp, Homo sapiens
  misc_feature 376, 413: n = A,T,C or G
aattcggcacgaggagcattgtaatgaagtgtggttctgtaaattctctaatgatggcactaaactagcaacaggatcaaaagatacaacagttatcatatggcaagttgatccggtatgtaccccaatatgagtgtttatattacaaaaggggataattttgaatctaattcattgattacatatttttaagtatatatgtatcaatagtattcttttctaagagcattttttatcatttttacatcttcatgtgttgtatagataatatatgtaagttaatattatcaacattgttgagtgtttatgtgctaacaataatgttaaatctgtgtatgcattatctaatttaatattctgaaaaactctgtgaggngctaacatctcctgcagtcagatgaagaaactgaggnagaaattaaa

SEQ ID NO: 9273 - DNA, 398 bp, Homo sapiens
agtttgtataaggcttagcacttccttgatttcatgcgtccactagggatctgggaaagtattcctcttgcataaggggagactactgtatgctgcttcccaaattctgctgtatgggcttcccaaaattcaagctgtgtctcaagtcagtgaaaatcccaggctctgattagtctcttgctccttgggttgcagtctgggaattccctttaagcagtaaccctggccatggtaggactcacctcccattgtagcctcccaggtggctgtgattacaggcgtgagccactgcactcagcaggaaagcattgcattttgtacaatgctttactagtaagaagtaatcagtaagtgataaggtattgtaacctgtggtctggactcacctgacagggtga

SEQ ID NO: 9274 - DNA, 425 bp, Homo sapiens
tgcccagctaattaaaaaaaaaatttttttgtagcagttcggtctcattagtattgcccaggctggcctctcttagcttcaagctatcctcccgcctcggcctcccaaagtgctggaattacaggcataagccacaagccactgggcccagcctcttttacctgtttcaaaattgagttttattgagttgtaagagttctttattcattttaaacacaagtcctttgttggatatatcttttacatctatttttcccagtctgtggcttgccttttcattttgaagagcaaaagtttaaaattttgtgaatttattaaagctccgtttgttgcttttttctgttctagtttatacttttgtatcatattttaggaaattttgcactgggtatttgatggctcctgaggaggttcaactttcagag

SEQ ID NO: 9275 - DNA, 386 bp, Homo sapiens
  misc_feature 302, 357: n = A,T,C or G
aattcggcacgagagttcctgccgctaagatttccaggtttattgtttctagctggtaatccccagggggccccaaatcctgaaatgctttggcccctgggattgcacaaccccccaaatggaaaggcagccaggaagacatgtctgggcaggctaagaaccctctatccggagggagagggcaaatgggggcggacaccaatctcaccacttttgtctccttagtcaccatccaggggagactccacctctcatcaccccaggtaagatggggcaacatggggctcaggggaacacggaantggtgtgtgtgtgtgtgtgtgtatgtgtgtttgcacactggaaagaaaagaactnaattcaccctccaaacggccccatcacct

SEQ ID NO: 9276 - DNA, 411 bp, Homo sapiens
  misc_feature 173, 174, 179, 180, 190, 208, 220, 222, 227, 229, 231, 232,234, 237, 240, 241, 244, 248, 260, 261, 262, 268, 271, 276,279, 285, 294, 304, 309, 314, 316, 320, 322, 325, 339, 345,347, 349, 352, 356, 361, 363, 366, 372, 381: n = A,T,C or G
ataaattagctgacgtggtgggcacacctgtaatcctagctactcaggaagttgaggcgggggcatcacttcaacccaggagttcactgctttagtgagctatgaccataccactgtactccagcctgggtgacagagcaagacctcatctctctctctcttttttttttttnnaaacnnagtttccccntgtcccccaggttaaagngcagggacccantntaagntnanngnaantcnngcntaancctctttaaaannnggaatnacnggggnggncccccnccccgggcnaattttttanttttnataangngggnanggngggctaaaaggccngacctngnanttngccngcctngnccncccaangggccgggnttaaaggcaggagccccgcccctaccaaaa

SEQ ID NO: 9277 - DNA, 471 bp, Homo sapiens
  misc_feature 8, 9, 28, 32, 44, 45, 48: n = A,T,C or G
actccttnnacaagccacttgctctctntgcnggatcccatcgnntcnaattcggcacgaggtgacatgctgtattggctactccataaagtaggagtatagatggaatggagaaagaagcaacctctgagattccagtggtgtgtgggggcaagatctgatggaaactgacaaagagaacgaagactacacaaagagaaaggaaagagaagaaaccctaaatgggcaaaggaaagcacatcctgtttgcggagctttgaaatattggaaccatttctaattgctcctgtttttctgggtaacaccagttttctgtagttgccactaaagcagtagactcttgagtctcacttgtctctgagagagacagaagttagaaagttttgacttggcgattccgaaagtatgcctttgttggcacttaaatgtccagtgagacttcttggcaccttagagccctctgagatctgg

SEQ ID NO: 9278 - DNA, 418 bp, Homo sapiens
aattcggcacgaggctctttctacccagattacctcatttaattatcatagcaaccatatgaggtgcaggtcattactattttcctcattctataattgaggtaactgaggcacagagagatttaaaaacttgttccaaatcacacagctagaaagttaggtaaaccaggatagtttgattctagagcttaacttcctagctaagacatgtgaagtcaagtttctatgcatcttttgaggggtgttgtatttattttcaggtctcctacttgatctcactgtatgcattacagaaatttcttgtttatttatttgtttattttgagatagggtctcactctgttgcccaggctggagtgcagaggctcgatctcttagctcattgcaacttccaccttctgggctgaaatgatcctcc

SEQ ID NO: 9279 - DNA, 399 bp, Homo sapiens
ccatggggaattggttccaggatcctccactgatggtaaaatctgaggatgctcaagtcccttgtataaaatggcatagtatgtatttgcatattacctactcacatcttcctgtatactttaaattatctttagatcacttatacctaacacaatgtaaatactatgtaaatagttgttatactgtatttttcaatttgcattatttttattgtattttatttttattgttttttttttgagtattttctatttgagattggtggaatctgcacatatgagggctggctataaagggcaccacaaggaagaagccaaacagacccagaatgtgtgaaattctacagagcaaattacctgatttcttcaactaacaggtagcatgaaaatcaaggggaa

SEQ ID NO: 9280 - DNA, 409 bp, Homo sapiens
aattcggcacgagacgacatctttaagaactgtaacactcaccgcagagtccacggcttcattcttgaagtcagtgagaccaagaacccactggaaggaaccaattgcggacacaaaagcagaagtaagcactccatttcaaccacatgtggctttctcttcctactgcaatttaagctaaaatatgttgaagctgctttacctcattttttatattcagcgaactttgtcggcatagttcataccctagcttcctgaaggcctagttattgcctatctttgctttgatgttgccattttcaaatcttctcatcacaccaatttcaattttctgcattaccacttttcatttctttgctgcctttcagatttggtggaaacttttatatgaatttatcactggggacga

SEQ ID NO: 9281 - DNA, 394 bp, Homo sapiens
ttttggtgctaggctttgggacgagattctggggcgtagatcttgggatcctccttctatagcctgtttttcaatggggatgtttgtcttttccttaatgatctataaaaggtgttcatatattagtacaaacaatttcacccacactttattacgcttttggggagaaagggcaagaaagtgttgtcagccccatttattgactaatccattctttccccacttatttgagatgccagctttatcatatactaaagtattttatatgtatggatatgtttggggatttttgaatttagttctgtttcaggaatcttttggttccagttctagccactgcactccagcctaggtgacagagtgagaccccatctcaaaaagaagagagagagaa

SEQ ID NO: 9282 - DNA, 416 bp, Homo sapiens
  misc_feature 325, 349: n = A,T,C or G
ccctcatgtgacagaacataataagtagtgtatgtaggtcattgggctgcagtgttccatgcagtcattcagagacccaggctgacaggggctctgccgtctttaacatgtgactttctaggtcagtcatctggtcattgcttttccacacagcagataagacaaaggagtggaaatagaggggtagagattttctcttaaacgtgtgaggctggagtggtatgcttcattggcaagaacctggtcctagcctgcctagctgaaaggaggggagtcagggagatgcactttgcagccaaaattctgttgccaagaaggggaaagnagatttgggtggattttgatctgnggttgctgctgtgtactctataattcaccatgtctctggagggttaactatgttgtaccaattgatc

SEQ ID NO: 9283 - DNA, 410 bp, Homo sapiens
gtaaaatttgcctatataatttcttgtatacacctattttcggtatcaaggctatactagcaatgttttctttttttgctctgtggaaacaaattgcacctgttgagggtttggtgaacttgacaccaaaaccatcttatctttctatgttttcatggggaaattttgtactagttttttaataattataagtcttacatgttctctaattcttcttgaatctgtttaatttttctcccttgggaattgttaagtgtacatgtattgtgataactgctataattttgcttttattgattttttttgctttatatctgctacaatttggttcctccaaatcccatgttgaaatctgatccccagtgttgctgggggatctaataacaggtgtttgggtcatgggaacaggc

SEQ ID NO: 9284 - DNA, 419 bp, Homo sapiens
aattcggcacgagagaagccagatgcaagggaataaatactgtttgatcctgtttatgtgaaattttataatgtgaaaggcaaaactaacctatgctgatggagtaagtggttgcctacaggggtgaggcttgattggaaaggtgctctagggaaatttccaggatgatacccccctttttttttcccaagacagggtctcactctgtcacccaggctggagtgtagtggtacaatcctggctcactacagcctcgacccaggttcaagcaatcctctcatctcaacctcctgggtacctgggactacaggtacaagccccacacctggctaatctttttatgaaaatttttttgtagagatgaaatctcactatattgccagctggcacaaactcctgggctcaagtgatcctcctgc

SEQ ID NO: 9285 - DNA, 411 bp, Homo sapiens
  misc_feature 96, 107, 112, 116, 125, 132, 134, 136, 137, 148, 170, 174,177, 180, 184, 214, 220, 232, 248, 265, 278, 296, 302, 319,324, 326, 331, 345, 347, 351, 372, 390, 402, 406: n = A,T,C or G
aattcggcacgaggcggaaactgcatcctggcagcgtctgggactcctctctgccaggatgacccatgacgctatgacaagagtacttttcctggnagggggccttncatcntgtnggctccccnttaatgncngnntgatctttaantgaacatggtcttgccatcacntaantgnctncacntgcccttcaggcagatgggatcattaaagnaccctnaacattgcctgngcttggtaacctggancctgaacgggaacgcgnaatcaccattgcnatttcttgtgaaatttcntaccancaggactatgtgctatnatttntncccangaccagaaactttntnaaancatgatacagggacatcttangctgctggcctgcctaangttcttgctggngttngtgaa

SEQ ID NO: 9286 - DNA, 418 bp, Homo sapiens
cggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccacagcaatgatgc

SEQ ID NO: 9287 - DNA, 419 bp, Homo sapiens
aattcggcacgagcaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattcttttggac

SEQ ID NO: 9288 - DNA, 391 bp, Homo sapiens
aattcggcacgaggtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagacc

SEQ ID NO: 9289 - DNA, 420 bp, Homo sapiens
  misc_feature 50, 55, 58, 63, 65, 66, 67, 69, 71, 72, 77, 80, 83, 86, 87,92, 93, 94, 96, 103, 106, 111, 112, 122, 134, 136, 140,144, 145, 146, 147, 152, 167, 170, 177, 184, 187, 192, 198,218, 237, 244, 245, 255, 256, 273, 275, 289, 290, 297: n = A,T,C or G
  misc_feature 300, 304, 312, 316, 325, 332, 337, 338, 340, 341, 342, 352,353, 374, 382, 384, 385, 388, 392, 400, 403, 405, 407, 408: n = A,T,C or G
aattcggcacgagcctagtcttaaactttttttttttttaactttttaancggangtnaaaancnnnancnnagacntantangcnngggcnnncncggggtnaanaaaanngggtttaccntggccaccttcncngttngttnnnntgganggttttcaggagcanaancaccctnggagccntcntttcntgtganggcagggcctgtttttaaanacctcctgaaggatctggntgaggcnnttttaaagtnnacttttttaaaaaaaantnaaagaagggggacnntcaaatnctngatnaaaaactngttnccggccggncgctggnctcanncnnntaatcccagnnttttggaaggcccaggcaggngtatcgcntnnggncagnattctaanacnancnnggccccaatggg

SEQ ID NO: 9290 - DNA, 411 bp, Homo sapiens
aattcggcacgaggccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgagatcttaacctatgaggaaatgtcactttatc

SEQ ID NO: 9291 - DNA, 403 bp, Homo sapiens
gagagacttcttcctgcatccttacatggtggaagacaaaagagtggcagagaatgaatatactcccagtccattcgagagggaagagccctcacctcatcacttccctgaggcctcaccttctaatactatcaccttggtgataagatttcaacataggaattagaggggaatacatacatccagactattgcagatgggattatgtaatactttgttcctgtttggcttatttcttagcacaatatctttctggtatgtgcatgtttctgcaaatggcaagattttcttcctttttaaggctgagtaataattcattgcatgtatagaccacattttctttatgcattcattattagtgagagttcttattacaaatgggcgaagtggtttttaatattga

SEQ ID NO: 9292 - DNA, 408 bp, Homo sapiens
tttagtaataagactttcagtatttttaatgttgacatttccagatgtttcatttagtatccaggggtctgtctggagacttctagagagggacagctcagaagtgagacccttgagctctggtgctgtaagcttgtgcaattaagttgaacagagcctgggaatttctttcctctgcacagtcccttgatatttggaatccaggttctgcccccaacccctacccacccagtggtctgttaagatgtctcagatggggctgggcttggtggctcatgcctgtactctcaacactttgggaagcaaaggcaggcagatcacaaggtcaggagttcagcctaaccaacatggtgaaaccgtgtctctactaaaaatacaaaaattagccaggcgtggtggtgcacacct

SEQ ID NO: 9293 - DNA, 427 bp, Homo sapiens
gaaaaacatcacagactttgaattctatagccagagaaaatatccttcaaaaatgaaggtaatgtgaagatttccagtcatacagaaaacttgaaagaaccccgcccccttagacctacccaacaagaaatgtgaagggaagttcttcgggtggaaagacaggccaggtgaagataagaatccacataaaagaatgaagatccggaaatggggatctaagtgaccctggcacaaactaacaatatcttttaagatgaacaaaaaagactactcatctgagactcaggccatggacactcaagtgagtgacctataacacttcacagaacatacaatcagacatcaggaactggtcatgtaggcttttttatagttctaaactaaatactacatagaactttgtgactgcctgttattagctttagaa

SEQ ID NO: 9294 - DNA, 417 bp, Homo sapiens
  misc_feature 338, 348, 390, 392, 400: n = A,T,C or G
aattcggcacgagtgacaacttattccctgctattatcaactaaagatcaccctttctactgctgtctctggagcaggagctggcaaactatggcctgctgtctgtttttgtacagttttactgaaacacagccatgcccatttgcgtaattgccccatatggttgctttcatgccctcacagcaaaggcgagtagttgtgatggatcaaatggcccacaaagcctgaaatatttactctttgaccctttacagaaaaaaaccttgttgacccctgctttagagaatgagaagccatgcagggatcagtgatgccagaggaagggaaggaactgcttncagctattgngacaataataataataataatattgggctttgactagaacgngnaacatttncagggggtctcacttgt

SEQ ID NO: 9295 - DNA, 393 bp, Homo sapiens
ggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttc

SEQ ID NO: 9296 - DNA, 392 bp, Homo sapiens
ggtacttccaagtacatataaaacaattagccaatctgatgggtgagagagactgcaatacaataatagaggactttgtcactccactcttagtaatggacagattatccaggcagcaaatcaacaaagagacatcagaattaaactacacagtagatacggaaatccttgaaaaaaatactagcaagctgaattcaacaacatattaaaaagatcagccaccacgatcaagtagattactcctgaggaggcaaggatggttcgatatacacaaataaagaaatgtgatacatcacattaacataaccaagaacaaaagccatatggttggccaggtgcagtggctcatgcctgtaatcccaacactttgggaggccgaggcgggtggatca

SEQ ID NO: 9297 - DNA, 378 bp, Homo sapiens
  misc_feature 218, 219, 228, 229, 231, 233, 237, 240, 241, 248, 253, 259,261, 266, 267, 268, 272, 278, 280, 282, 287, 293, 295, 300,317, 321, 325, 328, 331, 334, 335, 337, 342, 345, 346, 349,352, 356, 358, 365, 366, 371, 374: n = A,T,C or G
gagactagtctggccaacatggtgaaaccccatcgctactaaaaatataaaaaattagctgggcatggtggcgcacgcctgtagttccagctactcaggaggctgaggcaggagaatcgcttgaacccgggaggtggaggttgcagtgagctgagatcgcaccattgcactccagcctgggcaacaagagcgaaactctgtctcaaaaaaaaaaaaannggggggggnntnanttgnggnnagggttngaaancacccngnccaannngggnaacccntntntttantaaaantntaaanttacccaggcttggtancccncccntgnaanccnntnttttnggnnggntgnggcngnaaaatcnntaaanccngggg

SEQ ID NO: 9298 - DNA, 418 bp, Homo sapiens
  misc_feature 188, 190, 192, 193, 194, 195, 197, 198, 200, 210, 213, 215,221, 224, 229, 234, 236, 241, 247, 253, 254, 267, 268, 269,272, 273, 281, 282, 283, 286, 289, 299, 301, 303, 306, 311,313, 323, 329, 335, 343, 345, 357, 362, 363, 365, 369: n = A,T,C or G
  misc_feature 373, 375, 387, 389, 391, 395, 397, 399, 400, 401, 402, 403,404, 407, 408: n = A,T,C or G
caacaacgagtggacgctggacaagctccggcagcggttcaccaagaacgcgcaggacaagctggagctgcacctgttcatgctcagtggcatccctgacactgtgtttgacctggtggagctggaggtcctcaagctggagctgatccccgacgtgaccatcccgcccattattgtcattgtcccananannnnanntnagaggcttantantnaagctnctngaatntaacncncccanatctcntcatgnntttgatcctgttnnngannagtatatnnnttntcnctaatacggncncnccntgatntntaactattcnctacanttttgnagatgagncngactatctaccntgaannangaanaatncncggatcatcttncntntctngntnnnnnnacnnaatacctcaa

SEQ ID NO: 9299 - DNA, 403 bp, Homo sapiens
  misc_feature 396: n = A,T,C or G
aattcggcacgagaagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagttgtttgtttgttgttgtacctgcttgttccaggaaggatttaatgnggttatt

SEQ ID NO: 9300 - DNA, 409 bp, Homo sapiens
aattcggcacgaggaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcatagaacctcaggctcttaatgatgtagatggtgaagaagaaggaactgttaatagccagtcaggagaaagtgagaatgagaatgagttggataactctctaaactctcagtctaacacgaat

SEQ ID NO: 9301 - DNA, 397 bp, Homo sapiens
ctcgcacgaaagccgccgtggcgcaatgaaggtgaatgccggcgcgctcgccggccgaggtgggacagattcataacacagtgttctttgtggcagtgaaaaacttaattttcaaccttctgatggagtgttggtgttaaacctataatgaagtgtttcgtaattgaaaattttccagttatatcagaaagcttagttttcttttttcttcttggtgaagtgttttgcaggatctgtagcttttgggtttgcatattagcgtattttatacattttgtttggccaggagaattttgtcatgtgggttttacctgatgattttgtagatctaaatgtgacaacatcgatcttagctgtttcttctttggctcatttttcccactcagtggttattata

SEQ ID NO: 9302 - DNA, 411 bp, Homo sapiens
  misc_feature 404: n = A,T,C or G
cacccagctatttttattttttggatggggtctcactatgttgccctgggtggtcttgaactcctgagctcaaggaatcttcccaccacggcctcccaaagtgctgggattacagccctgagcctggcctcactgtggtctgttttgagaagcctttgtttttaaacagaaccacatgttggtatttcagagccaactcttctgtcaagaatccaaatcagccaggcacggtggcatgcctgtgtagtcccagcaattccagaggctgagacagaaggatcatatgagcccaggagtttgagatcagactgggcaacatagtgagactccatttctttagaacaatactaatcacatgagggtggtaggccattgcctgggctggacaggtgagtagagggcangtgtgca

SEQ ID NO: 9303 - DNA, 402 bp, Homo sapiens
  misc_feature 208, 215, 237, 243, 246, 248, 250, 264, 268, 283, 296, 303,313, 323, 333, 340, 344, 349, 352, 353, 363, 382, 392, 395: n = A,T,C or G
aattcggcacgagcctatctcaaaaaaagaaaaaaaaaaacggcaaatgatctgggtatttctcaaaagaagacacacaaatggccaacaaatacattaaaaaatgctcaacctcactaatcatcagggaaattcacatcaaaatggcaatgaggtatcatctcaccccagttgggatggctattatctaaaagataaaaaaaaaaancaattgntggcaaaaatgcaaaaaagggngaactnttntncnctgttaggggggangtancctagtcaatccctntagaaaacagganggaagcncctcaaaaanctccaaatanaactaccttntgatccnccangcccnctnntgggaatttnttcaaaggaaaggaaattnctttgaaaanacntctgccc

SEQ ID NO: 9304 - DNA, 400 bp, Homo sapiens
ctcgcacgaaagccgccgtggcgcaatgaaggtgaaggccggcgcgctcgccggccgaggtgggacagattcataacacagtgttctttgtggcagtgaaaaacttaattttcaaccttctgatggagtgttggtgttaaacctataatgaagtgtttcgtaattgaaaattttccagttatatcagaaagcttagttttcttttttcttcttggtgaagtgttttgcaggatctgtagcttttgggtttgcatattagcgtattttatacattttgtttggccaggagaattttgtcatgtgggttttacctgatgattttgtagatctaaatgtgacaacatcgatcttagctgtttcttctttggctcatttttcccactcagtgggtattataaca

SEQ ID NO: 9305 - DNA, 411 bp, Homo sapiens
ctgaagcggcgcatacggaaaggacgcatggaatacctcgtgaaatggaagggatggtcgcagaagtacagcacatgggaaccggaggaaaacatcctggatgctcgcttgctcgcagcctttgaggaaagggaaagagagatggagctctatggccccaaaaagcgtggacccaagcccaaaaccttcctcctcaaagcgcaggccaaggcaaaggccaaaacttacgagtttcgaagtgactcagccaggggcatccggatcccctaccctggccgctcgccccaggacctggcctccacttcccgggcccgggagggccttcgaaacatgggtttgtccccgccagcgagcagcaccagcaccagcagcacctgccgcgcagaggcccctcgggaccggaccgagaat

SEQ ID NO: 9306 - DNA, 413 bp, Homo sapiens
gagacaccatctccagattcccatccacttcctcaccgccgtgaacttggagcatccagagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggggatctactgtcctcccagtcacacccctctccccgcaccgccttcctgctgtcttctcttcttcccagaatgaagacatcaccgagccgcagagcatcctggcggctgcagagaaggctggtatgtctgcagaacaagcccagggacttctggaaaagatcgcaacgcccaaggtgaagaaccagctcaaggagaccactgagg

SEQ ID NO: 9307 - DNA, 422 bp, Homo sapiens
aagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccgtagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactg

SEQ ID NO: 9308 - DNA, 407 bp, Homo sapiens
aattcggcacgagctcagatttttaaatggtctctacaacaaattgtcacttgttgggttcaattaagtgctcattgtataagtgcacatggtacaaatcaacaccagcttataggattgtggaaagaattaagagatgaatttagtgatcttatataccctgtcagttggtcatattgtggaagagctctacaaaacttactgtactgttaactccaagattttcttccaataacagggatgctagccagatatttaataatcaaagaccaaaaatggcagtttaatttttctacccaatatcctatggcatatgaatgatccaaatttgaagctccaaggataggaaaaagcttacttgtgcctgtcctagacaagtctagagtttatattgaaatcaaaacttc

SEQ ID NO: 9309 - DNA, 405 bp, Homo sapiens
  misc_feature 317, 318, 321, 376, 395: n = A,T,C or G
aattcggcacgagggggcatggatgcaagaggattggagatgaggggccctgtccccagttcaagaggccctatgactggtggaattcagggtcctggtcccattaatataggggcaggtggccctcctcagggacccagacaggtcccaggcatttcaggggtggggaatcctggagctggtatgcagggtacaggcatacaaggaacaggcatgcaccggagcaggcatacaaggaggagggatgcagggggcaggcatacaaggagtcagtatacaaggaggaggtatacaaggaggaggtatacagggggcanncangcaaggtggaagccagcctagcagttttagtcctgggcagagccaggtcactccncaggatcaggagaaggcanctttgatcat

SEQ ID NO: 9310 - DNA, 396 bp, Homo sapiens
  misc_feature 331, 339, 348, 385: n = A,T,C or G
cggcggcagcttcccggggggccggttcgggtctccgtcccctggcggctaccctggctcctactccaggtcccccgcggggtcccagcagcaattcggctactccccagggcagcagcagacccacccccagggttctccaaggacatctacaccatttggatcagggcgtgttagagaaaaaagaatgtctaatgagttggaaaattatttcaagccttcaatgcttgaagatccttgggctggcctagaaccagtatctgtagtggatataagccaacaatacagcaatactcaaacattcacaggcaaaaaaggaagatacttttgntaacattntctgaaatncaactggaagcttcatgtgtcatgaacatcttggacnaaacttttaag

SEQ ID NO: 9311 - DNA, 409 bp, Homo sapiens
aattcggcacgagcttacatgaacaaggtagagctggagtctcgcctggaagggctgaccgacgagatcaacttcctcatgtaagcttcatccacatccttcttgatgaggacaaattcgttctccatctctgtacgcttattgatctcatcctcatacttgttcttgaagtcctccaccagcccctgcatgttgccaagctccgcctccagcttcagcttctcctggcccagagtctccagctgccgcctaaggttgttgatgtagctctcgaacatgttgtccatgttgcttcgagccgtcttctgctgctgcaggaggctccacttggtctccagcatcttgttctgctgctccaggaaccgtaccttgtctatgaaggaggcaaacttgttgttgagggtcttga

SEQ ID NO: 9312 - DNA, 397 bp, Homo sapiens
aattcggcacgaggcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtacta

SEQ ID NO: 9313 - DNA, 408 bp, Homo sapiens
  misc_feature 391: n = A,T,C or G
aattcggcacgaggcgagggcctggacgtagtgtcttcaacagttgtaacagcagctgccatttgctgaatgacagcatgtgtcacacactctgctgagtattacaggcatttttttctaatacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgngggcggaccttcacgat

SEQ ID NO: 9314 - DNA, 429 bp, Homo sapiens
caattcggcacgagggtgagcgagtgctgtgctttcatgggcctcttctttatgaagcaaagtgtgtaaaggttgccataaaggacaaacaagtgaaatacttcatacattacagtggttggaataaaaatgctgtgaggcccaggcgctctgaaaaatctttgaagacacatgaggatattgtagccctttttcctgttcctgaaggagctccctcagtacaccaccccctcctgacctctagttgggatgaatgggttccggagagcagagtactcaaatacgtggacaccaatttgcagaaacagcgagaacttcaaaaagccaatcaggagcagtatgcagaggggaagatgagaggggctgcccaggaaagaagacatctggtctgcaacagaaaaatggtgaagtgaaaacgaaaaagaacaa

SEQ ID NO: 9315 - DNA, 405 bp, Homo sapiens
aattcggcacgaggaactatctagtagctggttccctccgaagtttccctcaggatagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttc

SEQ ID NO: 9316 - DNA, 426 bp, Homo sapiens
  misc_feature 103, 104, 108, 113, 119, 125, 130, 143, 145, 148, 162, 163,167, 169, 173, 188, 193, 194, 195, 198, 207, 212, 213, 216,218, 220, 223, 225, 232, 233, 235, 238, 240, 241, 242, 243,244, 245, 249, 251, 252, 257, 259, 262, 265, 267, 268: n = A,T,C or G
  misc_feature 271, 272, 276, 277, 280, 281, 286, 288, 293, 305, 309, 314,317, 320, 322, 323, 328, 338, 347, 352, 365, 369, 371, 377,378, 382, 390, 394, 418: n = A,T,C or G
aattcggcacgaggagtcgtcggggtttcctgcttcaacagtgcttggacggaacccggcgctcgttccccaccccggccggccgcccatttgcagccttgtnncaanattgncccaanctctcnaaaanaaaaaaaaaaccntnaantttttttttttccnnggangnaaanttttttaaaaaaaanatttnnntcntaccaaaantaaannggnantnaantngtttttnngnaangnnnnnnaaananngcctntnggnttnannaannaccnnttnnttaangnctttnttttaaaagggngganctttnaanttncnnaaaanggaaaatggnttttttttnaaaantgggggttttttntttnanctaggnnaaantttgtaanggcnttggtttttttaaaaattctgganaatttttt

SEQ ID NO: 9317 - DNA, 421 bp, Homo sapiens
aattcggcacgaggtggagtgacggtcacaccgcggcgaattaattcccaaagactcatgttacatgagaaagccaccaagaagaccaaagaaaaggagacaaggatggctcttcctcagggatgcttgactttcaaggatgtggctatagaattctctttggaggagtggaaatgcctgaaccctgcacagagggctttatacagggccgtgatgttggagaactacaggaacctggagtctgtggatgaagtcttgctcttttgtccaggctggggtgcagtggcgtgatctcggctcacggcaacctccacctcccaggattgacttctaaggactcttggtacatgaggaagaaacccggaaggggaagaggaaagcaaaggcgtcaggaatggttcttctcagatggggcctcgct

SEQ ID NO: 9318 - DNA, 401 bp, Homo sapiens
  misc_feature 167, 175, 185, 229, 233, 240, 246, 247, 248, 264, 272, 274,279, 280, 281, 289, 296, 313, 314, 315, 324, 327, 330, 331,332, 333, 335, 338, 339, 349, 366, 368, 375, 380, 381, 384,386, 388, 389, 390, 395, 396, 397: n = A,T,C or G
aattcggcacgaggttgtgttcatgtaggacccaagggtgactgtaaacatgataggagcgctgggacattgtcactgaggcagacagcagccactagtccacaatggtttaaaaagtcagtcctgtcatgtttacagtcacccttgggtcctaaattaacagttgngttcatgnaggttcgtgncgtcgttggctctgagacattgataataaatttttctcaacagngaanaaaaaanataaannntaaaaaaaaaaaaatncccgcccntnaaaannntagggggnctttttncgaaaaccccccctttnnnaaaacctcnggnggnnnngnccnncccccccctnaatgccgggaaaaaaancnttttttnaaaanntcngngnnnctttnnntttt

SEQ ID NO: 9319 - DNA, 402 bp, Homo sapiens
  misc_feature 368, 390: n = A,T,C or G
ccaagacagtgcactagatgatgaaagattggcatcaaaactgcaagagcacagagctaaaggagtgtcgattccattgatgcatgaagcaatgcagaagtggtattacaaagatcctcagggagaaattcaaggcaagttgttcctttttcctttaaatactgaagtgtgtgccattacctccagaatctctaagaagggatttgtttaatttaaattatagtagaaaaagaagtcaacaagcacacacgcgcgcacacacgcagactagaagtgtttctgatttcagatgtttttagatttcttcccaattttggaataattgcattgtcataccagttgagcatccctaatctgaaaatccaaantccataatgctctattgaatgnttcctttgtgtg

SEQ ID NO: 9320 - DNA, 405 bp, Homo sapiens
aattccgttgctgtcggtttcattatataaaaggaacatcttcccatagcatattctatgaaaggggtttcattccaagttgagttttcaaaaaaaaggtcttcctaaagctaccattttcaaccgtccttgttatctagtacaacataaataacagtcttaaaaattgcactaataccagtgcccccctggctctccaaatctgttctttgctcttgtatctgctggacgcttgaagacaggtgcactgtctcgtatgtatttgaattatgaacagtaatttctaatgaattctaaaatggtcattgtaagtgaaagcctctcgctaccacttcctcttccaactacataaatatatttcaatgtatttccagttttgggaaagttttcaatacatacatcaag

SEQ ID NO: 9321 - DNA, 418 bp, Homo sapiens
aattcggcacgagagcatacacatgcatgcatgcatgagtgtatacacacagtaatgcatactagttaaacactcacatcattttaattattacttttggctaggatttattgaagcataatttactaaagcttctccagaagccactaactccaaaagacagaatcacaatacagggcatatgctgagggcctctgggttgggccaagaatttcagactgggcgccatgaccaagggcaatctgcagtcactcaagagtacttggaagattgatttagcagtggtgcttggaacagactgggccaggaagggctataagcagggagagtcatttaaaagttatagtattgatttaggatcagggtgaaaaggaactgaagtggagcaaggtgagacaggaaggaatggaggactctg

SEQ ID NO: 9322 - DNA, 409 bp, Homo sapiens
gcggcgccgcctcctgctcctcccgctgctgctgccgctgccgccctgagtcactgcctgcgcagctccggccgcctggctccccatactagtcgccgatatttggagttcttacaacatggcagacattgacaacctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagat

SEQ ID NO: 9323 - DNA, 410 bp, Homo sapiens
aattcggcacgagacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaaca

SEQ ID NO: 9324 - DNA, 425 bp, Homo sapiens
aattcggcacgagagtcaatccaaatgatttcagagacctgactttgctgtttgaccactctcagctttttggtatcagactcccttcactggctcccaaaaactccagggccatgtttctggaacagtggaaagcagggaaatagaaatggggcctcaggaattagaaataaggctttggcattcaaatgtcgcacctagcatgctgtgactagcgataagtgtgcaaggagtgttgaagcagtaggaagacttgtggtgaggcggggcaggggatgggggtgagggacctgcagagagaccagggccttcctgaagggctctgcccttcccggctggcaggggccacctggggctaccaacaggatactgtgcttctccagtaggtcccaccccctccaggacagagaccctggtggaggaga

SEQ ID NO: 9325 - DNA, 412 bp, Homo sapiens
  misc_feature 243, 247, 255, 258, 264, 268, 273, 299, 302, 310, 311, 321,328, 329, 339, 340, 348, 349, 350, 360, 365, 366, 371, 403,407: n = A,T,C or G
gaacaggtggtgttcaccaatcccttctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggagctgcaaggccgcctgcccgccgtggcccattcgaggcatcaccgacaaattccncacnagtgactnatnacctgngtgncatcnactatgcgggagacactttcttcganaangacacaanntccatccttntaaaaanngacggaatgnngaatatannnatatcgcaanctccnnatcanctggttggaatgaaaaggcttacaatgaaagnttgntggcc

SEQ ID NO: 9326 - DNA, 488 bp, Homo sapiens
  misc_feature 18, 21, 36, 39, 42, 45, 49, 51, 479: n = A,T,C or G
ccctatacaagctcttgnttntggagctccatccantanctnccngttngngaggctatatcctttcacacccatcaggcactgtgaagtaagcaggaagacaacctgaggttgtctctttactttgagttcctacataataaattgcagcctaatttagtacataaacccaaacctaatttaggagtaaattttttgtagcagatagccagatttcagccaatcacaggcttccagctaacaagactatgcccaaataaggcaaatgcctcatcacatgatgctcaaataaggcagccacctaggcgaggccaatcaggtaacttttctactttgcttaattgtcagcctgacaaatttgctgcttatgactgctgagcagagctgctaaacctcttctggtttggagtgctgccttatatatgaattggtctttggtcacataaaattgggtaaatttaacttctctaaaggtttgnattaaattg

SEQ ID NO: 9327 - DNA, 413 bp, Homo sapiens
aattcggcacgaggaacaaagacacaacataccagaatctcttggacacattaaaagcagtgtgtagagggaaatttatagcactgaatgcccacaagagaaagcaggaaagatccaaaattgacactctaacatcacaattaaaggaactagagaagcaagagcaaacacattcaaaagctagcagaaggcaagaaataactaagatcggagcgaacagaaggatcctctagaagagcctaaagcaaagaagcacaaaaaatcaaagaagaaaaagaaatccaaagacaaacaccgagaccgcgactccaggcatcagcaggactcagacctctcagcagcgtgctctgacgctgacctccacagacacaaaaaaaagaagaagaaaaagaagagacattccagaaaatcag

SEQ ID NO: 9328 - DNA, 420 bp, Homo sapiens
gccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttac

SEQ ID NO: 9329 - DNA, 414 bp, Homo sapiens
  misc_feature 330, 366, 372, 379, 380: n = A,T,C or G
cgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagancctagcaataacttcatgcctgtggcaggcccattngcgcanctctctnncctcgagcagacccttccaccaggattgaaactg

SEQ ID NO: 9330 - DNA, 430 bp, Homo sapiens
  misc_feature 386: n = A,T,C or G
aattcggcacgagaagacgatcagataccgtcgtagttccgaccataaacgatgccgaccggcgatgcggcggcgttattcccatgacccgccgggcagcttccgggaaaccaaagtgctgggattataggcgtgagccgccacacccggcctcaaataactatgttttattcacttttagtatagtaggctctggaatggaatgtatctttgccactcctagactgttgcccctgaagtgttctaacatacattcgtaatcatgcaaccaccacctccaccatccgcatcagaactctttcattagctctctgttgcctaccactccaaaccatagcagttgggcacctgcaccttctgaatggcagcctttttgtttatcctgntgcccttcctaacatgtactttgctccttttctcctggcagaaa

SEQ ID NO: 9331 - DNA, 411 bp, Homo sapiens
  misc_feature 396: n = A,T,C or G
aattcggcacgagggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgcacaagagacattaaagtatattatataatgaaaaaagcatcaatccccatgaagatataacaattattaatatatgcnctcatatcagagccc

SEQ ID NO: 9332 - DNA, 410 bp, Homo sapiens
  misc_feature 329, 333, 336, 340, 351, 372: n = A,T,C or G
tccagatgtaccttgaatactgttgagagctagtcagatgaatgagactggcctgccacctagcatctgcacatgaggtattcttctacactgatttttcatacaggtgtgctagattttaatgggtcacttaaattcagttagtctccaacatataaattctccacaacataggatatagtatacactctacttgacccaagatgataaaactgaaaaagacaaaaaaaaattttattgccataaattaatccagtaggtatatttgagaaagcacgcatcagttggttagggcaataagcgcctctaccacgttgccatgtgggccnttgnacngggntctgctgctgntcgagatatctccatctcaancatctgcagaaaaaaatcatggtacatagggtccaggc

SEQ ID NO: 9333 - DNA, 432 bp, Homo sapiens
atcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgcta

SEQ ID NO: 9334 - DNA, 386 bp, Homo sapiens
  misc_feature 155, 157, 160, 170, 179, 181, 185, 188, 195, 199, 200, 202,206, 211, 212, 214, 216, 218, 219, 220, 225, 228, 235, 238,239, 245, 248, 259, 265, 268, 271, 277, 280, 286, 288, 290,294, 297, 301, 304, 307, 311, 313, 317, 318, 321, 327: n = A,T,C or G
  misc_feature 329, 332, 335, 340, 343, 347, 352, 358, 363, 365, 371: n = A,T,C or G
aattcggcacgaggctgctccagctgaggagaagaaagtggaagcaaagaaagaagaatccgaggagtctgatgatgacatgggctttggtctttttgactaaacctcttttattgaacatgttataaaagaggtttagtcaaaaaaaaaaaaancncgnccctttaaanctatagggngncgtnttncgtaaanccanncntganaaaanncntngnnnagttnggncaacccncanntaaaangcngggaaaaaaangctttnttnggnaaattnggnaggctntngntttnttngaanccnttntaancngcannaancaagtnancancancaatngcnttcnttttntgtttnaggtncngggggnggggggggagttttt

SEQ ID NO: 9335 - DNA, 407 bp, Homo sapiens
aattcggcacgagagacagtcttactgacctttatgtccaacatgcaataccattgcctcagagggatttgccgaagaatagatgggggaaaatgatggaaaagaaaagagaacaacatgagattaaaaatgagactaaaaggagtagcactgtagatgggttaaggaaaagacccctcatcgtatttgatggaagttcaacaagtacaagcataaaagtgaaaaagacagagaatggagataatgatcgactgaagcctcccccgcaggcaagctttaccagtaatgcctttagaaaattatcaaattcctcttcgagtgtttcacccctaattttgtcttccaatttgcctgtgaacaataaaacggaacacaataataatgacgctaaacagaaccatgactta

SEQ ID NO: 9336 - DNA, 413 bp, Homo sapiens
aattcggcacgaggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgcctatatatgtatttctgacttggcaggatagttcaagggctggcagtttttattta

SEQ ID NO: 9337 - DNA, 412 bp, Homo sapiens
aattcggcacgaggagagagctaagcactttccactgcatgctaggatatagggcttgcaacatagacccagccctacagccgtcaccccagctggggcaggcagctcctaggcgctctctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggagagggtgggcaaaaacatgggggtagttctgagttgttagaaatgtttctgaatcaagtttgtttgaagacacgtgtgcctttgtacccattataagatggtcataagacccaagaactgataagctttggtttttttttttgtttt

SEQ ID NO: 9338 - DNA, 398 bp, Homo sapiens
  misc_feature 189, 195, 196, 199, 200, 201, 203, 206, 209, 210, 216, 225,226, 279, 285, 288, 310, 327, 354: n = A,T,C or G
aattcggcacgagcagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccatttgcgtnatttgnnaannncnaanccnnggcgtntgaccaaanncaccaagttcgtgcgggacatgattcgggaggtgtgtggctttgccccgtacnagcggngcnccatggagttactgaaggtctncaggacaaacggccctnaaatttatcaagaaaagggtggggacncacatccgtccaagaggaacgggaggagctgagcaacgtctggc

SEQ ID NO: 9339 - DNA, 397 bp, Homo sapiens
ggttcaaatagataaattggaatgagggttaatcagaagctaacagggcagattagcatccaagatggagttgctttggcctctagatggggcatcctgtgcaatttgctaaggtgcttatttggctttctctggtcctaagttggaagcaggggcaaaattaaagaaactgtcattcattcatttcctgacgattctgggccaattgttacacaagttattgtttagcttcctggattgtcactaaagaaagcaatctggtttcctgcaattctgacttacagcaggctgatctcctgggttgtttattgttgatgagggtgttggtttctcgggcagcttgctgcaggttgtgggtcgaatttctaattttacatatggcatggccactgccatt

SEQ ID NO: 9340 - DNA, 416 bp, Homo sapiens
aattcggcacgaggcagcacatatactaaaattggaacgatacagagaagattagcatggcccctgcgcaaggatgacacgcaaattcgtgaagcgttccatatttttcaaggagctcacagtatagtaggggagacaaagagatatttggagaacaatgagataagtcctgggtgtgatataacagcatagataagggccatctaacccagtctgggtcaagagggaagaatgagttagaagtcttaaaatggaagccttgagatggaagtaaagtaggtgtttgccaggtagacaggaaaaggacattcaaaagagaaggaatacgatgggcaaagtcataaaggcaagaaaaagcacagtacagtgtttcatttaaggaactgcaaattgttttttagctgaagaattagatc

SEQ ID NO: 9341 - DNA, 426 bp, Homo sapiens
agaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataat

SEQ ID NO: 9342 - DNA, 426 bp, Homo sapiens
ctgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactg

SEQ ID NO: 9343 - DNA, 470 bp, Homo sapiens
  misc_feature 12, 20, 28, 30, 32, 35, 48, 51, 457: n = A,T,C or G
tttgactccttntacaagcnacttgctntntngcnggatcccatcgantcnaattcggcacgagcggacactggtgaacaaggaagatccccccaaagagctgccagctgctgagcctgttctcagcccattggaaggcaccaagatgactgcgaataatctgcaccctcgagtcactgaggaggacattgttgagcttttctgtgtgtgtggggccctcaagcgagctcgactggtccatcctggggtagcggaggtggtgtttgcgaaaaaggacgatgccatcaccgcatataagaagtacaacaaccggtgcctcgcagggtgaactctgcctcctctgtgaccacgcagcccacagaattcaaaatcaagctttgagcaggggagtgaggcaccaaaagtgggggcagaggagggtggctctgtttcccaaggcgaagcttatgaccaatgngccatctgactgg

SEQ ID NO: 9344 - DNA, 434 bp, Homo sapiens
  misc_feature 408: n = A,T,C or G
ggtgggttggttgggcgcaggaggacgggggcgcgcttcccataacattaccctggctgagcgtgaggctccagggctgggcaccgggttgacctcttattcctcgctgagggcatcgttaccgcctgtggctgcaagccgaggcgcgcgggtggaaactgggtcgaggtctgggtagacgtctgagcgatctgcacaaggagtggcgcagtctggaatttgattgaggattcctaacgccctccgcttgatgttctggtgattcccgggggctcggcttcggaggaaggcaccaagaaactgataatgttcctttgaattggcttctgtatttgcttcatcaatgtctctcatactgaatatcttaagagagatgctggaatattttggcgttcctgtagaacaggntttgctgatttgggaaaataaagact

SEQ ID NO: 9345 - DNA, 399 bp, Homo sapiens
aattcggcacgagcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaagaagctggcctcaggctgcaagaatggccagattctcctctgggacccaagcacagggaagcaggtgggcaggaccctcgctggccacagcaagtggatcacaggcctgagctgggagcccctccatgcgaaccctgagt

SEQ ID NO: 9346 - DNA, 414 bp, Homo sapiens
  misc_feature 210, 219, 221, 222, 229, 230, 231, 232, 255, 261, 264, 266,288, 308, 322, 333, 346, 356, 358, 365, 366, 368, 369, 377,380, 384, 387, 388, 391, 393, 394, 398, 407, 408, 410: n = A,T,C or G
agctgcagaagctgcacagtgagatcaagtttgccctaaaggtcgacagcccggacgtgaagaggtgcctgaatgccctaaaggagctgggaaccctgcaggtgacctctcagatcctccagaagaacacagacgtggtggccaccttgaagaagattcgccgttacaaagcgaacaaggacgtaatggagaaggcagcagaagtctatncccggctcncnngagagcnnnncagacaactgtggggaacgctgngctgtntgnanttggtcccttgggttttttttnctgcctaatttatgttattnccaaccaacatganctgactataancgggtttttaatnaaaaaaaaananaaaaacnncnncccttttnatntttntgnnggngnnttcngtccccgcnntntaaa

SEQ ID NO: 9347 - DNA, 397 bp, Homo sapiens
  misc_feature 154, 157, 159, 162, 206, 236, 244, 278, 282, 283, 285, 297,310, 316, 321, 326, 332, 334, 357, 360, 364, 384, 390, 393: n = A,T,C or G
aattcggcacgagcccacctcccagcccggaggccatgacagcctggtggaccgctggatccgcagccgcctgacagaggctgtgaggctcagcaatcaaggcttccaggcctacgacttcccggccgtcaccactgcccattagatatgttgnatnanaantatgaagacatggaacgtgaagaaaacggagataatactatttncactggtctgttgtacagtgaggctgacanatgcccantatgtcttaattgtctattaaaaaaggaagttgntttnncnaaaagtgcattnttgactttggatnaattgnattcnttaangggcangnggcttttccataagttatttganttnttcnttatatcacctttgtggaanaaccanatnaaat

SEQ ID NO: 9348 - DNA, 485 bp, Homo sapiens
  misc_feature 7, 13, 14, 20, 25, 35, 36: n = A,T,C or G
tttgaancccctnnaaagcncttgntttgatgccnntcccatcgattcggtttgctagaaaacctaattgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtaaaaagggagctcctcttaataggcgcctctaactctttagtggcagatca

SEQ ID NO: 9349 - DNA, 414 bp, Homo sapiens
aattcggcacgagggtgtttgtgaatcgcgttccatcctcgtcctttgtgcctctctgtttgctgtgcttggggggctggcaagattccggataaggggaactggtgggctggaaagaggcatgcggtggccctcaagagccagaagaatgactgctaactggtgcctgggggacctatcccgccgtaattgtggtgctagagccgcattgtgtcctttgcctcggtccaacctttggagacctttcacggctctagccttggttgggagccgagggaaggagtttgggaatgtttggctctgtgtaacaatgaaataattcattggtgatgctctctggccggagtctgtaaagataaggtgcatttcagaacattgcaactcttgcggagggttttaggtaacgtgaaatgg

SEQ ID NO: 9350 - DNA, 401 bp, Homo sapiens
tatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggtaagaaatagtttatttactgtttttcaagaattgatgtgatttaatctattttagtgctttacaattagataccgtcttccatgtttatttcactgatgtcctagttttattgacaaaataatgcattttctcctatgtgtttaaatttctgaaagaatgtagtgtgatggaggctgtgtttaaactcctatctgaaatactaatgaggctgtataacaaagtcattcatgtatttaagagagatctgttgtgacctg

SEQ ID NO: 9351 - DNA, 402 bp, Homo sapiens
ctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccatctggcttataacctacagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcataagtcaaaggg

SEQ ID NO: 9352 - DNA, 415 bp, Homo sapiens
tttagatgttccagagtcctcagagtccatgaaaggactcacagtggagaaaagccctatgaatgtaaacaatgtggtaaagccttcaaatattctagtaacctatgtgagcatgaaagaactcacactggagtgaaaccttatggatgtaaggaatgtggtaagtcgtttacttcttccagtgcccttcgaagccatgaaaggactcatactggagaaaaaccctatgaatgtaagaaatgtggtaaagccttcagttgttccagttcccttcgaaagcatgaaagagcttatatgtggtaaaaaacaacaacaacaaaacacctctgtcaatgtaagaagtgtgttaaagctttcagttattctagtttcattagaacaccgtgaaaaaattaaaaactcaaattagagagaa

SEQ ID NO: 9353 - DNA, 392 bp, Homo sapiens
  misc_feature 157, 171, 172, 173, 181, 187, 192, 193, 198, 201, 203, 206,208, 217, 229, 230, 232, 236, 251, 252, 255, 257, 258, 260,261, 268, 273, 280, 283, 288, 295, 297, 298, 299, 310, 312,313, 317, 320, 323, 331, 340, 342, 350, 352, 357, 359: n = A,T,C or G
  misc_feature 365, 371, 373, 377, 381, 383, 384, 387: n = A,T,C or G
aattcggcacgaggttcggttgaaggattctgtgtgctgtcggacccagagggtgacggcgccgctaggatgaagctcgtgagatttttgatgaaattgagtcatgaaactgtaaccattgaattgaagaacggaacacaggtccatggaacaatcncaggtgtggatgtnnncatgaaancccatnttacnnctgcnatncngancntgacttaancctatatcttcnncntttngctttgctcattttnnagntnntnntttctcnttctnttattcnccntcttntattccncnnnacctcttcttngnntttnacnatncctttcancctctaatntnttctcttntnagatntncttctnctctcncntttnttcntnntcntgttt

SEQ ID NO: 9354 - DNA, 421 bp, Homo sapiens
aattgccgccgacgctgcttcagcttattccttgtggcctctgcgggtcctgcctcaaccatgatgatccacggcttccagagcatccaccgggatttctgcttcgggccctggaagctgacggcgtccaagacccacatcatgaagtcggcggatgtggagaaattagccgatgaattacatatgccatctctccctgaaatgatgtttggagacaacgttttaagaatccaccatgggtctggctttggaattgacgctcaatgctacagatgcgttaagatgtgtaaacaactaccaacagaatgcttaaagtggcctgtgctgaagagtggcaagaaagcaggacggagggtgaacactccaaagaggttattaaaccatatgattggacctataccacagattataagggaacctt

SEQ ID NO: 9355 - DNA, 423 bp, Homo sapiens
aattcggcacgagacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccccg

SEQ ID NO: 9356 - DNA, 393 bp, Homo sapiens
  misc_feature 214, 217, 218, 219, 220, 221, 224, 228, 235, 236, 238, 243,244, 246, 249, 255, 271, 274, 303, 312, 313, 317, 321, 322,323, 325, 326, 327, 336, 355, 358, 360, 363, 364, 366, 374,376, 379, 381, 382, 383, 385: n = A,T,C or G
ccgcagggccgtaggcagccatggcgcccagcccggaatggcatggtcttgaagccccacttccacaaggactggcagcggcgcgtggccacgtggttcaaccagccggcccggaagatccgcagacgtaaggcccggcaagccaaggcgcgccgcatcgctccgcgccccgcgtcgggtcccatccggcccatttgcgtcatttcgcaatttnaannnnnccncctnttttttnntnggaannanacntttttngttttttaaaaaaaanttnaaaaaaaaaatattggggggggtttaaanaaaaaaaanncctntttnnnannnggaaaaaanttgtttttttttattaaanacncnccnnantttctaananaanannngnagcccttt

SEQ ID NO: 9357 - DNA, 387 bp, Homo sapiens
  misc_feature 372: n = A,T,C or G
gccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggntatgtattccttgac

SEQ ID NO: 9358 - DNA, 415 bp, Homo sapiens
  misc_feature 313: n = A,T,C or G
aattcggcacgagcttaacatttcttatagtgtttgttggtgatgaattctttcagctttttatttattgtttgagagtcttgctctgtcacccaggctggagtgcaatgacacaattatggctcactggagccttgaccttccaggctcaagcaaacctcccaggctcagcctcccaagtaactgagactccaggcgtgtgccactatgcttggctatttttgtattttttttagagacaggttcttactatgttgcccgggctggtctcgaactctgaggctcaagcgtctgcccacctcagccttaaagngcttccagcttttatgtgtctgaaaatatctttatttcacttcgctaaaatatattttcatcacacataaaattctaaggttgcaggttttgccttcagcac

SEQ ID NO: 9359 - DNA, 408 bp, Homo sapiens
ccgctgctcacacctttctactgaagcatcctgatgacgaaatgatgaagaggaacatggcatattataagagcctgcctggtgccgaggactacattaaagacctggaaaccaagtcatatgaaagcctgttcatccgagcagtgcgggcatacaacggtgagaactggagaacatccatcacagacatggagctggcccttcccgacttcttcaaagccttttacgagtgtctcgcagcctgcgagggttccagggagatcaaggacttcaaggatttctacctttccatagcagatcattatgtagaagttctggaatgcaaaatacagtgtgaagagaacctcaccccagttataggaggctatccgggtgagaaatttgtggctaccatgtatcattacttgc

SEQ ID NO: 9360 - DNA, 416 bp, Homo sapiens
aattcggcacgagggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcgggggggcaacgacaacaagctgctggtctggaatcactcgagcctgagccccgtgcagcagtacacggagcacctggcggccgtgaaggccatcgcctggtccccacatcacacgggctgctggcctcggggggcggcacaactgac

SEQ ID NO: 9361 - DNA, 411 bp, Homo sapiens
  misc_feature 132, 134, 139, 140, 161, 168, 169, 182, 205, 355: n = A,T,C or G
aattcggcacgaggccacagccgggtcacgtggccggttgccccccatgacttgctggctgcggggcagtcacggtgacgttcggtccgacctgccgagtggccaggctacctcagtcacctgtgtggtccnantgctnncatggacctgggacccatgcncaagagnnaccgcggggaccnagaggcatttgaggagactcatntgacctcccttgacccagtgaaacagtttgctgcctggtttgaggaggctgttcagtgtcctgacataggggaagccaatgccatgtgtctggctacctgcaccaaagatggaaaaccctctgctcgcatgttgctgctgaagggcttcnggaaagatggcttacgcttttcactaacttcgagagtcgaaaaggaaaagagctgg

SEQ ID NO: 9362 - DNA, 451 bp, Homo sapiens
  misc_feature 5, 8, 14, 15, 19, 22, 23, 29, 30, 32: n = A,T,C or G
tttgnttncctttnnccanccnntcgcannancatatgcttgtctcaaagattaagccatgcatgtctaagtacgcacggccggtacagtgaaactgcgaatggctcattaaatcagttatggttcctttggtcgctcgctcctctcctacttggataactgtggtaattctagagctaatacatgccgacgggcgctgacccccttcgcgggggggatgcgtgcatttatcagatcaaaaaccaacccggtcagcccctctccggccccggccggggggcgggcgccggcggctttggtgactctagataacctcgggccgatcgcacgccccccgtggcggcgacgacccattcgaacgtctgcctatcaactttcgatggtagtcgccgtgcctaccatggtgaccacgggtgacggggaatagggttcgattccggagagggagcct

SEQ ID NO: 9363 - DNA, 413 bp, Homo sapiens
aattcggcacgagtagaggttaatggggttgacctgaggaactccagccacgaagaagccatcacagccctgaggcagaccccccacaaggtgcggctggtggtgtatagagatgaagcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctg

SEQ ID NO: 9364 - DNA, 410 bp, Homo sapiens
agacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgc

SEQ ID NO: 9365 - DNA, 474 bp, Homo sapiens
  misc_feature 12, 25, 39, 42, 434, 435, 448: n = A,T,C or G
tttaatcccttngaaatccccgccnttttgaggatcccnccnattcgaattcggcacgagattcgttgacaaaaacaatgaccttttctatcgagacctgtcccaagccatgtggaagggcagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtgtatcaaaccgaatgataaaaaagcagcacacatcttcaacgaggctctagtgtgtcatcagatcaagtacctggggcttttggagaacgttcgagtgcggagggcaggctacgccttcaggcaggcctatgaaccttgcctataaagatacaaaatgctttgtnnactaacatggctnattggaatggaccagcaggtctggtg

SEQ ID NO: 9366 - DNA, 406 bp, Homo sapiens
gacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgccggaggggccctcgtgtaaattcatgcccctcgattt

SEQ ID NO: 9367 - DNA, 410 bp, Homo sapiens
  misc_feature 322: n = A,T,C or G
aattcggcacgagcccgcggcgtgggcaagaccagcctgatggagcgcttcaccgacgacaccttctgcgaggcctgcaagtccaccgtgggtgttgacttcaaaatcaaaactgtagagctaagaggaaagaaaattatattacagatctgggacacagcaggtcaggagagattcaacagcattacctcagcttattacagaagtgccaaggggatcatattagtatatgatatcactaagaaggagacatttgatgatttgccgaaatggatgaagatgattgataagtatgcttcagaagatgcagagcttctcttanttggaaataagttggactgtgaaacggacagagaaatcaccaggcagcagggggaaaagtttgcacagcagatcactgggatgcggtt

SEQ ID NO: 9368 - DNA, 385 bp, Homo sapiens
ccagtccccatgggctgaaggcaggttgagttcttccccaggtctgcgagcctcgaaggcttctttcagacagcagaccccttagaagcgcaaggctgctttctgacaaagaatcaagtgttcctttcaaccagccaagggactggttttctcgctgaccctttgacagctccagccggtccctccgttcgaggtccctgacttcctgcaacagactgagatggccttctgagcttttccagggctgacgaccaccttcttgataccttcccctctctcgttctgaatccgtgcccaccagacggactctagctcttgttgcccagactggggtgcaatggcgcaatcttggctcaccataacctccgcctcctgggttcaagcg

SEQ ID NO: 9369 - DNA, 382 bp, Homo sapiens
gggatgcctccctctaagaacatgacactgagatgatcaaggttctaaaagggcgatcatatcactctccgaaaatgaaactgctcagacagaatgacaattaaattaataacaaccaagacactgcccagatttcatctccgttcacagcccctcctgtgtgctgtatgatcaggttcttgggggtggctccagatacagcaaacagtcaggattaatccacaagagtgagctgtcagcatgaggttcccctacagtggagcttgccaaggtccgtggctcccagggcacccgttccagggctaacagatgaagcatggaaatgctgtgtggagtgagctgacaccattctcaggagaaaacagacaaatcctctgcccct

SEQ ID NO: 9370 - DNA, 401 bp, Homo sapiens
gaacagtctaaggtttgtaggacttgcgttccacctaccaaagctaatcgagttagaaggctccaaactgaggtgtcatttctcattacggtggtgagaggacgggaccacacactgtgaagtcttcgttcccacatcccacacttcattcttgccgcctaagttgtcgccgtgggactattgaaagggtatcagcgatattcatctttcctataaatgggatctgctttctacagtttcctgccagatgtgtaaagattgcaagaattgaaggtatttcttcaactgaagacctttacagatactcagatgactgaaatcctcttatcactggctggacatggtggctcacgcctgtaatcccagcactttgggaggctgaggcagaatcatcattctgg

SEQ ID NO: 9371 - DNA, 387 bp, Homo sapiens
cccaggcctggggcccggtggaagtccatctgacaaccccacccaggccagggtcgaatctggaatgggagggtctggcttcagctatcagggcaccctccccagggattggaaacggatgacgggcctctaggcggtcttctgccacgagcagtttctcattactgtctgtggctaagtcccctccctcctttccaaaaatatattacagtcacaccataagcacaaaccaggctccagggtcaccctgtaggagcaaattccttgtagtccaaattgtatgagggcgtggccacatcagcacttaggagaggctctgcacaggtccacctcagagccgaccctccagagcaacttttctgttgtgaagaggctggttttctgagt

SEQ ID NO: 9372 - DNA, 400 bp, Homo sapiens
  misc_feature 394: n = A,T,C or G
gccttgtgcccggccctgttcacttcagggcagcctcaggagtaccctgctcaggcctcatctgctaggatgagccgacctgggagaagcaaacgcttgggatattttgcacagacagcttggcagctgggtgatgggaggggctgggcaacgtggcctgggcacaggcaagtaggggaagtgtctcccagtctgagatgcattgtctgtcccagcacttcaccaaccttggtgctcctggctagagaccactggggaaggtggtattgccatagtttcttggttcagggactcaggagcctcagctggggcccaagaaggggtctgtgtggaaagcaggcacccaaagtctggggaggtcctggggatgggcctgggaacaagccagcatggnaccttc

SEQ ID NO: 9373 - DNA, 387 bp, Homo sapiens
gccttgtgcccggccctgttcacttcagggcagcctcaggagtaccctgctcaggcctcatctgctaggatgagccgacctgggagaagcaaacgcttgggatattttgcacagacagcttggcagctgggtgatgggaggggctgggcaacgtggcctgggcacaggcaagtaggggaagtgtctcccagtctgagatgcattgtctgtcccagcacttcaccaaccttggtgctcctggctagagaccactggggaaggtggtattgccatagtttcttggttcagggactcaggagcctcagctggggcccaagaaggggtctgtgtggaaagcaggcacccaaagtctggggaggtcctggggatggcctgggaacagccagg

SEQ ID NO: 9374 - DNA, 379 bp, Homo sapiens
gcttcagaagggcttattttaaagggaatggaaagcatttcagttgtaggaagttaacagctgtgccaagcaaatgtgttttctcaagtttcagaaaatgctacagttgagagagatgcaaaaccaggtttttagttaaactaggcagacttttttgctttgttttgtttttttactttacatacttcatgcaaatctcacttagccagtcttcagaagccagtcttgaatcagtgtccacagctgtagcagatcagtaatttaactgctttttagcttctggaaatcccttgactgggtcagctgactatgcagtcatttatgagaaacatctgaacaccatagttacaagacagcagtatccattcaacaatccaaa

SEQ ID NO: 9375 - DNA, 383 bp, Homo sapiens
cccttttgaaggagatcagttgctccctctctctttcttagtgtttctcagcaagactatttaacatttaaggccgtaggcattaagaatccagggatctgtgttttagagctgaatgtccttctccaagccaagctcagagccaaagctctcaacagctgaaatacctgcttgctctattctttttaaccagtgcagcagtgcttccttctaggataacagagctcttctcatatattccattgactgttgaaatctcagtaagggaaacacttttcaaaatgtcttgttatggaaaggattgggccaaataaatatatttcctgttgaaagtaacgtgtactttcactgaaggatagcttctctactacagctactgtttg

SEQ ID NO: 9376 - DNA, 376 bp, Homo sapiens
aagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaacccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggtt

SEQ ID NO: 9377 - DNA, 383 bp, Homo sapiens
cctgcatgctttaccagagcccagcctccagcctccacggaaaatgtgttttggaatcaacactctttgcaaaggctccacactgctttctggtagcattggcctgggcgcccaggcactcctttagaacccacctgttccccccacccaccctagtgggaggaggagagggttacactgacagataccggcagctctgcaacccgggaacaacgcagacaacatacaactcgacagagtcacagaaggtggcgtccatcgcgcctggatggtgactactgccctgcgggctgctgggtgggtgaaacacacagggaagaagcacaaatacacacacagatgtggctcagggacatttgaatgcttcagtgtgtgaattttta

SEQ ID NO: 9378 - DNA, 375 bp, Homo sapiens
atttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacata

SEQ ID NO: 9379 - DNA, 420 bp, Homo sapiens
  misc_feature 376, 396, 416: n = A,T,C or G
ggtgcagtgcatctttgcagagcacccagaggtgggggacagtgactcacagaggtgcctttggccttaccctgccagcagcagctcccctgctcttggaatctcccccagccccctgcctccctgtctcctgagcacctgccccagctcagtgactctgggggtactggggagaccatgatgttgctaccaccttagtcagggttgggggagcccccggccaggtgccctccaggatccgcttccccacccctcctgggaagcctggaccagcatcccttcttgggtggatggagcctcgtcctcatctccagctacatcagtcattctctgcagggcaaaatctcctcccctaccccagctgtttctgcagaanggccctggctgtgttggcangacttcggtgtccaaggtanatct

SEQ ID NO: 9380 - DNA, 394 bp, Homo sapiens
gttgggaccacagacacacagactacaggtctggaaatctctccaggcaccctgctttggccctctagaatacagacagttcctgctctaagaggccatctgtgaggctcagtctcccaacacctctgattcatcccccgtctcctggtgggagacaacgtgctccttctggacttcaaagccagccccactaccctcggagtctgtgtgctgggcgtggacaagtctctgctttgtacccactctgtggccgtgaacctgtgacctatacttctcagccttgcttttcttatctgtaaaatgggaatagtcactggatttatcttaaagctgaggtcactggtgtctgggcttgaaagagaaccggctcatagggaccctcactcacgagccc

SEQ ID NO: 9381 - DNA, 378 bp, Homo sapiens
  misc_feature 310, 311, 312, 314, 321, 325, 327, 358, 359, 360, 371, 374: n = A,T,C or G
gtcagctcccgcgtgtctccgctcgacagggtgcttgggcaggtaagggtccgctcagtagcccaaccctctctgtatgcagctccccaaattcagcgctgcgctcaggcatggcagccacccgttacgtgggggaggtgtgatatgcatttattgaggtcaaataaaatgctggaaattggtgcctggtgacactgtcaggttggtggttaccctagcaggtcggcccagcccctgaacgcttccatcactgccgaaagccctgtgaggaggcgcagagctgagcattccccgccgttgcgtgggcccnnntntacctgncgcntntttcctctttgctgcagagcccattgggtannngcggccatggncantcaa

SEQ ID NO: 9382 - DNA, 382 bp, Homo sapiens
  misc_feature 371: n = A,T,C or G
gggaggtcctccatgcgcagtcatgagtcgcttcaagtttatcgatattggtatcaacttgactgaccctatgttcagaggaatttataggggggttcaaaagcatcaagtttatgattacaggtggaaatctacaagacagtaaagatgcactgcatttggcacaaacaaatggtatcctcatatttcttttaccaaaaaaaaaatgaattaagtaattttgaagaagtctttctgaaaactgcttcaggtatgtttttcagtacagttggatgtcatcctacaagatgtggtgaatttgaaaagaataaccctgatctttacttaaaggagttgctaaatcttgctgaaaacaataaagggaaagttgnggcaataggaa

SEQ ID NO: 9383 - DNA, 382 bp, Homo sapiens
acagcatgttgaagcctatcccccagtcacagtgatagaagttcttagttaaagacgagaatctgtttactggcctcgagacattgcactgcacctgggaagggcaggtagtccgtgtgctggtccttccagctttccagggcggaagtggtgagggtgcgcgtttctgacttcgtggctgctctctggagactgctcagtatctttgcacatgccaccctgagatgcatgaccattgatagcctggtttgcctgtaagacaaagcagccccaccatgcagtaggcgccagctgtatacctcacttggtatcacctgcagccttgccagctgaggcagatgcacctgagtgtgagggcggcaattgacctgttcctccatgt

SEQ ID NO: 9384 - DNA, 378 bp, Homo sapiens
gggcgggacggtacagcacccggaggaaccttgattccctgccccgcaagcccagcaccggttttgccgccttgtctcgaagggtcaaccaggccatctcctgcctcgggacggagagcgccctggaaaaggcggaggggccgaccttagtcacacaagagcgatggcaagattttcacccaagccatctgacttggaacccatggattaaccaactgccactggaggcaaatccagagaccaagggagcagtttatacagaaacagaaaaattagccgggcatggtggtgggcgcctgtagtcccagctactcggaaggctgaggcaggagaatggtgtgaacccaggaggcggaggttgcagtcagccgagatcgc

SEQ ID NO: 9385 - DNA, 402 bp, Homo sapiens
cctggctgagaggcgttaggagtccgggggttcgcccgcggaggccggggagcagccgaccatggagccccagagggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagacttgcaccgggctgtcagtgtgaatgatgaagatttgctggtccgaatacttcaaggaggccgtgttaagggtgatgttcccaataagtttggctttaccgctctgatggttgctgccagaaaggatacaccaggcttgtgaaaatcctagtttctaatggcacagacgtgaatctgaagaa

SEQ ID NO: 9386 - DNA, 380 bp, Homo sapiens
acgcctcgccggagtgactgaggcactgaagccaacagcagccaccaggaccacattgctggggggcaaggaagcacaggccctgggagtcccggggggctccgctgagacgacagaagccgagtggggtcctgcggcctggcccgaggacaaaagggcccgccttaatgttgcagccccttgccaaccgcgccccacacattttgtggccctcatggtgaccgagcctgggctacaagcagaatgaccaaggcccaggaatacctggtccacgtggccccacactgcgccaacttcctagtgccctctcagaacctacacctgaccctggccctgctgcgactggcaggcgctggggaggaggccgctgccattggagc

SEQ ID NO: 9387 - DNA, 392 bp, Homo sapiens
cgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgt

SEQ ID NO: 9388 - DNA, 379 bp, Homo sapiens
ggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggca

SEQ ID NO: 9389 - DNA, 464 bp, Homo sapiens
  misc_feature 8, 12: n = A,T,C or G
tttggccncttnaatcaagtttgtgtccttttgcaggatcccatcgattcgctcagcaggaacactaagtccatggaaaacaggccctgggcccgctgatgtgcataattccacgtttgccccccatgtaaccaggatggtaaattacaggtgtcagataatcacgctctggagtggctacttgaggatgcgatcgaccaatttaagctccgtctgacacatgatcaatagcccgtgatgctgcatggaattgcaggcacagcgtccaaacctgcagagcagtggctcccagctgtggcaactttgccccccagaggacatttggcaatgtctggatatgtttgcaattgtcacaactaggagagggggatgctattggcatctggcgagtgaggccaaggatgctgctaaacctcccatgatgcacaggagaaagtccccacacagaccattctgggccaaat

SEQ ID NO: 9390 - DNA, 458 bp, Homo sapiens
  misc_feature 9, 12: n = A,T,C or G
cccctactnganactctttaaacaagctcttgttctttttgcaggatcccatcgattcgcttagtctttggcttttgctgacattttcccctcttatcttttctcctgaccaagttctaggtatttcatagggcagtctaggtgagggttggaaccccaatgagttgggcaacagaaacccagctcacactggctgtcactgtgggcaagctgttcccctcatctctaaaagtggagatgagattagtgtatgagtctggcttccattcaactgtgtgtgaaaaaaaattgtaaaattttctttctggtttacgcaagttaaaagtttatttctctcatatgaaaggagtcaaggcagacagaccaggatggggagggagatgtctacagggtcaaggacccaggctcttatttcgctgctgacgtccttagtatgaggctttcaccttccaggatgg

SEQ ID NO: 9391 - DNA, 400 bp, Homo sapiens
ctggcttcctggccaaagagcccgcgcagcgaggtggggttgggggctgggacccagctccgtgccccgccacctggctctctgggaagaatcggacctgtcaccctcgaaggactggccgctaaataacttcggtattgagagctgtgtgagcctcaaagggagggcccagaccagctggagtctctacccccagacaggataaagggcaggacttggggtcataggaggaggcggctaacatgaaaacaacttaggttggagagaaggaggggccaatccaatctgcaccctccctgtgtctgtcccgagtaggtgctgtccccctctcccttcctttgccaccgattggagggacactctggaaaactcagttgaagaaagcggagagtctgcgtgt

SEQ ID NO: 9392 - DNA, 395 bp, Homo sapiens
  misc_feature 369: n = A,T,C or G
ataacatgttcaatttaaagaaaaaaatctgaagccacttaaaagctactgtttggcaccgatacattattccagtaatgaataatcattaaagatattattctggatgcagttaccatgcagtgatgtgaataaaatgcattagatggaaaattgtatttcaagtaaatatatgcactggtagaaatgttttaccacccactaatatgtattaattcaaaaccaaatgccaactggagttcgcctacacgggtttgaatggcaggcagtgatttggaagtgggaggaaataggtttggatttggtcaaatagactgagaagtgatagtgggggcgggggtttatgactcaaactttaacaggtgagangactatgccatggacagaacaggcat

SEQ ID NO: 9393 - DNA, 395 bp, Homo sapiens
gatgagggtgtagactgtggagtcgcataaggacttgaccgccggcacagggagctggagcaaacccaagactggctgagaccattcatcatgcctgggtgagcacaatttaaatctggaaatttctgctcagccagattacagaactctaaatgacagtatttaactgctgcctgaggaccctggagtttctcccatgtgacgcttcccgaatcaagggagggatgtgctctcctcttgcctaggaggaggtcctggactggtcttgttctggagagactggacacttggcatcctctcccaccatgaactgccccccaccgcccatataaatgttactgctgggggtgtgaacaagtaaacgtgtattattacctcccttgccagctgaggag

SEQ ID NO: 9394 - DNA, 389 bp, Homo sapiens
agcagctggggaggagccaaagcctcggcgctcacctaagccgcagggagatacacccaactgggagatgaggaaacagcaacccagagaggagaactaacccacacaggatcatttcgcgaaggagcaaggctgaagaaccagacctggactttcttaggcaagtaaattctgattatatcacggagacttgctttgagaaatctgccccttttcactgtgagatggcgtcattaacacatctagttctctcctaagcagccagcaaacatttattatacactagatattatattggcatttgagatgatacaaaggaataaaatggggcaattagctctagtaatttggaggctcaacttacggatattccaagttcctttgaaacg

SEQ ID NO: 9395 - DNA, 391 bp, Homo sapiens
gttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacaagtg

SEQ ID NO: 9396 - DNA, 406 bp, Homo sapiens
  misc_feature 353: n = A,T,C or G
ataaaaaaaggcatttaagcaaggttggaaactgaaaaaaaaatctgactgtatattctgtaaaactataataaacaagaggaaatggcaagtgtttccaactgagaggttcccagttgtaatctactggcattctttaataggaatatttaatagtcaattctcaccaacaagaatggacttcaaataaagccacattttgaaacaataggttgtttacagcagcatagcaacggctataaagcaacaattcctaatcgtacttatcttgctggctattcaagaaaaaggtgtagaacttccttactgagaggatcttgagttataatttagtactaaattataagtaatgnttgtgtggatacaaatatgacacaaaaaatgccttcctttaaaacccattata

SEQ ID NO: 9397 - DNA, 386 bp, Homo sapiens
agaggagtggtttctggctgaatactatcttaggctcaaggagaaacaaaataaaaattagcttccaggcagcctgtttttaaagaaatgggactaatgggagaagctgtttgtcactctaagagcatccaagccctggcctgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtcacatgtgatacatttaagccactggaaaaa

SEQ ID NO: 9398 - DNA, 383 bp, Homo sapiens
ctcgcagcagctggggaggagccaaagcctcggcgctcacctaagccgcagggagatacacccaactgggagatgaggaaacagcaacccagagaggagaactaacccacacaggatcatttcgtgaaggagcaaggctgaagaaccagacctggactttcttaggacaaacttactgcagcttgaaggagccaaccatggatttgaggcgtgtgaaggaatatttctctggctctactatcaataccaaatcattagctgctgtgctgttttagagccctgggagcgatctatgtttaacaccatcttactaaccattattgctatggtggtatacactgcctatgtctttattccaatccacattcgcctggcttgggaat

SEQ ID NO: 9399 - DNA, 376 bp, Homo sapiens
gacagcctggggaacgctggggccctgctgaatcccgggctctccaggcacgaacaggggcatcccgcgtccacgccgcggggaggagggtttcaccgtctccagggacttggctcgaggaaattaaactctaatgagtagctcgagaaatgttccgggatggtggatgagcgatcatccttaaaagaaaatgctattctgggagctccaacctgcaattaacctacagaaggaaccttttgagaggctggtgcagcgcttcggggaggcagattaagaacttagttggcctggttgaagctctgtgaggagcaaagcagccctctccaggtgaactgcttgactttaccacctgaaggagtatttactgcaagaa

SEQ ID NO: 9400 - DNA, 380 bp, Homo sapiens
gcagacaggaggctggacagaggggccgtgtgccaggctgcaggggagaagctggtgggagggtgcttggacagagtgtcgggttttgatctgaccccctgggggctgtgaggtctgcagaggaaatgcaacctcccagggctggagcctgccctgtcacctgctcagcagtgtggccgactgagcatgtcacctctgaactgcagatcctcctccctgcaaggggataaccacagcccccccacacccagggatcctgggagattaacttcgaggatacagcagggcacgcagcctggtacacgctcggggaagaatgtcagcaaaccttcctcctcttcccgtcctgaccctgcagtcacaccctccagggctatggc

SEQ ID NO: 9401 - DNA, 404 bp, Homo sapiens
cggtctccacgggagccaccggtcctgaaagcgcggagcatgctttgtttgcggaaacgaaagcgaatacttctttccaaggagacttaggaaagggcagacgctcccactgcctcaggtgttccctggaggaccttcaagtggccgccgtgtgggcgggctagcgtcccgctgctgcgctggttccggagcccttcccttgcctctcccagggtccttctcccagcgtcggaggaaggcccgccgtctgcgagtggagtgcgggtggtgggaatccctgggaggattacgaaatccttaaagtgggatttaccaaacgcattcctttccgctcacttccgttcccgcttaacaaacgtgttggaaacgtgttgctactgaaaggaagtggcgctgggctgcat

SEQ ID NO: 9402 - DNA, 387 bp, Homo sapiens
gcagcccttgactcctaagccccttcctccttccattctgcatcccctccccatccaacctaaatgccacagctggggctgagctgtattcctgtggagggacctctgccgtgcctctctgaggtcaggctgtgctgtgtgatgggcaggctttgccccagcccacccctggcaaggtgcacttgttttctggtttgtacaaggtgtcctgggggcccgtggcttccctgcagtgaggagtgacttctccctctcttccagtcctgtaggggagacaaaaccagattggggggcccaaggggagcatggaaaaggccggctcccctgtctttccttggctgtcagagtcagggtaacacacaccaagagtggagtgcggccagcaag

SEQ ID NO: 9403 - DNA, 383 bp, Homo sapiens
aaacgggatggtttataggagttcccatttggttgaaagctagaagccctaattgaccttaaagtaacatgctatgggatggtgggattgtcccctctgacagcacatatgaaatagttcatctatataatagaaacgcacacacacgaaagagaatcttctgacttaaatacaactttcatggagttcttcaccacttatctgtctctgttaaaatctgaaaatctagcccatggctaaaatctattatatgtgttctccatatttcttgtataagccagtccccagcatctgatgttttgagaagtgcatggagtttcctaaactttgcacagaagaatatcctggggccgggcatggtggctcacgcctgtaatcccagc

SEQ ID NO: 9404 - DNA, 156 bp, Homo sapiens
atgccaattacatatttatttttccatacctgatttttttcaagtctgtaataaaaaaagtataagttgagattaacataggttatttttcatgaagtatagcaaacgatctagaatgtgataggagtgtggtttccatttctttttttttttttt

SEQ ID NO: 9405 - DNA, 465 bp, Homo sapiens
  misc_feature 6, 8, 21, 29, 42, 44, 49, 52: n = A,T,C or G
tttggncncttaaacatttgntgcctttntgcaggatccctngnttctnatncggcacgaggttccctgtagctgcctacagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaaacctgatattgaactgagagaggggttcaaaactgactgtgttttgtgggctgccagggtgggagaggagcatcaccagctcctcagagccactccgctccatatcaagtatctcacaagtcccatccttccaccttctgggcagaaggttttctgatgggg

SEQ ID NO: 9406 - DNA, 450 bp, Homo sapiens
  misc_feature 5, 11, 19, 23, 27, 29, 34, 48, 55: n = A,T,C or G
tgaanccctanacaagctnttgntctntntgcangagcccttcgattnttttctncccccagagcttagcaagacatgatcagcctggattacagctgccctcacgtaactgggttaaagtgttggcctacttaggcccctcctgcagtggcttccttcaaagctgatgaggccgattagggtgctatttctgagatctagtcgtgtacccagaagcctgagggcggtcctcccctgactagaaagacaatgactaaggctggacagccaagggcagagtcagatttgcccataggagagcactgccgtcagaactcatgtatgcttgtaaaagaaccaaataatatcaaggctaagtccctggattttgaacttcaaaaaccaaaccaaccaatcagttttcagggataggcctagtcctacacctttgccatcttcagaacttaaaga

SEQ ID NO: 9407 - DNA, 442 bp, Homo sapiens
  misc_feature 8, 9: n = A,T,C or G
tggacccnntgaagcccttgtctttttgcaggatcccatcgattcgtgggtactttatacaaagaaaattcagccctttctgctgtgtcttcaaattatgcagggtaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggggactgtatcgtcatagatgtacatattgtgcggtagggctatgaggcatgttacaggaatgta

SEQ ID NO: 9408 - DNA, 442 bp, Homo sapiens
accctttgactttctgcaggaacccatcgattcgctggtcagttcagtccctatgaatgtctcttctacaggaggctaccctgcccctgctaccctgggagaagcctcagctttctgggcagagtttgtctccctgtcatttatactctcaggctttatacatttacacagtaagttctccctcctggagggttaaaaggaataatttcaacagggtgaaggcctggcacggtggctcacaactgtaatccaaggactttgggaggctgaggtgggtggatcacctgaggtcaggaatttgagaccagcctggccaacttggtgaaaccctgtctctactaaaaacaaaaattagccaggtgaggtggcacacacctatagccccagctactgggggaggctgaggcaggagaattgcttgaacctgggaggcagaggttac

SEQ ID NO: 9409 - DNA, 424 bp, Homo sapiens
aagatggtaagctagatttgacaataccacatgcttcaaaatttaggcttgggaattgaatcttttgttatcatatgtggatatataaaaacacatttttaactcttaaatgtattactactgtaataattagataaatttggtctcatcctattacatccaaattgccacttaaatgctggttttaaagtaagaagagcaaggatcttcctggcaactataatagtcaaagaaaaccagcagtgactgaagaaaaaaatgaactgctgagatgaaactatcactgtaactcccagcaaatgtcaatgctatccttatcttatacctgtgattctggaagctttcagagtttctctttgagacttgctccagtaaccagatctaaacttttccttcctctccagttagccagtcatgctctaga

SEQ ID NO: 9410 - DNA, 394 bp, Homo sapiens
gctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggcctctctattctctgctcgctgctcttcgccattcttctcgccttcctcctcgccatcgcctacttgatcgttaaagagttgcatgcttagaaattgaaaaa

SEQ ID NO: 9411 - DNA, 398 bp, Homo sapiens
tccatctcttcttcctagtattcatgtctaccaaatgctttctttggcttcctctgaaagaagccagtttcagcaagtgagtttgtgattctttctcctttcaggtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaaggtattcctgcagttaacccttcctacaaatgtggaatcttgttagattcagtgtgcactaaactaggtaagaggagtagtcaggactttcctaacatctaccaatct

SEQ ID NO: 9412 - DNA, 387 bp, Homo sapiens
gttgccatactcttgcatacacaatcggttatctagtttttgattgtttgtgtgtatggtgtgtgctgtctctctgaccagatttcaggttcctgaggcgagcctgcagctcatactgctcatctgtcctctcctgtggtgggtgctcagggcctctcactgttagttactccctcctttctgcccagttctgcactcaactagtagaagcagccatcctttccccaagcaggaaattgtagtggtcgcccttaagagcagtgtgagggcagaagattaagggaggggaagagtccctggaactggaagaaggtaaatactttgccttgagagggcgccgaatcattttaccaaaatagtaaatggaaaaagtgtcaaagggtgggg

SEQ ID NO: 9413 - DNA, 383 bp, Homo sapiens
  misc_feature 171, 349, 365, 379: n = A,T,C or G
acaagagcccctggggagtaggtggtggcctgtgccgtcatccccatttcaaagcagggagctgaggtcctgggaggggaaagtgcttgcctgaggtcccactgtgttagtgggtgggcaggactggaactcggttctccaacagcccagagctcactcttttacacccanaggtggagcaggtggcttagggggtggtatgtacttcacaagccaattcccttcagccaggagctcctgggtgcatttccgtgtcagaaacagtaccgagtcccaccccctctggaggcacagctgttgcgtcaggcaaggtcacctgcatttatttattgagcagcaatgctgtgtnaggcccagggaccgancccctctcctgttnccta

SEQ ID NO: 9414 - DNA, 381 bp, Homo sapiens
ccaaagcaaatgtatttttaaaggcaaatgaggtttattaagaagagagaaatggcagatgtctccgagactgaagtctcttgatcttgagagtagggtctggtctctgtctctttactctagcacattcttggtctttccttttcaagatgagtgcccttttgtgctttgcaccccataggtggttattaaatacatgttgattggttggttggctgtttgtctggttagaagtggagagtcagagctaggtggaaatagcacttgcaaccattgcagctgctgttggaatgacacaggcaagagatcacttttgggccaggcgcggtggctcatgcctgcaattccagcactttgggaggccgaggtgggcagatcaca

SEQ ID NO: 9415 - DNA, 375 bp, Homo sapiens
ccaaagcaaatgtatttttaaaggcaaatgaggtttattaagaagagagaaatggcagatgtctccgagactgaagtctcttgatcttgagagtagggtctggtctctgtctctttactctagcacattcttggtctttccttttcaagatgagtgcccttttgtgctttgcaccccataggtggttattaaatacatgttgattggttggttggctgtttgtctggttagaagtggagagtcagagctaggtggaaatagcacttgcaaccattgcagctgctgttggaatgacacaggcaagagatcacttttgggccaggcgcggtggctcatgcctgcaattccagcactttgggaggccgaggtgggcag

SEQ ID NO: 9416 - DNA, 379 bp, Homo sapiens
tggattgtaggtgagcctcagatcttttgttttttagtgagaggtggaccttgcaggagagagccctcccttctctgttctgcggctgccgcactccccattgctgattcccattgcagggtacttgcatggtcaccccatttgccttactccgtggactcttttctgggcattgagtagcaggctcagggtctgagcacagggagctccctggagagaatgttgcatctctcacttcccatcccgccaccccgtgtgtagccccctgcctggattcacttcccctggaaagtttctgcccatgaagccccaaaggcagaggagagtgaagagtgaatgccacagctgggtctaggggctctgccaaagatgcccacag

SEQ ID NO: 9417 - DNA, 384 bp, Homo sapiens
atccactcctctgcagggaatatggaaatctttccctcatttatggctaattaggcagtatagcctcattaatcatgggatgacagtacagtgtggtggaaagaggatgctgtggagccacacaaacagggttcagagcccagctttcctgccctaatggtggcactgtgcaggtcagccctgttgtctgtaaaatgggtgtaacacagactaatgtgcagggtgggtgcagggttagagaaaacttacatgacaggcaaagcagcgtactttgctcatagaactcaataaactgttcctctgtaattattattaataaacattattgcagagtatgggcacagtggctcatacctgtaatctcaacattttgggaggccgagg

SEQ ID NO: 9418 - DNA, 383 bp, Homo sapiens
gggaggaggatcccgtcctcatgggtgcgggagcaacgtggcgtgggagtgatcgttctgggggagagggggcagaagagagcgcgaggcgagcccggggccaggggcgcagggaatagtggctttggagctagcgctctgccgaccagacagtaggacacatgctggtttcgcctactgagatggcttcccacccgtaacctgcttggagattcttgacactgcctgcccctctgacatcgctgccctgagatggctctatagagccagaggactggacaggacctgcctcccgctcgtttggttccggcctcaggcttaggacaatggggtgttcctagcacccgagcgggcctcctggtcacagtgcgccttttaggtgg

SEQ ID NO: 9419 - DNA, 387 bp, Homo sapiens
  misc_feature 263: n = A,T,C or G
gccgctccccagcaggacagggtaaccgccgaggtggggggcttcttgtccgtcccagcccccccaactcaggccctctcgctgcccctggcgaccaccgcgtgcgcccttccccagggcgggcgcagtcctggacgcctccgccgagcgtgactgcgtgcattttctctcctttcccttcccaacctgcggagagaagacagccccagagccgtgtctccatcctctgctgatgcctgctgtctttatgttggcctcgtcgnccgcactgcagtgtggcaggggcgtccctcgtttcccgcggactgaggtgggcgccgggcattcagtaaacgaagaaaccaaagcggagaaggttgggaatcaaacgtctgtcatacctgccac

SEQ ID NO: 9420 - DNA, 401 bp, Homo sapiens
tcagatccgaggacatgttgacgtcgtccgagagtcttaaaatcctgctgtggccggattccagactcgtgggggaaaggctggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaatccctaccctc

SEQ ID NO: 9421 - DNA, 382 bp, Homo sapiens
ccacccccgattcctgaccatgccccctatcttgtgatttcagacttgggagagcaaaagggaggggaagaaaataagagtaatggggggaggaaggaatgcatgggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctccaggccctggctgtttaccatgtcactgcctactgtgacttcatgcccttttgggataaagaacacaaaacgcatggaacaactatccatggctcttagccagaaatgtcttgc

SEQ ID NO: 9422 - DNA, 381 bp, Homo sapiens
cagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaaggggcagtgagcttggccctcagtccaccccctccgcctcctggcctccgccctgcctgtgtctggggcctgggggcttctcccctcgctgctgcaccctggcttccagcgtctgtgtccctgcctacgtgccccttccaggctcctggggccc

SEQ ID NO: 9423 - DNA, 387 bp, Homo sapiens
  misc_feature 382: n = A,T,C or G
gcgagactctgtctcgaaaaaaaaaatcaccaggctggcttacaaaggatggggtttttttactgtcgtttccagagatgtgattctggaggtcaaggcagggcccagggacacacaggtttaataggcccatgggggttctgtgcagtgcctcgggtcacacctggagaaccgttgctctgattggtatttctccacccgggctgtgcgttagaatcaagaagaagcgttgagatattgggatgcctgggtcctgctcccatgctgggcttctggtttacttgggatgagattgcatccagacagagttttaaaagtttcccggttgagtttaatgtacagttgaagttgagacatgaatctctgcatgtaggggaaattntgtgt

SEQ ID NO: 9424 - DNA, 387 bp, Homo sapiens
  misc_feature 383: n = A,T,C or G
attcccaatttcacaaattcctcatgtctttgagatttgatcagtttgtgaatattttatgctttgatgatatagtgagaatgcatcacttgcaaaaacgatctcaaaagtgtcagccttagataaacgttcagcattaaaaacgcctattatttcatttactagcattttaggatccagaagaattccaccagattgcatgagttagattgggaaatgggagtgggagataatattggaggtatctattttaagtcaggggctttactagccgatttagttctcacaataaccatgtggagaagctgtgacatttttaatttacaacctttctggggctcagacataaagttacctatccaagggtgcagttgggtagtggnggga

SEQ ID NO: 9425 - DNA, 391 bp, Homo sapiens
ggaaaatctgttttataattccctaaagctacaattacatgcaaactggattcttgaaataaaacacaattgaatttaaatgacatctacatgaaacccaataactcgattacattgttttaatgttcttaatgtggtcaaaggcagcccatggctttatcatcaattaggtaagcttttgagggaaattctgaaaaatggcaagtcctcacgtgtggactgacaactgagcaatttgcctgctgtgcttcagaaagagaggccagctctgtgaggtgctgtcgaaatgactgaaaaccacccactgcggatttctacttccctctatgaaaaccagccttctcagggattatcaccgccaataagaagggaaaattgcctgcacagttgg

SEQ ID NO: 9426 - DNA, 392 bp, Homo sapiens
cccagtccacaatcacataaggagtttgaagaattgttaaatgtaagaactagccccaaagtccaaataactgcatcaggggagttgggaaaattgtttttcaaaaagattttgtggtgcagtacttattttgaattagacaaaaattaagaaagacatggtaatttttgctagtgaaattctaaaatgtatacataaaagtgttgaatttttaataacttgatttccacatctgaattattcctatgctgtttaaaacaggtcatttcggtgactttctcaagggctgtgaaggctttgtacatagataactagaccaaaaccaacaagctgtagtatgaaatgtactgtcactctcattatccagatatttatttacaactatttaatga

SEQ ID NO: 9427 - DNA, 386 bp, Homo sapiens
ctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctcctgatccctcccca

SEQ ID NO: 9428 - DNA, 376 bp, Homo sapiens
ggtttactttacacatttttgattcagtccttaaccccctgctattttttccttctcagcttctctgagctgtccttcctttccatctcaacaaattccttgtccacaccaaggttaattttgccccatctgtggttagttaactcacaaatgatcttttacagcttcttccccctggagctgctggtgttttttattttcagcctttaaaaaaatgttacagagtggagtgctctgcccactccccaccccacaacctgctgtggcacctctggatgggcagagggtcttgtgtggtctgtctcacctcctgtggactcgtgactcaggctgtcccctcaactgatcaaccaagacaatctttttttcctgtcaa

SEQ ID NO: 9429 - DNA, 376 bp, Homo sapiens
ggctgctccagcagcttggattcagagtgagaaggcataaaggagaatccccagctgacttgtgcagtggttaattgaaattattcaggcaagagatgatggtgtcttggaccaggggatgaggaaggctacaaaatgtgtctacctgtattctgtgaggagaacgtgttccctggttttagatactgtgaagatggatcaggagagagtttatctagactgttggggaagggtgttgcgattccttcagctacacaggattgaaaggagacatttctgaaggggaaaaaggaaatgaaagaaaagatgtttcagattgaggatatgctgtgtggtgaacttgttcttcactctgtagggttcacaaatgactctt

SEQ ID NO: 9430 - DNA, 392 bp, Homo sapiens
tccgttggaccttctctgacttcagggtgagtcgtgaggtaggagaggcccgggtttagcgatgagaccagtatgaaacggagggccacgggagggcccgaggggagcaggcgacgctcagctatgggttaccttctctttgggaccgatgggtgctggggaggatcccccatttgcattttagccgcaccccctgagccgtctccgttcgaccctgggatcctccagatcccagattcttaggaaggaccttggagatcagctggaccagcccctgacttgcctggtttcggaagcggaaacccagcggtgcccttagctgtcaaggatgctgtgggaagagtggagcctcgaacccgagacgctagacccaatttggtgcccatgggagg

SEQ ID NO: 9431 - DNA, 387 bp, Homo sapiens
acagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaatcatacctcagctcatgtcagagtgcgaatatgtctctgagaagctagaggcggcagagagagacaatcaaaacctggaagacaaagtgcgttccttaaagacagacattgaggagagcaaataccgacagcgcccctgaaggtggagttgaagac

SEQ ID NO: 9432 - DNA, 380 bp, Homo sapiens
  misc_feature 167, 179, 188, 193, 205, 207, 212, 216, 218, 222, 225, 226,229, 234, 243, 246, 249, 250, 252, 253, 254, 257, 260, 264,271, 272, 273, 276, 288, 302, 306, 312, 316, 317, 318, 322,325, 326, 329, 331, 332, 335, 339, 343, 344, 346, 357: n = A,T,C or G
  misc_feature 358, 361, 365, 366, 367, 370: n = A,T,C or G
aatcccttctgcagcacctggatcgcttttccgagcttctggcggtctcaagcactacctacgtcagcacctgggaccccgccaccgtgcgccgggccttgcagtgggcgcgctacctgcgccacatccatcggcccatttgcgtcattgcccatttgcgtcattgncccaaacctttntttgcccanaatcngtgctttatgcnanaaatntgtnantggnttnnatnattanaaagaccanttngcnngnnntanttntttngtaagtnnncgntcttctttccanttttaaatgccttnttanatctgngtannntaanttnncantnntantatnttgnnanaaaaggagttnnacngaannnaantccccataat

SEQ ID NO: 9433 - DNA, 458 bp, Homo sapiens
  misc_feature 9, 18: n = A,T,C or G
tgccccctnttgaaagcncttggtctttttgcaggaacccatcgattcgtccggaagtccaacaggggagggagagtggaggaaggaggcgtctcaacatctggaaccatatttccatcagatgtgtttctcaagcactctgccactcctttctacctctcctgcgtttgatctgaggacggcccgttccacaggaacacaaaggcacagaagatgaagtaacttgcccacggccacacggttgacaccatgaaggctgaacaaaggatatctgggggcaaaatctgacccatgggctgcccattgccacctctgggcagccctccttgatggtgtggagtccgcggtccgcattggttaacctaactgtgcttcctcagatcagtctggaattaattattgaattgtatgcattttcaatgccatcctcaagctaacagccaactatgcgggggaat

SEQ ID NO: 9434 - DNA, 462 bp, Homo sapiens
tttatacaagctcttgttctttttgcaggatcccatcgattcgaaaacctaaaagaaagcgaatgaatttgacacctgttggttggatgacagaccacacagagggagagtgaccaggctttgcttgtggagcgggcatccctgcctagctatctccttcatgtgcaaggacagtataagtagtattttgcatgtgagtaaacacacctgcgcagccctggctgaggtcactaggctggccagaggcaggacaggcagtcttgaatttcctctaggggaggcctgcagttttccccaccaaccccttttcacatgctccaaagatgtagtagtgtctgctgttttggatcgaaaatcaccttgagtggaggaagtgacttcactgggtctctggaggctctcggagcttgagtggctctgcccaccctgaatcatgcacccataaatgcaggtatgggtgga

SEQ ID NO: 9435 - DNA, 437 bp, Homo sapiens
  misc_feature 13, 15, 16, 18: n = A,T,C or G
tagaccctccctngnncnttttgcaggatcccatcgattcgcttctttccaaaacccttctttgttctagatagctgtgctgttagtgactgccctagccctgcttttgtgctgacagaggctgccccagcaggcctcttccctcctttcagagggaactttctgttgggtgcagctgactctggctagaggccttttctctcctgcttgcctgagtcctctcaagactctgtcactctgctgtgcactgctccgttcccgttccacatgcctccctgcaaagaaccccagtaaggagaaacttacaacaatggggcaggcgctgatcaggaccagcaagattcagagtcagagcactgaggcagggcttgaaatgtctgacatcatcacacagtcccacttccccgtggctcctccagatctttagatgtttaggt

SEQ ID NO: 9436 - DNA, 425 bp, Homo sapiens
ccccagaactggagcacaataagttaaatcatttacctgtctcacttcttcttggcgtgcttaaaagcaaaaatgattcgctacttcctgtccttcagtccgggcatttggggtgccactgaagactggggttatctgctgaggtttgggtgtcttgcaggaagtatctcattgcagttgattttgatgaaaccaaacagtaactagggtccatgcagaccgtgactccctgattacatctagccatgccctacttatttcagagagaaagagagggggaataaaggcagtattgccacactgattagaagcacattcattccactttgatgttgaatatttttgaccgatacatgcttgagtatctttttaatagagcacatgaaggaagaagcacacaatatagagaaggaattgagaatgcc

SEQ ID NO: 9437 - DNA, 387 bp, Homo sapiens
cattcttaaggaatacacttatcttttttctttaaaaaaagtttttcttctgctatttaaaaaaatgtttctgagtataaccaaaaataggtatttgtttccttggttttcttttcttcttctttaactaagtagttcaaagaacaacacaacagaaaagagtaacaaaaagtcacaagaacataacccttaacacaccttgtataaaaatagcttccggccatggctgctgacagtggatgctcccctgtcgaggggtggatcaggctggctgggtgcctgaggctggggcgcctctgcaggggacacccacaccccctcaccctcccacacacccatcccacacatggtacattccaagggcccgggcctgcaggacaggaagca

SEQ ID NO: 9438 - DNA, 401 bp, Homo sapiens
  misc_feature 391: n = A,T,C or G
aatatgtcctccatacattttatcgaacattattaattaataaacaacagataaataacaacagtgctttgtttgattaaattatatatatgattatatttcttcagtgaaattgttggttatgcatttcttacaaataattcacaaatattaatgaatgtctgtgttgcagcaggcattttgctcaccacggtggacctgggggtatgtgaaataggcaccatctctgctctcacaaatttaatacgtgcaggctgctggattggactaaagtcctgaggagaactataacaatctcttagagggaacagtgattaaacagggatcaattgtgccacccatatagccttcctacttactgatcaagaatgataagcagaccttagcaagngccaatcaac

SEQ ID NO: 9439 - DNA, 375 bp, Homo sapiens
ggcagggggaggtgagggaggttttttgctttctttgctttttatttttattttttaatatggctgggaatgcagaaattttaaaaatggatacatttgagtgtgttaaaagtaaaaacttctcttggacaaaacataaactgctaaccgcaacgggggagaagatatttgccgcacatgtaaataacagagactgttctacagcaccaggaggaattctgactgccaatgggtgaagacgaggcacccagggaaataaaggggcagggatggggcagccctccacgcagaggagacgcctgagaatgcgcacattcactggttgtctatctctagacaacagcagatgcctcttcacaccaatcgatggcaccc

SEQ ID NO: 9440 - DNA, 398 bp, Homo sapiens
gccgccgccgcgctcgctccccgcgctggcttcaggagcgacccggccgaaatgaagttgaaaatagcacaggagcccactatcactgtgtgaacattttgtgaatgaagacatgtatgaaaggatgtttggaggcttcaagaaacgaaagccgagagtctagctagaccagagccatccagcccaggagcgatggccacgtgtggccgctggacaagagagacgtggccagtccaaactgtgcagtgcggggcagtggaagccgttggagggcctcaggcaggaacacaaggtgtcgtggcagaaaggaagaaggggccgggcacggtggcccacacccatcatcccagcactttgggagggaggccaaggcaggaggatcgcttcaatccaggagt

SEQ ID NO: 9441 - DNA, 389 bp, Homo sapiens
aaaatggggtgccagtgtcctcagactagaatgttctagtatcttggggtaggaatgagagaatataagcctgaatgccagcattatgggagccaaggagagttgggatgccccattcaatatatagactttcattcaagacccatcttcagccaggcacgatggctcacacctgtaatcccaacactttgggaagttggaagattacttgagcccaggagttcgagactacctgggcaatgtggtgagacctcatctctacaaaaaaaaatttaaaagaattagtcgggcatagtagtacatgcctcttgtcccagctactgagcaggctgaggtgggaggatcacttgagcccaggaaatcaaggctgcagtgagctatgatggcat

SEQ ID NO: 9442 - DNA, 243 bp, Homo sapiens
  misc_feature 130, 134, 136, 141, 142, 146, 147, 148, 149, 150, 153, 173,175, 180, 182, 189, 192, 193, 200, 205, 213, 215, 216, 219,222, 224, 225: n = A,T,C or G
gagagagagagagagagagagagagagagagagagagagagagagagagagagagagagagagagagagagagagagagagagagagagagagagagagagagagagagagagagagagagagagagagnggcncnccccnngcgnnnnnttntctctctctcaccccccccncnctctntnttttttntcnntctctcnctctntgtgcgcncnnttnggngnncccctttttttttttttt

SEQ ID NO: 9443 - DNA, 429 bp, Homo sapiens
cttaaaagaaaatgctattctgggagctccaacctgcaattaacctacagaaggaaccttttgagaggctggtgcagcgcttcggggaggcagattaagaactgacctagaaacagaagtgaagtttgaagtctgctctctgcaaagagggtgggagtgggtggagaagaggcttgttttaaaagccaaaaacagaaagtaaaaagaaatgggaaagtaaaaccaaagcagcaagtgactctcttctgatgtgcacttttcatttttctcccccacatttcagtgttagaaagaaaacgagaggagctagggaaagaaggagttggggacagaagactaagatttcaacgtgaaattccatttacaaaggctttactgcaaacaatagctaatttagtcctgtaaacatgcatttatcatacattttaa

SEQ ID NO: 9444 - DNA, 469 bp, Homo sapiens
  misc_feature 13, 17, 21, 32, 450: n = A,T,C or G
cccccctttgaancccnccgnaaacttcttanacaagcccttggtctttttgcaggatcccatcgattcgggcaagcccaccaaggggcctatggctgcaggggccatgggtacggggcttgctcaggagagggaggtgggtgctggagtcttctgagcctcactttgccctttggcaggctcctgggaagcagccacagaaatgaagcctgttccccaggagccccagggatggggacagaccccgtcctccctttgaggagctcccaggttagaggagaaggcagctctgtggacagacaaggattcggtcgggggcaccagggctgtgatcaggaggtgccggagaatcggggattggaagcagagagattcttggcagttgaagcaaaagtcggatctttggtttcagatgttaaaagcaacatgcattgcttgtttctggtctanaaatactacattcgcattt

SEQ ID NO: 9445 - DNA, 377 bp, Homo sapiens
cctagctaccgctcactggatatcactccaggcaagaatagcaggaaaaaagggagtgtggagaggcgctcggagaaagacagctctcatagtggaaggagtgtggtcatttagtcaccaagcacagcacaacttctgtggctacttctcggctcctgtgtgtcatcagcatcacctaggtttccagctgacttgggaactgcaagtctgagtctaacagttttggcttagattctgagaatcaaatagaagaattttaaatacaagagtttgagattgggtatagtggctcacacctgtaatcacagcactttgggaggctaagaatcacttgagactaggagttcaagatcagcctgggaaacatagtgagaccc

SEQ ID NO: 9446 - DNA, 382 bp, Homo sapiens
ggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggc

SEQ ID NO: 9447 - DNA, 187 bp, Homo sapiens
  misc_feature 6, 7, 8, 9, 10, 12, 13, 14, 15, 16, 20, 24, 28, 29, 40, 50,57: n = A,T,C or G
ggcccnnnnngnnnnnaacngccnactnnctaagagaccncttcgaaaanccaggancccatcgattcgcagtattagagccaccgcgcccagttgtgcatttctggtttctaagaatcaaaccacttggctgtttttaggagttacttcccatgttataaagctgaggaagctttttttttttttt

SEQ ID NO: 9448 - DNA, 468 bp, Homo sapiens
  misc_feature 5, 6, 7, 8, 15, 17, 25, 27, 33: n = A,T,C or G
ggcgnnnntctgacncngtaaaccngntcttgntctttttgcaggatcccatcgattcgcatgagatgttttgatataggcatgcaatgcgtagtgatgatatcatggaaaacggggtatccatcttctcaactagttatcctttgtgttgtaaacaatccagttaccaacccaacctggaaattgagtaccagtaatataggcagttatccacgtggctctttgaaacgtggtcgctaagctgtgcatgtttgcaaacgtggaagctgttgtgtagatgatgttcactcccgtgaatatgcagctgtgatgtggccaacagaagggaaggaacacgcctgtgtgctctacgtcttctgcaagccggcacagctccatgcgggaccagtgctgatgccagagtgaggtgtgggggctgtggcctgtgtctgccgcacgtggtggcattctagcaaagccacgtgggtg

SEQ ID NO: 9449 - DNA, 459 bp, Homo sapiens
  misc_feature 5, 8, 15, 26, 27: n = A,T,C or G
tctgnaanccttacngaaactcttcnnacaagcccttgttctttttgcaggatcccatcgattcgcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgct

SEQ ID NO: 9450 - DNA, 181 bp, Homo sapiens
  misc_feature 11, 15, 25: n = A,T,C or G
gaaacccttgnacgnaaactcttanacaagcccttgttctttttgcaggatcccatcgattcgcagtattagagccaccgcgcccagttgtgcatttctggtttctaagaatcaaaccacttggctgtttttaggagttacttcccatgttataaagctgaggaagctttttttttttttt

SEQ ID NO: 9451 - DNA, 479 bp, Homo sapiens
  misc_feature 15: n = A,T,C or G
ttgaaacctccttgntctttttgcaggatcccatcgattcgcttctcctttgtctctggtttggcaatcggagctttcagggcacagtgtttgtctccagatgttgatggaagtgggcactccttggtggcctccaacaggaaaagcgtgttctttcattgtttcctatacacacagacaaccgtttttccaggaaggcagccccatctttagtcattgactgcgggcctatcatcagtcatgacgaagaccgagtgaggtgtgtgcaggcccagaactagcacatcacagccccagagtgggctccaaaccggtagaccagagagcctgcaggataatttcccccttaagatgggtagatttactgttccacagccaacaggtggatacgcgtaactagaacaatctgtcatgggactaagtggaagaatccatcagcactacacagcatcttttcttcaaatacaactgtaaatctc

SEQ ID NO: 9452 - DNA, 377 bp, Homo sapiens
gattgaatcctggaacctcaccatcttccctattacgtatacttctctattatgtatacatcaccatcttccctattatgtatacatcaccatcttccctattatgtatacttctgttatgtatacttcaccaccttccctattatgtatacttccctattatgtatacttcaccatcttccctattatgtatacttccctattatgtatacttcaccatcttccctattatgtatacttctctattatgtatacttctctattatgtatacttcaccatcttccctattatgtatacatcagttttcaaatattaaacccaccttacatttctaggataaaccctacattattattattattattattttcccaat

SEQ ID NO: 9453 - DNA, 391 bp, Homo sapiens
ttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggtgac

SEQ ID NO: 9454 - DNA, 388 bp, Homo sapiens
agaggttcattaagcatctaatttttcatattaaatccctttctgctaaaaccagcaagagtgttctgttatctgtaactaatcttgatgcacacatcatggggacactgggtcacagggtttgataagtggtagaagaagggggaaagaagtttgtgcacatttcagagacaagaggaaaaggaaaagcagagatttcctgtgagtgcaaaggcctgtctaggcaaagatgcccctgcccaccttgggccatttacaaggaaaacacttacaaacccagcagtagaaaaccatatcaatacattcccaaacaattactacagtcagcagagatgacatcattctccttcccatcagaacaataagcctggctctaactctataaaca

SEQ ID NO: 9455 - DNA, 453 bp, Homo sapiens
  misc_feature 11, 23, 31: n = A,T,C or G
tttgaactctnaatacaagcttntggttccntttgcaggatcccatcgattcgtgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctggtgctgatcctggtcggcgtgggactggaggcgaccccctctccaggtgtctccagcgccatcttcttcgtgccgggcttcctgttgttggtgcctggagt

SEQ ID NO: 9456 - DNA, 378 bp, Homo sapiens
  misc_feature 342: n = A,T,C or G
agtgtccctgccaaattcatgtccactggaacctcagcgtgtgacttagctgaaaacagggccctgccatctcatactgtcctcctcggtcacactggctggaggcaaagccctctcccctgtttccggaaatctccaaccctgtgcaccttttatcagtcttcacttgggtggatttttctgttctctagagctcaactccaaccgcccatttgccaaaaggcaattgagagctgttctggcagccgaggctcctccctctcctgctggaggtccagggtctgtgggtgtacagaggggcagcctggcgagggcagggactctggatcttttgtcctctgngtgccccaggacctaaacccggcctgacagtaggtg

SEQ ID NO: 9457 - DNA, 414 bp, Homo sapiens
  misc_feature 360, 361, 367, 368: n = A,T,C or G
ggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttagacatggggtctcactgctgttgccgaggctgaaatgcanngcacanncacagctcaccacagcctcgaacttctgcctcaacaatcctcttgc

SEQ ID NO: 9458 - DNA, 458 bp, Homo sapiens
  misc_feature 15: n = A,T,C or G
ttctgactcatatcnagctacttgttctttttgcaggatcccatcgattcgagcaagaagcagagtgagagaggtggggagaattcaagatgatgttagagagatgacagagtctaggttagggagggcctgagtccttgtagactctgagtacggtgctgagcagggaagagacaggctctggcttagggtttagaaggaacacaggctactgcgatgaggattgtctgaaggggaacaaaggccaaggtggggagaccacttagaactctactgctctactttaggtgaaatgttagaactgggtgagccgaaaacatgctcagcatctgtgaggagggggcacagagggagcaaggatggatccagggtttttagtctgatcaactgaaagtctggaacagccattacttaaaataaggaagtctaagggaagaagagatttaggggagaatatc

SEQ ID NO: 9459 - DNA, 387 bp, Homo sapiens
  misc_feature 364: n = A,T,C or G
gtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcangttcaaggcccaagcattgatgc

SEQ ID NO: 9460 - DNA, 394 bp, Homo sapiens
tgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggc

SEQ ID NO: 9461 - DNA, 453 bp, Homo sapiens
  misc_feature 7, 8, 12, 13, 426: n = A,T,C or G
tatgagnnatgnnaccttcaaacaagctacttgttctttttgcaggatcccatcgattcgccagctcatactttccttcgctgtccctcccgcactccttaggcaagatttcccagtaaagattttctgtgcgtattttaaaagtcgtgttaatactcatgataattattagggacctggcagcgtgattggagtatggatgtttccgtaaaagctggaattccgtaaaagcattgacgcagcccctacactccatcccaaccaagaaactgcatttcctggggccaggtgggagctgcctttgccccactgcctcccctgttctgctctctcagtcaacatgtggaaatccaaggaggacaaagactccagccacgctgctaaatagggctcctctctcctctctctctctctaggtggtaaggntggggattaagtccaggtacagaacaa

SEQ ID NO: 9462 - DNA, 462 bp, Homo sapiens
  misc_feature 7, 16, 23: n = A,T,C or G
attgaanccctattgnaaccttnaaacaagctacttgttctttttgcaggatcccatcgattcgcaagaatctgctcttagtagccctgtgcctgaccttcggggtggaggtgggctttaagttcgccaccaagaccgtcatctacctgctcaacccctgtcacctggtcaccatgatgcatatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgctt

SEQ ID NO: 9463 - DNA, 457 bp, Homo sapiens
  misc_feature 21: n = A,T,C or G
tgaatccataatacaagcttnttgttctttttgcaggatcccatcgattcgcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggacc

SEQ ID NO: 9464 - DNA, 463 bp, Homo sapiens
  misc_feature 11, 374, 426: n = A,T,C or G
ccccctttggnaacccttaaacaagctacttggtctttttgcaggatcccatcgattcgtgcctatctcccacccctcgtttcctcacaaagcaagccatagagactagaattcctctttctcaacctaaaaaatacgtctgtaactttcccctgcctttctgtgtaagatctggccatcaagacattttttgacctaccttccctcattccaggaagggtcctgtcctgtacccgggaggaagaaatgctacacagagaagccaagatgaatctgaacagacagcctttgtcagttccacagattccataaaagttaactccagagcagagaatgatgccacagtcgggataacatccaatatttgcaatcanaagaaatatgagagtcttgtccatcacccaggctgcagtgcagtggcacgancttggctcactgcaagcttcacctcccgggttcacgc

SEQ ID NO: 9465 - DNA, 444 bp, Homo sapiens
  misc_feature 6, 13: n = A,T,C or G
tttggnactctanaatacaagctacttgttctttttgcaggatcccatcgattcgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatga

SEQ ID NO: 9466 - DNA, 456 bp, Homo sapiens
  misc_feature 8, 13, 14, 15, 17, 18, 25: n = A,T,C or G
tctgaaanccttnnngnnacccttnaatacaagctacttgttctttttgcaggatcccatcgattcggctatttacttcccttatctttgggatctgacactaactctgcaacttactgtttctgtaccccattttcttacctaaaaggaggttaataatatgactcatctcacaaacttgttgcgaagactgaataagataaagcgtgcaaagtcttaagaagaagacatggcatttagtaactaataaaaaatgtcacctctctcagtatcattattaccttagaaaaagtccttctcattttcatcagaggccaggcacatagttagggttcaaaatgcagttgacaaactgactgaattagcatagtctttaaaaactggaccctggaaccatatcccctgtttgtccttccctgccccatgggtaagcaaatatctccactgcctgggcta

SEQ ID NO: 9467 - DNA, 458 bp, Homo sapiens
  misc_feature 5, 171, 172, 177, 178, 184, 193, 195, 203, 207, 213, 215,219, 230, 231, 232, 234, 236, 244, 245, 250, 253, 258, 263,268, 269, 272, 276, 278, 281, 284, 287, 288, 291, 296, 301,305, 306, 313, 315, 316, 320, 327, 328, 333, 335, 338: n = A,T,C or G
  misc_feature 339, 340, 343, 348, 353, 356, 360, 365, 367, 369, 376, 378,385, 389, 392, 395, 397, 402, 403, 409, 416, 419, 446, 452: n = A,T,C or G
tctanaatacaagctacttgttctttttgcaggatcccatcgattcgctcaggaggctgaggtaggagaattgcttgaacccaggagacagaggctgcattgagccaagatcacaccactgcactccagcctgggcagcagagcaagactccatctcaaaaaaaaaaaaannaaaannaaaaanagggttatncnttcatttntggngggggnanaaanaaaccttgttnnntntnaaaggggnnaaggnggnagggnccttnaaacnnttntttncnaanctntcnnggnggttnccagnaccnntactgtncnnaaangggttcnnttttnanctnnntcngtttngtaancanccancccantngnggggatntnaaagggncttnagnacntntaccnntggggnggccccnttncccaaatagttaaaaaaaaaattgttntggcancctgtt

SEQ ID NO: 9468 - DNA, 475 bp, Homo sapiens
  misc_feature 5, 6, 16, 23, 395: n = A,T,C or G
ttggnnccctttttgnactctanaatacaagctacttgttctttttgcaggatcccatcgattcgctgacctctgtgagctcagtctgctctatgctgagctggaggtggagctgtcgccagaagtgagaagggctgccacagctcgagctgttcacatattaaccaagctgactgagagcagcccctatgggccctacactggacaggtgttggctgttcacattttgaaagcgcgaaaggcttatgagcacgcactgcaggactgtttgggtgacagctgtgtctccaatccagctcccaccgattcctgtagccgcctaattagcctggctaaatgcttcatgctcttccagtatttgaccatagggattgatgctgctgtgcagatatacnaaacaggtgtttgcaaaactgaacagttctgttttcccagaagctctggcgagggggacagtgccagctcccaaagttgg

SEQ ID NO: 9469 - DNA, 451 bp, Homo sapiens
  misc_feature 6, 13, 20: n = A,T,C or G
accccntttgggnactctanaatacaagctacttgttctttttgcaggatcccatcgattcgctgcaaatttagagcttacaagatgctaatggcacctcagtttccaggatagtctctgcagactgctttcactcagcaggcttcctttcatgatggctgccagtaacagctacccctcatttacatccagcagagatgaggggtatctcttcggggagttcatgcaaaaaaaagcaagaaaagctgaaatcttctcacttcaaaggaatggcacatgacagcacttagccaataaagcattctcttctgggactttgcaatgcaagcaaatgaaaccaggaacacatggcatttattcaccccagggagttgtccaaagcagactattgcagctagtctgcaatgagaccactgctgaggaaactactttctagcattctggagttatc

SEQ ID NO: 9470 - DNA, 461 bp, Homo sapiens
  misc_feature 5, 6, 7, 8, 9, 10, 11, 12, 13, 19, 26: n = A,T,C or G
ccttnnnnnnnnntttggnactctanaatacaagctacttgttctttttgcaggatcccatcgattcgttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgt

SEQ ID NO: 9471 - DNA, 474 bp, Homo sapiens
  misc_feature 6, 10, 14, 16, 23, 437: n = A,T,C or G
tttggncccntttngnactctanaatacaagctacttgttctttttgcaggatcccatcgattcgctggaatggtttcttcttacaatcagaatagttaggatgtaatatatttttgagtgggcatttaaagtgaaaaggtacatatttacatagacacaggtgataatgtatctatgtaaatgccttttgattctgcaactgcaggatactctcatcaaagacacagataaaaagcctctgtgtttccaaggccttgccctatacctaacacataatatgtccaaatggatgaagaggaggcaaggacaaggatgtgatgacaaaacattctgttatgcacttgtagcatttatgtttcttcctgggggattttataatactaaaagaatcataatataaagagatgattaaaaaaaaaatactgccgggcacggnggctcatgcctgtaatcccagcattttgggaggccga

SEQ ID NO: 9472 - DNA, 410 bp, Homo sapiens
  misc_feature 106, 109, 114, 117, 119, 125, 126, 136, 146, 150, 160, 167,179, 189, 191, 197, 204, 213, 219, 224, 225, 226, 227, 231,235, 240, 242, 248, 249, 250, 252, 257, 261, 279, 280, 282,283, 288, 297, 298, 307, 308, 309, 315, 323, 324, 326: n = A,T,C or G
  misc_feature 331, 334, 335, 339, 348, 358, 363, 364, 365, 369, 371, 373,374, 376, 380, 401: n = A,T,C or G
cccacatccagtcttctccataggacaacctgtctgctgaaaggggctacccactacaagactcctctcttctgaaagctggagactcctcaggatgatctgcccnttngaatnatngncccacnnatataatacnatgagagccnatgncgccgctcantcaacanaaatgtgcttcnaataaacccncnttatgngagtagntctgcttgnttcctngaggnnnnaacncganctatnanacctgnnnanctaanggantttaagatgcctgcctanncnnaagantggaggtgnnctttgttannntgacgnttcttttnntnatatnatnngacnaaattatangcaatgtttngggannntacnananngncacnacaaatgccttactttacaanccttttgtg

SEQ ID NO: 9473 - DNA, 466 bp, Homo sapiens
  misc_feature 9, 11, 113, 114, 130, 132, 134, 144, 153, 159, 163, 166,167, 168, 173, 175, 177, 179, 182, 185, 187, 188, 192, 196,203, 205, 206, 208, 218, 227, 235, 237, 239, 240, 242, 244,252, 254, 261, 263, 278, 279, 284, 285, 292, 293, 298: n = A,T,C or G
  misc_feature 307, 311, 314, 317, 318, 323, 329, 336, 341, 343, 344, 345,346, 347, 348, 350, 355, 366, 375, 376, 382, 387, 391, 392,394, 413, 419, 428, 430, 439, 441, 444, 445, 446, 447, 448,450, 452, 454, 457, 458, 459, 461: n = A,T,C or G
tttgaaccntntatacaagctacttgttctttttgcaggatcccatcgattcgaattggcacgagctgctgctcccttctgggttccgaggcccatttgcgtcattgccccanngagaggaagggaggtnangntatcgtccgnggccccagnagcccntttnccnnnttggncnangnccnaantnntttntatntcatatnanncnactatataangaataaacntgatcttntnanntntnaaattatnancatagtnanaggtaattacacatnntattnnaacaacnnttggnatctataanttgntcnttnntatantaatanttttttncattnannnnnntnatatnctaaaattttnaaatattanntatctntgatnggtnngnaatgcttacactttttgancttatntatgggaangnagggggtgncntcnnnnntntnanaannntntttcc

SEQ ID NO: 9474 - DNA, 387 bp, Homo sapiens
  misc_feature 334, 360, 361, 362, 382: n = A,T,C or G
cttcctctggaaatattcttctctttgacattttgggtagaaaatgaaaattcttgtattgtttactgtgttaaatgaagagctttaacaaaggctacaaagctgatgtgtcatatttcttttatatcttcttgaaagatgatgcaatactttgggcaaagcaataagaaaactgaagaaggatgaaacggttatcacttatttccttattaccgtcacttttagataaatccatcatgtttccattttctttggatttttttctttcttttacagtttacatgcattgtagaataataaagccgttcttttcaagaccttttataaatcctgntatcttgctggctggctcacattgannnctgggaaggccagcctgcantggct

SEQ ID NO: 9475 - DNA, 406 bp, Homo sapiens
ccgcctccgtcgcacagtcgggaggctttgcagtgaacttcgaccacttccagatccttcgggccattgggaagggcagctttggcaaggtgtgcattgtgcagaagcgggacacggagaagatgtacgccatgaagtacatgaacaagcagcagtgcatcgagcgcgacgaggtccgcaacgtcttccgggagctggagatcctgcaggagatcgagcacgtcttcctggtgaacctctggtactccttccaggacgaggaggacatgttcatggtcgtggacctgctactgggcggggacctgcgctaccacctgcagcagaacgtgcagttctccgaggacacagtgaggctgtacatctgcgagatggcactggctctggactacctgcgcggccagcacat

SEQ ID NO: 9476 - DNA, 391 bp, Homo sapiens
ccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactggctcaattcccctacatagttcacctggggcagcacaacctccagaaggaggagggctgtgagcagacccggacagccactgagtccttccccaccccggcttcaacaacagcctc

SEQ ID NO: 9477 - DNA, 399 bp, Homo sapiens
caccaacactgaggtgttgaggaacatgggctttgcagcaaaagcgatgaaatctgttcatgaaaacatggatctgaacaaaatagatgatttgatgcaagagatcacagagcaacaggatatcgcccaagaaatctcagaagcattttctcaacgggttggctttggtgatgactttgatgaggatgagttgatggcagaacttgaagaattggaacaagaggaattaaataagaagatgacaaatatccgccttccaaatgtgccttcctcttctctcccagcacagccaaatagaaaaccaggcatgtcgtccactgcacgtcgatcccgagcagcatcttcccagagggcagaagaagaggatgatgatatcaaacaattggcagcttgggctac

SEQ ID NO: 9478 - DNA, 465 bp, Homo sapiens
  misc_feature 8, 16, 21, 22, 23: n = A,T,C or G
atttgaanccttttgnaaccnnnaaacaagctacttgttctttttgcaggatcccatcgattcgtatctcaattgattgctcacagtcagttacagatttaaggccttgttccactctttctcctcttctcaccgccgcacttgactaatcttaaaaaaagagagagaaagattttgtgctcttttctgtatgtatgttatattttactttaaaagaaagtggaggggggtggctgcgatcatagccaccaggccacacatatgcaaattagagtcttcgagcaacaggtgattccaatatacaccctggccaatggctgagctagctagacaaaagcctttattttctttaaaaagattttggggccgaacaaggtggctcacgcctgtaatcccaacattttgggaggccaaggcgggtggatcgcttgagcccaggagttcaacatgggcaacatggcaaaa

SEQ ID NO: 9479 - DNA, 456 bp, Homo sapiens
  misc_feature 22, 23, 28, 33, 45, 46, 54, 346, 348, 429, 431: n = A,T,C or G
tcttgccccttatcaagctacnngaacncttgnacggcccttggnntttctgcnggatcccatcgattcgcttaagtgtaaaatgcaaaactataacattcccagaagaacacaggagaaaatctgtgtgatctggagtttggcaatgtatttttagatacaatacaaaaagcacacctcatgaaaacaattgatacatttgactttattaaagttaaaatcttctgcattgcaaaaaaactaagagaatgaaaatccaagtcataaactgggaaaaaaatgtttgcaaaatttatatctgataaagaacttgtatccaaaatatacaaagaactctttaaatccncnataagaagacaacccaatttaaaaataagcaaagatcttaataaacatctcaccagataagatatgcagatggaaaataancntgaaatgatgctcaacatcattagc

SEQ ID NO: 9480 - DNA, 455 bp, Homo sapiens
  misc_feature 7: n = A,T,C or G
ttggttnctatacacaagctcttgttctttttgcaggatcccatcgattcgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaagtatgagaagttttactcggagtgccaacctaattaggcaccaggcaactcacactcacacttttaaatgccttgaatatgaaaaaagctttaactgtagctcagatcttattgtcatcagagaattccatggaagagaaaccacatcagtggctg

SEQ ID NO: 9481 - DNA, 375 bp, Homo sapiens
gagagttgtaatggcccgactgttgagtgagggggagcaggggatcccaacggcttgcgctgcctttgcgcagcagccggcgggcggccacgtcgcggcctggctggggagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttaaacagt

SEQ ID NO: 9482 - DNA, 386 bp, Homo sapiens
cccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggccgattctacaggtcacggaaaaagcacttgatcaccacccag

SEQ ID NO: 9483 - DNA, 377 bp, Homo sapiens
gtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaac

SEQ ID NO: 9484 - DNA, 493 bp, Homo sapiens
  misc_feature 24, 456: n = A,T,C or G
tgaaccctacgttatctttctgtnaaagcccctcgggatttttgcaggatcccatcgattcgccgccgccggtgacctcggcggagatcatttggcatttagctgtgatgttgctaaagaacatgatgttcaaaatacatttgaagagctggagaaacatttaggtcgagtaaatttcttggtaaatgcagctggtattaacagggatggtcttttagtaagaacaaaaactgaagatatggtatctcagcttcatactaacctcttgggttccatgctgacctgtaaagctgccatgaggactatgattcaacaacagggagggtctattgttaatgtaggaagcattgttggcttaaaaggcaactctggccagtccgtttacagtgccagtaaaggaggattagttggattttcacgtgctcttgctaaagaggtagcaagaaagaaaattanagtgaatgtagttgcaccagtgcaatacttgtatgga

SEQ ID NO: 9485 - DNA, 384 bp, Homo sapiens
  misc_feature 140, 147, 170, 171, 173, 193, 200, 202, 215, 222, 227, 244,245, 246, 253, 273, 280, 281, 289, 296, 299, 301, 303, 306,308, 319, 323, 342, 344, 349, 361, 374, 378: n = A,T,C or G
gccgccgctggtgcttattcttttttagtgcagcgggagagagcgggagtgtgcgccgcgcgagagtgggaggcgaagggggaagtgttggaggtttttaaattcccctgcatttatatagtccctacccctatatgttncagatcnctcaggacctgtcaaacttaacnntncctactttcgatttgacctntactacncnactggagacctgnatgccanccgcnctgtcccatttgaactnnngcccaancatttttgagttttttaccnccctctnnctttcctnccccttncancntnctntntttctgtcccnccgnactttcccacctacttatntngattncattctgaaaanttttttcatgacnaaantctttc

SEQ ID NO: 9486 - DNA, 457 bp, Homo sapiens
  misc_feature 451: n = A,T,C or G
tctagaatacaagctcttgttcttcttgcaggatcccatcgattcggtccacccaatgatttggaatgtgccttgagcccatatgccttgtaatacaaactcgtctccctcccatttggaatagccaccaatcaagatttaatccggctggttgcatacacacaggatggagtgatgcatcccaggacaactttcctcatggtagatgaggaacagactgttccttttgccttgagggatgaaaacctgaaaggagtggtgtatacaacacgaccactacgagaagcagagacctaccgcatgagggtccgagcctcatcctacagtgccaatgggaccattgaatatcagaccacattcatagtttatatagctgtgtccgcctatccatactaaggaactctccaaagcctattccacatatttaaaccgcattaatcatggcaatcangcccct

SEQ ID NO: 9487 - DNA, 386 bp, Homo sapiens
gcggcttagtcggtggcggccggcggcggctgcgggctgagcggcgagtttccgatttaaagctgagctgcgaggaaaatggcggcgggaggttagccacccagtagagctactgagttccatcctggtactggggaatgtctatagagactcctgtgatgtgatccatcttcagatcttgcagccatgactactagcacctgctccaggtcccacgtgtttcaatggacatttgtctccatcatagccacatcacaccacagatttgatttttcagttcatttggtcaaatgccactcaaaacaagaaatgctaaaggagaagaagagtccagttcaagatctgcatttcatttctgatgttggcccaacaactttttctttcag

SEQ ID NO: 9488 - DNA, 401 bp, Homo sapiens
gtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggac

SEQ ID NO: 9489 - DNA, 377 bp, Homo sapiens
aaacaattgaaattggactggaaatggagtgggcgaagtaaatacacacgttaccagagtgttgagtttgggcactcttaacagtcattattactcagtgtttattgataaatcagacaaaattgccatcttagttttgagtgtctaaattaggtgataatggttattataatttggttattttgcatgactcaagctagtaagtaaatacactctgtaatctcaaccaattttttaatttgttaaatactatcattgtcaacatcttttttcatttgcttcagacttaatgaacaagccagtgaggagattttgaaagtagaacagaaatataacaaactccgccaaccattttttcagaagaggtcagaattgat

SEQ ID NO: 9490 - DNA, 368 bp, Homo sapiens
  misc_feature 144, 147, 149, 155, 156, 161, 164, 165, 172, 173, 174, 178,181, 203, 216, 223, 225, 226, 229, 231, 232, 235, 240, 242,257, 265, 268, 271, 272, 291, 295, 299, 314, 319, 325, 333,337, 351: n = A,T,C or G
tgggtcactgcccctcctgccagcggctcttcatggtcctgctcctcaagggcgtacctttcaccctcaccacggtggacacgcgcaggtccccggacgtgctgaaggacttcgcccccggttcgcagctgcccatttgcgtcnttngnacaaannatccnttnnccagatnnncaantanctgacattcatacggagtcaanacacgtttctgangactggntnntanannttncgttntntttaacagccattgngccctgantgnttnngagagcgtgaaaatttctntganctgntcagcatgaccggancaaantagagnatcaagancatncgatccaaattatncggctcctcatgcggtg

SEQ ID NO: 9491 - DNA, 389 bp, Homo sapiens
  misc_feature 381: n = A,T,C or G
gtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagatcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctnaaaaagtt

SEQ ID NO: 9492 - DNA, 386 bp, Homo sapiens
actgcctctctagattccacctctgtgggcagggcatatcggaacaaaaggcagcagccctagtcagggacttatagttaaaaccctcatccccctgggacagagcacctggggaaaggggcagctgtgggcacagcttctccagacttcaatgtccctgcctgacagctctgaagagagcagtggttctcccagcatggcattcaagctctgggacagactgcctcctcaagtgggtccctgaccgctgtgtagcctgactgggagacatctcccagtaggggccaacagacacctcatacaggagagttctggctggcatctggtgggcgcccctctgggacgaagcttccagaggaagtatcaggcagcaatatttgctgttt

SEQ ID NO: 9493 - DNA, 332 bp, Homo sapiens
  misc_feature 207, 208, 209, 210, 211, 220, 226, 230, 239, 241, 242, 243,245, 249, 250, 252, 253, 266, 269, 272, 275, 288, 297, 298,299, 301, 304, 308, 309, 310, 311, 312, 314, 315, 316, 317,319, 320, 322, 323: n = A,T,C or G
ccccctgaacctccctccctctgcctagacactggggtacccctccagatgtggggacattccaccccagtggggacagccattcccctacctgctccaggagcctggattggctttaaatggctcatcatcttccagcttcttaaacttagcgcctgttcccagactggagaccttgggatgggggaggtgtgggaggttttctcnnnnnctgactcanccactncctnggctgtggnannntnaggnngnnggctctggatcangcnccngancctgtgcaggttncccatttgnnnanttncccnnnnnannnnannanngacatgatg

SEQ ID NO: 9494 - DNA, 382 bp, Homo sapiens
  misc_feature 360: n = A,T,C or G
aggctctagcccaactcccaggtggtccattttggtccatattattttttttcatgcttttaactttgggtctcgattctcagtttgcttcgattgaaacgatcacaacaacaattcaagatttatttcccaaagtgatgaagaaaatgagggttcccataactttgggctgctgcttggttttgtttctccttggtctcgtctgtgtgactcaggctggaatttactgggttcatctgattgaccacttctgtgctggatggggcattttaattgcagctatactggagctagttggaatcatctggatttatggagggaacagattcattgaggatacagaaatgatgattggagcanagaggtggatattctgctatgg

SEQ ID NO: 9495 - DNA, 397 bp, Homo sapiens
agtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcggtgttggaagtgacagtgaggtggaaaagaggtctggactggt

SEQ ID NO: 9496 - DNA, 396 bp, Homo sapiens
gcaagaaggggctgactctgaaccaggaagctgtgctgtgctcaccagacactttgatcttggacttctcagcctccagaactgtgagaaagagatttctattatttataagccacccagtagatggtactttgttacagcagcctgaaaggactaagacaccgacctagtctccctgatgaaaaagtttctctcagacttctaccctttccaatgtggccaaagcttttcattccgaagaagtttcctttctgagaacgctcattgtgtcgtttggctttccccgtctctgcttgacacatgaaccaaaacagaggcagccaaagcagggaaaaaaaaatcctaggatcagagtccactctatgcccttttgagcttcaaaaggagaaagagaca

SEQ ID NO: 9497 - DNA, 369 bp, Homo sapiens
  misc_feature 115, 117, 120, 127, 135, 143, 150, 155, 157, 159, 161, 163,165, 169, 176, 178, 183, 187, 189, 190, 191, 209, 211, 217,218, 220, 221, 255, 260, 269, 292, 302, 307, 312, 315, 319,321, 329, 337, 340, 348, 363: n = A,T,C or G
cagtctcctgccggaagaaatgggttgagcccgaaaggaggctgtctgaggaagggagagggagggctggggttttccttcccctccctacaccatttccttcctggatcgcacncnggnaattctntctgcctncaattctntccaganccctntnantngncnccanacaaatnanccatntttncnnnctttccgacaacacattnanttctcnnanntgccaaacgcattgggaaagaccttaacaacacntttgnccatctgtngaaacttacaatcttgcaaaaancaagtacctnttttntgatnaancacngnaaattttncaccttanctnttcatcanaccggacattatctnccacac

SEQ ID NO: 9498 - DNA, 379 bp, Homo sapiens
ccagtcagcggggtggtctcctgggtccccagcctcgccattctgtggggggtggtgactgggcgaactctcagatgcctcagcaccctcccaccccttcctcaggcagaacgagatcttgtggcgggaggtggtgacacttcggcagagccacggcggggccgagcaatgcaggaggcaagagaaagctgtccctgatgctggatgaggggagctcatgcccaacacctgccaagttcaacacctgccctctacctggtgcccttctgcaggacccctacttcatccagtcgccctcacagggccaggggccccatcatctctgacatcccagaagactctccatcccctgaggggaccaggctttctccctccagtg

SEQ ID NO: 9499 - DNA, 389 bp, Homo sapiens
  misc_feature 374: n = A,T,C or G
ccagtcagcggggtggtctcctgggtccccagcctcgccattctgtggggggtggtgactgggcgaactctcagatgcctcagcaccctcccaccccttcctcaggcagaacgagatcttgtggcgggaggtggtgacacttcggcagagccacggcggggccgagcaatgcaggaggcaagagaaagctgtccctgatgctggatgaggggagctcatgcccaacacctgccaagttcaacacctgccctctacctggtgcccttctgcaggacccctacttcatccagtcgccctcacagggccaggggccccatcatctctgacatcccagaagactctccatcccctgaggggaccaggctttctccctncagtgatggcaggaa

SEQ ID NO: 9500 - DNA, 395 bp, Homo sapiens
  misc_feature 321, 322, 324, 325, 326, 328, 329, 330, 332, 334, 342, 376: n = A,T,C or G
agaaggctggataattggaggaggcagaaaattagtgcagagaagatggccaaattgcagtttctgaggtcatcagagaagatttgccagaggctttcgcttacccaagggaagtaatgttaaagggtcatgtgtttttctgaagcaaagtatcgcttttacagagaaatggctgctacctagggccagtgccttcacagtttggttatgctaagtagaagatacagatttgtaatgcctaaattctcacacttctaatcctacagtccaattattctggcatttgctacaatgtgctctgaagaaatggattggaaatanncnnncnnntnantaaataantaattccacaggaggaaaaaaatgcgttctgaanggatcaggattttcaaagc

SEQ ID NO: 9501 - DNA, 464 bp, Homo sapiens
  misc_feature 15, 16, 18, 21, 324, 326, 330, 331, 334, 342, 351, 353, 356,369, 370, 381, 391, 393, 394, 403, 410, 412, 413, 425, 429,430, 435, 437, 452: n = A,T,C or G
agaaccctttgaaanntntgnaacccataatacaagctacttgttctttttgcaggatcccatcgattcgagggagcgaagcagcgcgggcagcgagcgagatgcatcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccaacaccaaagattgcggcgtgggtttccgagagggcacctgcggggcccatttgcgtcattccccatagatatccttgcaantnaatnnggngtttgctnaaagcaatntnttnccaaaccctaganntgacccctcantgccctaatnanngcttgttcntggtgancnntctatgccctgnatanngcttntntttctttgcccaaanccaaaaaaaaaa

SEQ ID NO: 9502 - DNA, 446 bp, Homo sapiens
  misc_feature 7, 8, 11, 12, 22, 435, 442: n = A,T,C or G
atggagnnaannaaactcttantacaagctacttgttctttttgcaggatcccatcgattcgctcgggccccgatgtcccgacacggcggcgtcggctacagctccgggcggccacggccagaatgaaaacggccgcactgggacacgacctggacgggcaggacgcggatgaggatgccagcggctctggagggggacagcagtatgcagatgactggatggctggggctgtggctcccccagcccggcctcctcggcctccataccctcctagaagggatggttctgggggcaaaggaggaggtggcagtgcccgctacaaccagggccggagcaggagtgggggggcatctattggttttcacacccaaaccatcctcattctctccctctcagccctggccctgcttggacctcgataacgggggaggggnggcctgnatca

SEQ ID NO: 9503 - DNA, 394 bp, Homo sapiens
  misc_feature 377: n = A,T,C or G
gggcggtgttggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcngtgcgctgcaggaggct

SEQ ID NO: 9504 - DNA, 385 bp, Homo sapiens
gtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgat

SEQ ID NO: 9505 - DNA, 368 bp, Homo sapiens
gcaatttaaatcaaaattaaagcttgaatctctaaaactggctaacctcatctggaacatgtggctcccgcttgcacctaagatcaccttctccattgtctaccaggctagcgtgagccacacctgttcagttttccaactatcagctaagagaaagacttcattaatatttggaggatacaggccgggcacagtgtctcatacttgtaatcccagcactttgggaggctgaggcaggtggattgcttgaggccaggggttcaagacctgcctggcaaacacggtgaaaccccatatccacaaaaaatatgaaaattagccagacatggtggtttgtgcctgtaattccatcttcttgggaggctgag

SEQ ID NO: 9506 - DNA, 368 bp, Homo sapiens
  misc_feature 302, 306, 309, 311, 320, 334, 336, 350, 352, 354: n = A,T,C or G
gatcttctgaggtcaggagttcaagaccagcttggcccacagggcgaaactccatctctactaaaatataaaaaattagccaggcatggtagcaggtgcctgcaatcccagctgctcgggaggctgaggcaggagaatcacttgaacctgggaggcagaggttgcagtgagctgagatcgcgccaccgcactccaccctgggcgacacagcgagactctgtctcagaaaaagaaacctcccttgaattgaaacttcgatatgaaggttgcaacccttcctttttgttggtgtggcttggcanatcnttngngctcctggntgtatctcctgagncncttgtttcaaaacngncnttggtcggcacatg

SEQ ID NO: 9507 - DNA, 402 bp, Homo sapiens
  misc_feature 227, 235, 242, 247, 250, 259, 262, 269, 271, 274, 277, 286,291, 307, 317, 319, 322, 324, 337, 339, 351, 354, 357, 390,393: n = A,T,C or G
tagaccagcctgctcaacatggtgaaaccccatatctactaaaaatacaaaaaattagccaggcgtgttggtgcgcgcctgtatccccgttactcaggaggctgaggcaagagaatagcttgaacctaggaggcagaggttgcagtgagccaagattgcgccactgcactccaacctgagtgacagagcgagactccgtcccccctcccaaaaaacaaaaaaaaaangaagaaangaaaccngaaanttntttttttcntancaaagtncncanacnttttaagtngactnttgacaaacctagttnatgaacaatngnttntntatgtagcatttngntttttttattgncanagnaaaaaaaggcatatttccatgactactttaaanggnttttttttg

SEQ ID NO: 9508 - DNA, 383 bp, Homo sapiens
gggaaagtctaggagtaggactgtgttttccagtgaatggaaaacttcaaatgtgacttggcaatgcttttgagtagcacatgagcacctagtacttggaaaaactgagatacagctctgttcaacttcgagtgctcaacttcactaaatcacagtaatgagacctttgagataggagaaatctgtaacggagccacagaagaatactttttggaaagggctttccggtttgatccaggagtttatcagcattctggtacttcatgtatttgtcatttgtgcctttaagtaaatacacatctttatgtgtagtaccctcaaaactaacctatcaggagacttcctactgttagagatattgtagtttttctctgatgccttaa

SEQ ID NO: 9509 - DNA, 385 bp, Homo sapiens
gaataatacctcaataaagctgttataaaaatatacaattcagtggttcttagtacattcacagagttgtgcaaacatcacatctaattccagaacattttgatcactcctcccaaactccatagacaacacaattttaactaagattccaattgggatttctgtggaacttgatgagttagggccaaaagtaatcaagatattcatgaggaaggataacagaatggcaaaacttgctttaataatttgtgcagggatagacaaatactgtacaccagtctctcaatagggagatcaaaaccaaattcacacagacatgaaaagttgatttatgacagatgatgttgcagtccctggggaaagaatggaaatggtgctagaataa

SEQ ID NO: 9510 - DNA, 368 bp, Homo sapiens
  misc_feature 254, 256, 257, 260, 268, 278, 288, 290, 300, 310, 313, 314,315, 317, 319, 324, 328, 329, 331, 332, 333, 334, 342, 343,346, 348, 352, 353, 355, 362, 363: n = A,T,C or G
caaaaatatgtacaaattgacctctgttcttatttcctattgtgagcattataaagataagctcctatgtaaaaccttgctctcagatgagtaaaatatgtatcacagcatagctcagcaataattcatgctcagctgtggggaccctgggggctttttgaagatgatggaaccgcactagggttgaaactgatggctgtggagttaattgtgttttcgagcttgaatctcacctgtgattttttttttttaangnnggncatgactngatttttctnataagccaangnatttgtaggnttactggatntannntnanggagngggnntnnnncctttttnnccncngggnntnttttttnnggggg

SEQ ID NO: 9511 - DNA, 374 bp, Homo sapiens
  misc_feature 355: n = A,T,C or G
cttccaagtatctccagcccagaacccttttgagtccaggacctgtcattcatatccatcccagaacccttttgaacccaggacttgtcattcatatcagaccaccacgagcatttcactacagcctctgatggtcttccctgtttcctcacttttgcctattttttttcttttctattccctcttaagtgggccacacttttgttcccctacctgaaatcctgtagcaagtccctataggataggcatgtggtacagtgtgaagctcctgagtggtcaacagctaccccgtgacaacatgccacactccatgtgccactccctcccgctgctgctgtgtcttggcccagtggtntctcccggctgacagccgg

SEQ ID NO: 9512 - DNA, 439 bp, Homo sapiens
  misc_feature 417: n = A,T,C or G
cccatctctacaaaaaagtttaaaaaattagccaggcgtggtggtgcacctgtcgtcttagctacttgggaggctgaggtgggaggatcgcttgagcccggaagcttgaagctgcagtgagctgggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatctagggcgtttccactcccagcagccaggtccctcaccccaagctcacccactgttggggagattatctncataccccaaaaacacattggg

SEQ ID NO: 9513 - DNA, 372 bp, Homo sapiens
gttctctgagtctgtttggtcatgtgcagaaaggggttctaggcgcagctcagacgtagatggggacgcagatgtgagtacctaggtgagtctggctggtcacgtgtggaataagtggtggtggctgccattactctttaagcattcttggatctagtgcctcctctgccactgagtacagaattccttttcaaattcgggcttatgaggcatgttttgatccaggctgtcgtagcaagggatttgatgctggagtctgtgactgctgtgcgtgtggaggcttccggaaggcagccagtgctggttactgcttggagtttggggagctgccattttggattgcctacctcatgccttctgagaaacatctgt

SEQ ID NO: 9514 - DNA, 348 bp, Homo sapiens
tgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtca

SEQ ID NO: 9515 - DNA, 369 bp, Homo sapiens
gatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgctcgcacctccttggtgcaggcctggcctggctacacactggagactggcaacactcaatgccatg

SEQ ID NO: 9516 - DNA, 373 bp, Homo sapiens
  misc_feature 357, 363, 365: n = A,T,C or G
gccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgccgaaagcctgtgcgagatttaccccgtcttccgctccttccaccggaaaactctgaggacatgaataatcgcaggcttggcggntcttgntnttccaaag

SEQ ID NO: 9517 - DNA, 378 bp, Homo sapiens
  misc_feature 356, 371: n = A,T,C or G
gctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcanggccttgaaagcctnactggat

SEQ ID NO: 9518 - DNA, 381 bp, Homo sapiens
gccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgcattgaaaaattgagagaaaggacagaccaaaacgcttcagacgatgacatttt

SEQ ID NO: 9519 - DNA, 423 bp, Homo sapiens
  misc_feature 411: n = A,T,C or G
cattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcaactgtgccaggcacctgcttgaccattcgaaagtggntttttacaacaa

SEQ ID NO: 9520 - DNA, 409 bp, Homo sapiens
ccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgcggcacctaggccgagattggaggtggacacaaaggaagaggcagccagacagctacttcagcgtcctcaacgcattcatcgacaggaaggacagttactactccattcaccagatagcgcaaatgggag

SEQ ID NO: 9521 - DNA, 338 bp, Homo sapiens
ccttttcaaaacccgccccaagcccattatcaccaggagtgtgtttgacaaggactgcaaaaggtttctccaggtggatgattttcccatacaggatatgatgccccacgatcagcacagggattccctcagtggtgtaatgtaggtctcccaggaggtttccagctaatccagtgctgtagcgagcctcgatctccccctgtagctccatcagcacccattctgccaggcctccagccctcgcactggaaataacaatttgcaccatgagctttctgtctttaaaaagcaagtgaaaacaagctgcaatggcggccgcaggagtttttttttttttt

SEQ ID NO: 9522 - DNA, 280 bp, Homo sapiens
gcgccagtccacttgagaatggaggcaggcacctccttggaagggaataattaactttcacgttgcctaatcctgcatttctggtgttaatctagtggtaggtttatagctgaagctttctacttaagccgggtttaaaaacacgtccacaaaaggatattttcttataaaaccagagttggcccggcgcagtggctcacgcctgtaatcccagcacttgttcgagacaaacctggcgaacatggtgaaaccccgtctctacttttaaaaaaaaaaaaaa

SEQ ID NO: 9523 - DNA, 487 bp, Homo sapiens
  misc_feature 7, 15, 22, 235, 478: n = A,T,C or G
tttgaanccttttgnactctanaatacaagctacttgttctttttgcaggatcccatcgattcgaattccgttgctccatggtctactggcatgcactggactctggagatgcctccccagtacaggctgtgtttgcccggggaattgctgccagtggccacttcatctgtgtgggtgagggagccaagtgcagggcatggaggggtgctggggcatgtgggctgtggccagganaataatgagggcctgaggaaattgtggaaagttacagggaagggtggaagtggagtggaatcacagactccagtaaaccatggaagggttcagagggtcagggtgggataagacaaggctagtgaatgaaggggcatggccgttggagcagtgagagggggttttgttactaaggtttctgggatggagtaagtgttgagtatggtggctggagacccaggagggtcaggaagtcatcactgnagtactggt

SEQ ID NO: 9524 - DNA, 428 bp, Homo sapiens
  misc_feature 6, 7, 16, 28, 32, 33, 41, 56, 62, 64, 65, 66, 69, 75, 77: n = A,T,C or G
ttgagnncttttgtgnacttagaatccnctcnnggactttntgcaggatccctccnttgctntnnngcnaccggngnttgagtgctcatagtacatctgcaaccgcgaccatggtcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttctttcatattgg

SEQ ID NO: 9525 - DNA, 339 bp, Homo sapiens
agttcgtgtttgtgtggcgtggctgccttccatcagcaagtttgagtgttgatgtgaggccaccctcttttgaaatggattgtggtcggtttggaatagttacacagtgctgtgccatttggtaactccacacatgtaccgaaaggtgagcccacagtggaacgctcctcaaccaaagtggtttaaagttgcagaaaagggtaattgtgctggttggtgtgtgtgctgaatttgtagcgacatcagagtcaagcattatttgtcctgctgctttcttggaggtcacagtaactataaaaccgtgagccagcaaggcagagaggaccctttggggtaagg

SEQ ID NO: 9526 - DNA, 440 bp, Homo sapiens
  misc_feature 417, 427: n = A,T,C or G
gctccgcccgggatgggatgtggcgcctttttccgctcgccctcgcgccccccccgccccgcgcagctaaattccggcggaggggcgagctggcaggccggctcctcccactctgggcagcggggtcccgcgtcccctcccccactatttggcagcgtctgggggtctggggcagcttcgttcattcacccgggggagttgggtttccgggaagggtcggaagctcctccctcgcttcctggtgggtaatggggtgggtgcctttgactccgggggtggaaaagcgaccccacattcaaggacgccaatggcatgttgagctttcccaatctaaaccaggtgcgtggagggaagcaagtgcttactcccagcttgaaccctgagcagcggtctctaactttagtgtcctgtggccanacctggaagngggtaagaacctt

SEQ ID NO: 9527 - DNA, 423 bp, Homo sapiens
gggtaggacaaggaaggagggggtgagtttagcagccagttggggaaaggatgcttgcagagtgtcagtgtaacttggattcccactcatctcttctctctcccaaggatcctgaatcaacgtagtgtgaagggacaagagtgagcacctattgatcacctatgataggtcagacactgtccaaggctccttctctacactggctcatttaatctttacatctcactatagaatagatgtaccaggtgttttccacatcaacgaccaccacgcgccccatccaccccacccagatgtgtctacaccctcagatttcacttgaaatgttccatccttagtgcagccttccccagcccctcagaccaggttagatctccctgtcctatgttcttatgtcccctatgctttccctccatggactta

SEQ ID NO: 9528 - DNA, 408 bp, Homo sapiens
attgtgtttgcatgttatattacttgatactctaagcatattacaaagttttcccacatgtaaaccccggaaaggtagtgttcattagatttttgtggcagaaattttaatgaagtgttacgtactggagaggtttcataagtatatacttattttattattggcatactctattgaaaggggttttgctgtagctgttagaaacaactatatttgacataagaatatgtatgtattttaagacataaggttaatagggctgacaaatatgagaaccagctgattggttagagtcgtgggaaaacttataacttgggatgtttctggttgtctagttgtatttcttggaggagaagccgtgtgatgtaaatgccgttgtttaacaccactttgagaccagagctgggt

SEQ ID NO: 9529 - DNA, 407 bp, Homo sapiens
  misc_feature 387: n = A,T,C or G
gagcaagagagaagacagtgggtgaagtcctggttccagactcccctttttgccgggatatgatggatctgtcagctggtgcctagagtcctacagagctagagatggagggaaattcagatcatctaaacccttcagcccttcactggacagaagaggaaactgaggctccatctgcatgacgttcccagagtcacggcacaaattcatggaaaaagcaacaggaaactcagttctccacactgggtccaatgtgtgttttaaaaatatctccacagggttaatgactcaatttttcatgcatgattgctagtaatgacaatcatgttatgtttgtttctgtactttggaaatcactccttcacttgagtttcaggtcccaactgnccacacctgcaggaatgagg

SEQ ID NO: 9530 - DNA, 410 bp, Homo sapiens
gcttctcatcctcatggtctagtgtggctgcaccggctctggccctcatacctcccggcaggaagccttcttctaggtgaagaagagcaaatccccacctttcaaggaccctcactgcaagttgtccctgtgactccgtttgtgtcccattgagtacgacgcttccctgcacaggatgctaggacacgttgtctttattccgcacacagctgaaatttcttactgagaagaggaaagttgctgttgaacaaaaactagcaacctcagccagtcagtgaccgaggggcagggtaagaagagatgaagatggaggggcagcccgaggccggctcccagagcgccgcgtgaccagagcggaccctggagtaccgtcagtgcaggaggacgtgcataggagagatcagagcaga

SEQ ID NO: 9531 - DNA, 407 bp, Homo sapiens
  misc_feature 365, 370, 398: n = A,T,C or G
gcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaaggtgagtggccggcagtggaaggctgttgctcattctgattactgttggctctatttcatgctaacccagttttttttgtttgtttgtttccactttataacatatggatttctatgccacactacccgtagctttgaaaaataactttangctgnagttttcagcaaacaggacagtccttanctgccacat

SEQ ID NO: 9532 - DNA, 408 bp, Homo sapiens
attcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccacaggggaaagtttggggatgaaggagagcttaaaggtgtttcaattaagttagaaaactgacacaggctgttgagaattctttgcacttttcccaccccaaaacagcatggggcctgacatcttctgccctggtcccctttctcttgatgtggaaagtctgaatgcagtattta

SEQ ID NO: 9533 - DNA, 424 bp, Homo sapiens
aaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtaaagatagcgatgaagagaatgaagaactgaataaattgcaggcattacaggaaaaaagaataaatgaagaagaggaaaagaagaaagaaaaaagcaaagaaaaaaatcaaattgaaaaaaaaaaggaaaaggtcttactcatccagttccactgaagaggacacttcaaaacaaaagaac

SEQ ID NO: 9534 - DNA, 386 bp, Homo sapiens
  misc_feature 255, 257, 259, 265, 267, 272, 280, 287, 295, 297, 310, 322,329, 333, 335, 339, 346, 347, 350, 351, 354, 356, 358, 360,363, 368, 371, 378, 380, 381: n = A,T,C or G
ctccctaccagatgcaggaactcctggactccttggtgggctggccctggctagcccttgggcctcggagatgatcagaggtgaagaaccgcctggaagaggaaggccagggtttggccaggagaactaagaaggtctcaactccaggctttgttgtgtttaagctattgagagccccaggccacaccaggacttgcagtggtgggaatccattcctcttctgccctgtgttgcagggaactaggaggtaagggngnanggccancntttcnctccttgntggcggnggaccatncnatacctgcttttnttgatggccaancagtatnaacngnatcntgagcgnnctnnaangngncntgncaggnacntaactcntnnctctc

SEQ ID NO: 9535 - DNA, 389 bp, Homo sapiens
ccaggctggagtgcagtggcacaatctcagctcactgcaacctctgcctcccaggctcaaaggatcctcccacctcagcttcccaagtggctgggactaccggtgtgtaccaccatgcctggctagttttaaaattttttgtagagacaagttctcactatattacccatgctggtcttgaactcctgggctcaagtgatcctctaagccttggcctcccaaagtgctggatttgcaggcatgagccacaccactcctggccctggttgtgttttctaagctagactctgtgcttgccagcaaagcttcatgacttctctaaaggggcaataagtttgcctttagagaagtcagggagctatattcaggcatccagcccaaccagttgt

SEQ ID NO: 9536 - DNA, 387 bp, Homo sapiens
gagatttcctactaaccatttgcattgggacagtgaggctgggggagggattcagtgagagattactgaaaaaatgagtatttatcactacagaaaggttaatttgcttttcaccgtttaaactttttaaaacatggtcttttatcagaattggcattttgagaagagggtgaactgagttaaacaatgaagcaattctagagctctgttgtccagtgtggcagccaccagcaacatgtggctatttaattttaagctatttatggccagtgcggtggcccacgcctgtaatcccagcactttgggaggctgaggcaggcaggtcacctgacttctctgaggtcaggatttccagaccagcttggccaacatggcaaaaccccatct

SEQ ID NO: 9537 - DNA, 402 bp, Homo sapiens
  misc_feature 297, 298, 310, 312, 316, 317, 318, 320, 321, 324, 325, 326,340, 345, 346, 349, 351, 364, 365, 374, 382: n = A,T,C or G
aagaataagctgggcacggtggctcacacctgtaattccagcattttgggaggccaaggtaggcggatcacctgaggtcgggagttcaagaccagcctgaccaacagggagaaacctcgtctctactgaaaatagaaaacagttagccgggcgtggtggcacatgcctgtagttccagctgcttgggaggctgaggcaggagaatcacttgaacccacgaggcggaggttgcggtgagctgagatcacgccattgcgctccagcctgggtaacaggagtgaaactccgtctacaaannaaaaaaaaaaangnattnnntnncgnnnaaaaaaaaaaaaanaaaanncgngnaaaaaaaaaaaannaaaaaaaantgggaaanaaaattttaagggccggccc

SEQ ID NO: 9538 - DNA, 389 bp, Homo sapiens
  misc_feature 79, 81, 82, 83, 87, 95, 99, 103, 115, 116, 144, 146, 234,319, 371, 373: n = A,T,C or G
gcctggagctaagtgccgagagcgaggccgagatggccgagtggatgcagcatctctgccaggctgtgtccaaaggggnannngtgnaaggtttnactnccancccctgcatacnntgctgcctggtcctcacggatgaccgcntntttacatgccatgaggattgccagaccagcttcttccgctctttgggcacagccaagctgggcgacatcaagcgccgtctccaccganccgggcaaggagtactgcgtcttggagttcttccaggacagccagcagctcctcccgccctgtgtcatctatctgagctgacttntgaactggaccgattgctgctgcactgaactctgggtggaaaaccatttatnangtggacctccccacac

SEQ ID NO: 9539 - DNA, 391 bp, Homo sapiens
  misc_feature 349, 371, 377, 384: n = A,T,C or G
ggggaaccaacggaagccgaagccagagctagagcatctaatgaagatggtgacattaaacgtatttctactaaggaatgggctaaatcaactggatatgatccagctaaactttttaccaaggttagatttacttttttttataatcatggatagatgtattgttgtgcatagatgtattgctctagttctgcttgttttaaaatagcccataaaattgaattaagcttctatgtatatgccttgtgatgtcctaataaaatgattgatgccgtccggatatgcaagttttaaaatgttaccatctacactaagtctatcagtatagcatctaaataggaggtaaaangagaggtggcttgtataccttnttgggnggctttncttctct

SEQ ID NO: 9540 - DNA, 405 bp, Homo sapiens
gattgtgggagaggtgggtgctgtgagggagtctgctgtgactggactgtaacaggatttacttgagaatttgaggtgtgttgggggcagggtcaggagcaaaggcttgtttcccctactcagcggctgctgctgcagggccgggcaacagtggaggtcatgcaggaagggtgttcgctgaagaccgtgttctgtgacttgaagatgggtgttcctcccgtgggggtggaatggagactggacgccgtgtggcttgagagtggcatcctgcgtgaccttgcgtgtagtgggcttacagcagagctagtccttcctctatagattcttttcatagtttgcctgcctttagattctctgattaacgcatctgaggtgggtcccaggagtctgccacctgccagccag

SEQ ID NO: 9541 - DNA, 408 bp, Homo sapiens
aagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctggcacatggcgaaacccta

SEQ ID NO: 9542 - DNA, 383 bp, Homo sapiens
gcccctgtggagggcagccccgacaggaagcagtcccgctccagtctgagcatagccctgagcagtgggctggagaagctcaaaacagtcacatctgggagcattcagcctgtgacccaggccccccaggctggccagatggtggacaccaaaaggctgaaggactcagctgtgctggaccagtcggccaagtactaccacctgacccacgatgagctcatcagcctgctcctgcagcgggagcgggagctgagccagcgggacgagcatgtgcaggagctggagagctacatcgaccggctgctggtgcggatcatggagacctcacccacgctgctgcagatcccccgggcccccccaaatagccttctcaccctacccca

SEQ ID NO: 9543 - DNA, 393 bp, Homo sapiens
gcctttctccttagaggccagaggtgctgccctggctgggagtgaagctccaggcactaccagctttcctgattttcccgtttggtccgtgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttggggtgccctcctgaagagag

SEQ ID NO: 9544 - DNA, 367 bp, Homo sapiens
  misc_feature 363: n = A,T,C or G
gccaaggactgaggtttctctggacttgtgagagcgacatgtgcagcacctgggcaggcgtgaggggtggacttactttgtggaacacatgggagcatgaaagcagcacctgttcatgaggaaacagaacgacgttgaagtttacaaaagagaagcagcatgtatccaacagttaaaatcctgaatgcttagaagggaaagtgtgctcacaagaaaacttcacctttctgtgacccaaattccccactaaacagtgatatactgggctgtgacaaaagactgaagcttagaccaaatgaagaagaaggcagtgggtacttaatagaagggacaggccgccagcccaccagcgccagggcctgngggc

SEQ ID NO: 9545 - DNA, 377 bp, Homo sapiens
  misc_feature 369: n = A,T,C or G
aactggagcaaggtggtgagttcaggctcagacatgaacctgggaaggcccacagcctggatgcacacatggcctggggctggatgagtgtggacctgagctgaagtggggcctggcagtcaccattgaggatgaatttgcccaagctagctgggcagagtgacagcaaagggtaaaggtagaaccttcaccctatggaaacatccagagcattcactcactcaccattcattcattcattcactcactccacaaatccacggtgagccccttctgcgctccaggtagtgttctctgtgcaggggcattagtggtaagggcctgtctcctggagctcacggtctatggcagaaactgcagtgaccaccngacatcat

SEQ ID NO: 9546 - DNA, 407 bp, Homo sapiens
  misc_feature 330: n = A,T,C or G
taggatcctggtgggcggtgggacttgggttcaaagaagaccaagcaggcagacgtgttcgggggcccgcgggttccgagactggagactggacctttggctgtccccacgtgcattctaggtcaacggtgcggtggcagaaccctggggctctcccccgcggaactcggccctggccgaggccccaaccacgctagtaggaggaggccgagcatccctcctcgaaatcgcgaaatcccggcccgacaatgtagccacggagtcgaaagccgcgtgcgaacttggcactcacaaagcctagataaccgtctattttctcctgtaaaatangagggatggacccccacagatcattgtaaaaggtcttacaaagaaaaatccttctggactggcacggtggctcacgc

SEQ ID NO: 9547 - DNA, 392 bp, Homo sapiens
gtatttggaaaattggttcaagctgggtatgagacataagtgtagtcagctctgggagaaggttgctcttaaggagaagcagggacctgtggtttagcagcaggaagtgcaaatgggactggcttgtgctctacctggcagacctggattggcttcaggcagccagtgcctggaaaagcctggagaattgggccgtacttgaccctgattctcatcaggcacagatgaatcacaggcacctaagaatcggcacagaacttccatgaggcctcagtcagcattttttcacaaaatgagctgaggccattcaaggaggctagaaagagggaactgaatccagagaggaagagtctatagtcatcaagttgtatccatgccagcctccctccaca

SEQ ID NO: 9548 - DNA, 401 bp, Homo sapiens
  misc_feature 350, 351, 352, 356, 361, 363: n = A,T,C or G
gggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccnnncccnccatngnccgaggtgagggggcccctccggtatcgccccgagaac

SEQ ID NO: 9549 - DNA, 382 bp, Homo sapiens
  misc_feature 361, 371, 375: n = A,T,C or G
attctgtggacaccgagtccagcctccgggaggacgctgagggaaccttttgggacagccagggcagagaacgccttttacttcttaaggctctggatcaaaacagagaagcttctgttttggagcctggcaatcctcgaacatcagtgtgcattttaagccataaagcgcaatactgattacaaacaggaatacggagggcttcctttaaactgcttcaagaaaacaaactcctcggggacttccgaaaggagctctcaccatagctcctgcaatccactctgaacaggaaaccttctcatctatttattaaaactgaccccagaaagattttcaacagggaagcctggctttatgttgnggtatagccncaanagaaaga

SEQ ID NO: 9550 - DNA, 408 bp, Homo sapiens
  misc_feature 360: n = A,T,C or G
gccccccagcccgagcggggaggcgagcatgagcccccgagccggccctgtggcctcctggatgaggatgggagtgagcccctccctgggcccagaggggaggtccctggaggcagcgctcactatggggggccctcccctgagaagaaggcaaaaagttcctctgggggcagctcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgccctcctgtgagggggttcagggacccccgatggccccanagaagtacacaggggaggaagatggacccgggggacattccctgccct

SEQ ID NO: 9551 - DNA, 357 bp, Homo sapiens
gggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcc

SEQ ID NO: 9552 - DNA, 353 bp, Homo sapiens
aacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaatatttgtcctatttttctctgtcacttcctttttctctaaggcaggaaaggaaagacattaaaccattaattaagtcaatcctcttggagactcaaaagactatgaagtgatcactctatataaaatataaatacagtg

SEQ ID NO: 9553 - DNA, 355 bp, Homo sapiens
gcatggtcatttgtttgggaggtaatgataggagcagaaatgaaaaatctttgagaagattgtgaaattggaaagtgtggagttctagaacagaataaattctagagttagaggaggtgctttttcatgaatgggtgtaccgtgtgttgagagagtggagtgagaaatgtacttctttgatctgtttcacatagaagcatgtatcatatagaaattcagtggtggccgggtacggcggctcacgcctgtaatcccagcactttgggaggccgaggtgggtggaacacttgaggtcaggagctcaagaccagcctggccaacatggtgaaacccctcctctactaaaaaattaact

SEQ ID NO: 9554 - DNA, 385 bp, Homo sapiens
  misc_feature 318, 322, 334, 340, 348, 353, 354, 361, 371, 374, 379: n = A,T,C or G
aggtctttggccttcctctctaaattgtgatttcctacagagtaaggcttcttatctttttacctagcattattggtgctcatcaatattaagtgcattaagtgcattgaactcatgcattcatgagactaagttttagttaagtgttaattgcagaaaaatttagtatagtaaaatgaaagtttattctgttctgtgggacactctgagccaccagggtcatagattattttaagttgtctgtgcctttgctgatagggaactttgatgagcaaagaggaacctggtagtggtagaggattgtgaactggcctgtgntcantcatcattgganatttanaattgacngctcnngggtggntcccatttanaanacttntgattt

SEQ ID NO: 9555 - DNA, 348 bp, Homo sapiens
  misc_feature 172, 174, 177, 180, 183, 186, 188, 189, 190, 199, 205, 207,209, 223, 227, 235, 244, 247, 248, 255, 257, 260, 261, 267,269, 273, 275, 281, 284, 288, 295, 296, 298, 299, 302, 306,310, 311, 312, 313, 315, 316, 317, 319, 321, 323, 324: n = A,T,C or G
  misc_feature 326, 331, 332, 335, 336, 341, 343: n = A,T,C or G
aaaaaatattgtttccttaatggaattctcacttcatttgaatataagattttggatgaaaggatttggtataaagtttgggtttttgtctcaaggatttgatccatatttatccctaaatatttcttaagggatgtaactttttataaccattaagtggggggaagggggngnagnggntgnccntnnntataactgnaagggnantntctcctatgaaaancctncttccccnactttactntgnntttactngngannccctananattntngaatcnaantttngcccccnnannaanatanattnnnntnnncntngnngnccaanncannaattntngttaa

SEQ ID NO: 9556 - DNA, 383 bp, Homo sapiens
gcaggcctcatgggaggatttgatgaagatgttaaagcgaaagtggagaaccttctcgggatttccagcctggaaaaaacggaccctgttaggcaagcaccctgcagccctccctgtccccttcttcccctccccttcccccgcccgtggagacagctgttctcagcagggctctccgcagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggca

SEQ ID NO: 9557 - DNA, 348 bp, Homo sapiens
  misc_feature 330: n = A,T,C or G
gtagaaggctcagtttctctgctcatcacacggccttcggcactgtagctttgggtggtgggctgcagattaattttgtaaccaccttaagaaaaatacggtaaggtgatatttaagaaaaatatttgcgaaatgcgctcccgagtcaaacatcggttgacttgacactactacagtttccatcacagtcaggcatgatcgattcaggtggagggagttgaagattgttcttgatgaactgaatgcagctaatacattttcagtgccgttgatgcctctatgactccgtaaaataatcggaactctaactccttgccactcaagaaatgncctccctttcagaatatg

SEQ ID NO: 9558 - DNA, 379 bp, Homo sapiens
gtctggatcatattttcaacacagggcacatgagacagttgaccatgatcatcaaagaccagctgtgatgagagaaagggtttctgccttggggcctgtaaaaaaaagggtcaggaaaggtcgaggggctagatgtcagtatacattcctcagcatctggccctggactgcctgccacctccacacatgccacccaccacctcacttgaaggatgttggccacaaaagaggttatctgctcttccaagacagaaatgaggctctgacaaatcatgtagtcaaccaggcgggcaaactttcccagctgcagccaccaggcctctgcttgcttcagcttctgctccagttgcttgtgctgtaccctctgaaggtatatgga

SEQ ID NO: 9559 - DNA, 386 bp, Homo sapiens
  misc_feature 339, 364, 375: n = A,T,C or G
ggtctgccttgcctagttgagcctgtgcactctgtctctgcctcccttcagatagggaaaggagcttcaaattacggggtgatgtcatagcacggagtggagatggggtggcagggagacagggaggctcagggtctctggcacacattcctcccagagcaactgtaggaagcaagccagtacagaggtactctaagcgctagacaggacgggggtgagttcgtaacatcgtctcctctgggctggccctgcttctgcttagctctgggcataagactgactccagtacagtcacaattatgtctctgagctcacccagtcctgggttcaggttcccanctctgacctggcgagacacacacangctggtgctgngggatgcttgg

SEQ ID NO: 9560 - DNA, 344 bp, Homo sapiens
gcggggtaccagcagagtggatgacaagcccagctcaccgggggacagctcgaagaagcgaggccccaagccccggaaggagctcccggacccctcacagaggcccttaggcgaacccagcgccggcctcggagagtacctcaagggcaggaagctggacgacaccccttccggggcaggaaagtttccagccggccacagtgtgatccagctggcccgaagacaggactcggacctggtgcagtgtggtgtgaccagccctagctcagctgaggccacgggcaaactggctgtggacaccttcccggccagggtgataaagcacagggctgcttcctggaggc

SEQ ID NO: 9561 - DNA, 355 bp, Homo sapiens
  misc_feature 349: n = A,T,C or G
cagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttcacccgtcgggaaactacctgatcacagccttcagtgactnaaccct

SEQ ID NO: 9562 - DNA, 339 bp, Homo sapiens
  misc_feature 243, 244, 257, 260, 267, 272, 276, 278, 279, 283, 287, 288,294, 295, 297, 304, 305, 306, 307, 308, 311, 315, 316, 318,320, 322, 331, 334, 335: n = A,T,C or G
ggtgcccataacggggtgggcctgccgctgactcgggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcaaccctgcggtaccgcaagcccatgcaccanngtctcgggggganttnctgatgngctangagnanncccncganntttgtnnangctaatnnnnncangcanntntnancttttctcnatnngcgc

SEQ ID NO: 9563 - DNA, 308 bp, Homo sapiens
  misc_feature 219, 220, 221, 222, 223, 224, 225, 229, 231, 233, 234, 237,238, 239, 240, 243, 245, 253, 254, 258, 261, 262, 270, 278,281, 290, 293, 300, 303, 304: n = A,T,C or G
aaggagcggtgccagactgctgggaacccgttctttgagcgttttggcattgtggtggcagccactggcatggcagtggccctcttctcatcagtgttggcgctcggcatcactcgcccagtgccaaccaacacttgtgtcatcttgggcttggctggaggtgttatcatttatatcatgaagcactcgttgagcgtgggggaggtgtgggaggttttnnnnnnncttntnannttnnnnatntnaacatgannctgntgnncctgctgncccgctgnttnacccctggngangcactgntgnnattg

SEQ ID NO: 9564 - DNA, 259 bp, Homo sapiens
aagatggagaaaagtagaataaaaaagaccatcttttgtcaccatcgtttcataaaagcattttaactccctaaaatataagtgggactatctcaaagaacactgaacaatccattaaattgaattctgatggttaacagatgaaaaactcacactgtccttgttttgttcatccgttcagcttagacctgtgaaaattctattgcccatcattgaggtccagtttttgggaaaaagtaatgtataaaaaaaaaaaaaa

SEQ ID NO: 9565 - DNA, 450 bp, Homo sapiens
gaaaaagttctcctcttatttggggaatggatttcagaagagaccagaagatgttctcgtgttctcaccacagggaaggcagaagcacagagccccacaggctaagaaaatgagagcattggcaacccgtatggcccaagacacatgcaaaagcaagtcccaggtgcctccttcacatgatgctggcctcaaagaccccatgaagagcaaaaagcagccactctctcaaaataacagaactgcctgcttcataaaagagcaaccacaagcccaagagaaagattctgtgaatccatctaaggacgtagaccccagcaagggcatctctgttccatgccaaaatcaagaggtttccaccaacaccatagaacaaggtcctagttccagcccagctagtgatagtggaatggcatgtgctgatgagaccagatcaaaagatgttgttttaag

SEQ ID NO: 9566 - DNA, 418 bp, Homo sapiens
aggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccagggcatgtttgctttttttgtttatgtgtttgttttttgagacggagtctcacactgtggcca

SEQ ID NO: 9567 - DNA, 415 bp, Homo sapiens
  misc_feature 390, 403: n = A,T,C or G
gtggaggctgccaagcctggattccagccggctccaaacgccaggctgaggaggctttggactttgtccagtgtcaccacaggcttctgggcagagctggtccaatgggggttgggggacagtggcatacctgacatcaacccctgggttattgacatcagcccctggaatgcattagtgatgcattccacgggcccaggggtcatccactgccttcgggtcaagcaaatggccagtagctgcccaggctgatagaggtgtgtgttggaggggggcacaggccactggccctcggccctggcctggcagcagggaggcctcagatcttagatgcctgagagctaccccaagaagggtctcggcacagctatggtccccatgcctagtggngctgggccttctnggtgctgcagat

SEQ ID NO: 9568 - DNA, 408 bp, Homo sapiens
atttttggtcattattgtctaaacaatacagcttaacaactgttttcatagtatttccattatattaggtattataagtctagagatgacttaaagtatatgagaggctgtccataggttattatgcaaacactacgccattttctatcagggatttgaacatttgcagattttggtatccataggatgtcctggaaccagtcccccactggtactgagggacagctatacttaaagactaatatatatgctctgttttcctttagagtacttgactctacacatttcctatagctttgaagacttgtcttccttgaagcagactaaaagggggacagatgggaggatgggaagaaccacacttccataatcttagaattattccttccttgctatgctgacaaaggg

SEQ ID NO: 9569 - DNA, 407 bp, Homo sapiens
  misc_feature 237, 246, 253, 254, 256, 271, 275, 280, 281, 291, 294, 296,300, 307, 308, 319, 324, 325, 326, 335, 341, 343, 349, 351,352, 353, 358, 367, 375, 377, 378, 381, 383, 397, 399, 401: n = A,T,C or G
caaatcacagcattaataacagtgccctaattatgagctgcaataattgctttccagagttagacttcaaatcactgagtagctgacttattaaaagtttttattgttctgaaatgtaaactaatacagttacttgtagattgctgatgaagtgttaatattgagatgtcttaattgggcctcctggcattctttgaatgaaatgatttgtggctcaaaaatgctgcggcagcaganaccataaanagcactnnancatagatggccttcnaganaaacnnaatatccatnggngncaantaacgannaccccatagantgcannncggagaaanaccccngngaatgntnnnaaacngggaaacancctccccnanngananctttccccacgcancngngcgcac

SEQ ID NO: 9570 - DNA, 406 bp, Homo sapiens
  misc_feature 402: n = A,T,C or G
tatacacataaagtttaatagttaatgttaccagattccctggtaagatcttaaaatgagcttccttgtgttctcaacaacattgctactaaaaacgaagtgtggaatatactcttcagatagcagcaaatgttttgtcatttcctttgcttctgttgattttcaaaagtttacctccttaaaatacataaactattgtgttgtagaagattccacatgatgaagggcattaattttcttgtgccactggtgccagttgatcagaccaacctaacatgcctcagtttcatgcatattctcacttgttttccttctgaataaaagttattctaaatctttctcttgacttctttgtttaggggagtggtctgaacctgctgtgcttctacctacttgataggngagg

SEQ ID NO: 9571 - DNA, 407 bp, Homo sapiens
aacccataggaaatatgatcctgaggcaccgaggatggttataggacgtggtctgctgctgcatgttgcattactgtatgctgggtttttggtactctttctcaaggctctgttattagttggtaggctccagtaatgaatatagaggactgacagagtgggattaacttatttgcaattgtttcctactgaaatcaaatgcacggttttcccaatttaagacttggtcccttgtaccttgatttgattcagaaagccatctgtgatgtttttgtttcctggcgcctgcaggaaaactcatttgtcatgagttacaattaccttgcagtcattgctatgtggttgtagcacactcattgctaaaaatggttatgagtgcaccttaatccatgagctcaactgggtgc

SEQ ID NO: 9572 - DNA, 401 bp, Homo sapiens
aacccataggaaatatgatcctgaggcaccgaggatggttataggacgtggtctgctgctgcatgttgcattactgtatgctgggtttttggtactctttctcaaggctctgttattagttggtaggctccagtaatgaatatagaggactgacagagtgggattaacttatttgcaattgtttcctactgaaatcaaatgcacggttttcccaatttaagacttggtcccttgtaccttgatttgattcagaaagccatctgtgatgtttttgtttcctggcgcctgcaggaaaactcatttgtcatgagttacaattaccttgcagtcattgctatgtggttgtagcacactcattgctaagaatggttatgagtgcaccttaatccatgagctcaact

SEQ ID NO: 9573 - DNA, 402 bp, Homo sapiens
gtttttccatgtcgtcattgagtcattcaagttttatggctctggatatttgaaattattttggacacccaaatttggaatgtttctttctgaattgtgataacgccagaaaatttttgagatcagaaaagggcagtttatttgctttaaaataatacagcttttgtaggggactcgtgatacttgggcattatttcctctccacattaaaaggaaagcagtgggcaggaaagatgcatacagcacataacctcattacataatacaatgtttctttggaaccagtaggaatgagttgttctggaaaacaatttgtagaggttttatcacttttagctctttaagatttatcacttttaggccaggcgcagtggctcacgcctgtaatactggcctttggga

SEQ ID NO: 9574 - DNA, 398 bp, Homo sapiens
aaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctg

SEQ ID NO: 9575 - DNA, 397 bp, Homo sapiens
gataaatatcaattttaattaatactctaagaacatacaaaaatggcaagccctttaccatcactgtttattattgatggcaacaagtcaaagctagatatattttatttgctttgagatgattttttggttatgattttatagccagcaatgcttgttatgcatccatcaacaaaaagttgttaaccacctactgccaaagaaaaatcaaaatgtcaccatcaaggccatcatggtgtaagaaaacagacctatactcaggcaacttcagttcagtatgatggatactgtattagaaaaagtatctgggcgctttgtatgaggaaggacatgtcattgtgtggagaagatgaagcttcactgaggagagagtgccctggcagtcctaacatttgtt

SEQ ID NO: 9576 - DNA, 388 bp, Homo sapiens
  misc_feature 111, 118, 123, 125, 129, 141, 144, 191, 207, 236, 248, 258,267, 359, 366, 374: n = A,T,C or G
aaaaaaaaaaactcccatgattaaagtttacctacataacaaacctgcagttgtaccactgaacttaaaataaaagttaaaaaataataataataatttttttttgtaaanatggggngttgntntggngcccaggctggnctntcaaattcctgggctcaagcaatcctccgacctcagcctccaaaagngctgggattacaggcntgagctacctcgccagcctaaatacattnttgaatatgtanctttgggaanatttattanttgattaaggactaggaggtccagctaaaatgcaattggatttataaggggcttaaatccccatttaagggatgaaatcaaaaatggcgaanaaatcantgaactgnggtcttaaaaaatt

SEQ ID NO: 9577 - DNA, 383 bp, Homo sapiens
ctctttcttttctttcctttcttcctactttctctttctttctccttctttctttctctttccttccttccttcctttccttattctttccttttttccttctctttattttttctttattctctatcttgctctttctttcctttctctgtctctggctctttttctttttctctcttttttcttttctctctctgtgccgctctcttttctctttttttctccttccttccatccttccttccttccttccttcctcctgtccttcccagataaaaaatattatctggtcaaactgtcccatctgtttgggacaaaggagatccactgagattttgtacaagacgtacatttttaaaaaggaaggggggtagagggcagga

SEQ ID NO: 9578 - DNA, 384 bp, Homo sapiens
  misc_feature 244, 249, 254, 293, 358, 361, 374: n = A,T,C or G
gttttctgaattcagatataatgctttcttctgctttttttttgctgtgctccaaatctcagaaggcactgaagccagattaaaagttaaatgaacaggtgacatattaaagttacaggtttatgagtttccccactccactgttttcatgtagctccagaaccttataggataatggaagacagattcagtccaatgctgtttttcagagtagaatctatcatgtttttaaagttaaaaattntcagngtacntattaaatacaagtttttcagatttagaatttgttcttntgaaaataagagtcctgaatgtctcctggacagaaaaccctggttctgggggttttaggatccanaanacagcatgcccanatgggcttgg

SEQ ID NO: 9579 - DNA, 386 bp, Homo sapiens
aggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctccctcccggccaaacccagacccagactctaagaagctggaatggagggcagggatccatggga

SEQ ID NO: 9580 - DNA, 383 bp, Homo sapiens
gggactggaagcctgccatggcggcttctgcggcggagacgcgcgtgtttctggaggtgcggggacagctgcagagcgcgcttctgatcctgggagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaga

SEQ ID NO: 9581 - DNA, 408 bp, Homo sapiens
  misc_feature 324, 332: n = A,T,C or G
cagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcgtgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcanacctgcanggggaaggcgggagagcttggtgcactgcagacctgcggggggaaggtgggagagcttggtgcactgcacacctgg

SEQ ID NO: 9582 - DNA, 400 bp, Homo sapiens
  misc_feature 393: n = A,T,C or G
gcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaaggtgagaggaagggggaagtgatgtgtaactgctcaagagatgcttaaacctccatagagaggagccgggcgcaggggcatctgtgtgtccgtcacacactgcagcanggaaggg

SEQ ID NO: 9583 - DNA, 378 bp, Homo sapiens
gggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcacaaagtcacgggaatgattgacttatacaccagcaaaaataataggattgggaaaactggggagaggcctctcaagaaaacggaattcagaaacacaggacat

SEQ ID NO: 9584 - DNA, 403 bp, Homo sapiens
gcaaaatacactttcaaattaagaatgggtctgtgatgtcacatctaggagcacctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaa

SEQ ID NO: 9585 - DNA, 153 bp, Homo sapiens
gtcaaaaataaaggaatcatacatctcaacttactgagcaatgccgtagctatggaatatgaagcatttgttgcactctttttgtgagccaggcattgctcagtaagttgaggtcaaaaataaaggaatcatacatctcaaaaaaaaaaaaaa

SEQ ID NO: 9586 - DNA, 398 bp, Homo sapiens
gcgctggccatgaaacacatggatctgaagcagatggagctggacacggcggcggccaaggtggatgaactgaccaagcagctggagtcgctgtggtcagactctcccgcgcctcctggcccgcaggccggacccccttctagggtaagcctggttcccaccttgatctccaaagccagcctctcgccacagtccagaccagaggcctggatttcaggcaaaattgccccatatagttatgcaggttgtgggctcttcaagggaacttgaaaaaaggggaccaggccaggcgcgatggctcagacctggaatcccagcactttggaaggcgaggtgagagaattgcttgagactaagagtttgagaccagcctctacaaatgattttttaaaaatctg

SEQ ID NO: 9587 - DNA, 372 bp, Homo sapiens
  misc_feature 355: n = A,T,C or G
gaagaattctaaaggaagagactgctatgagatttgaaggattagtaagcactagctaagtaatgtagggatgcacagagtgggaacaaggggtccattatcacagcaaaagaaatcacccaaagattctgtgccagttggagtgtgaaacttctcaggatctgaaaaaatccagagtaggtaaattacagagaataagggagagaatgctgcaacctgatgcctataagagctagaatagcctcgttaaggtctgatgtcttactcaagagtaaagtattataagctgggtggtgagaggagtaagtgtccttatcaaagtaatgaactgctgtagagttgattaaagagaggnaagatttatctgaagag

SEQ ID NO: 9588 - DNA, 374 bp, Homo sapiens
  misc_feature 98, 100, 101, 103, 111, 114, 130, 134, 135, 138, 140, 144,152, 154, 180, 186, 195, 197, 209, 214, 218, 221, 222, 224,226, 228, 232, 234, 272, 273, 278, 286, 299, 302, 304, 307,315, 329, 336, 340, 341, 345, 370: n = A,T,C or G
gcggagcctacggagttcacggtgcaaggcatcgtccgtcactggaccagtgaggcgcaggcgcgagctccccagggggaggtgtgggaggtttttcnannanaactttcnaanatgttccctgtgaggncganngcngngcgnttatagtntnaaagtggtattgaggtatttttattnggtaanagcctaggntntgttcacccaanggaanaaanaanntncnancccnancaacttctggggcgtggtccgttcacacgctactctannacccntgggcatnatggaagttgtanttnanacnattaaggncaccgtttcctgtnaaacggnttcnnaatnccctaaaaaaggcttgggaactttnctta

SEQ ID NO: 9589 - DNA, 373 bp, Homo sapiens
gaggtggtcacggaatggggggcgctgctgtcctccccgggggctgcaggccgagaccgggtgaggggcgggggtgatgctggcactctggacggaagggcgtcgtcttcgcagccgaacaggttgtggacgcccaatcgtttttctgcccgtagtcccaatccgaagctaagctgtgtggttttcccttgaaagctccccagccaggcttgctgcctccacccctttcgcatctgaagcattttgcctcccactcgagagaaatcaattttcttaaacaaacaaaaaaaaagatgtgcaggatttctaataaatagcatccttggatggaggagaagaggaatgactccctcatcctgccacacacaccccc

SEQ ID NO: 9590 - DNA, 399 bp, Homo sapiens
ccagccttccccgccctcttcggcgccagcacctcccttgccctccaggaggaccccagcggcagcatctgaaacgtccgcatttgagcagcacctgctggactcccaccggcagcagggcgccctgctgtcctcctgggcccagcagcagagcacactcatggcccagcaaaacctgctgctgcagcggctggccgagcagagccagcgtctggccgatggcgtggaggccctcaaccggaccctcgagaggctggtggaagcacgccctacccgggaagcctcaccctcactccaggacggtagtcctgccagtggagtggccaggggcctgctggaggctcccaggacagccccaagggcacccactcggggctcgaggtcttctcagggatgatc

SEQ ID NO: 9591 - DNA, 369 bp, Homo sapiens
tttaaaatccaactacagaaaaatttttaactgaaagatgccttaatagaatgatctatatcccttagagaaaagattaggacagtcctttatccccttgaattactttttaaatttttaattttctgattttaattgcaataactgattatcatatataagtactaggattctggaaaaagtatttcatctcaaatttcctctaagtagctaatcttcgagaatggtaacttatgggaacccccttgattcccttgctttatgacactgagcaagttacttgagctttctaataccattttattcatgtgtggtatgacaatggggatcatgattatattgatttatgttaccaaatgatttgagggg

SEQ ID NO: 9592 - DNA, 364 bp, Homo sapiens
aaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggctctacaaatgggaacgggacggaatgctaaaggaaaagactggtccaaagataggaggagaaacttttgt

SEQ ID NO: 9593 - DNA, 386 bp, Homo sapiens
attctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctgagggcctgcaagc

SEQ ID NO: 9594 - DNA, 391 bp, Homo sapiens
gcatctccagagcatgaggttttaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaattctgcaccaatatcccacagatgggggaaggtgagaggaaggggcaagtgatgtgtaactgctcaagagatgcttaaacctccatagagaggagcccgggccgcaggggcatcttgtgtgtcccgtcacacactg

SEQ ID NO: 9595 - DNA, 390 bp, Homo sapiens
  misc_feature 295, 325, 327, 334, 335, 339, 345, 354, 375, 378, 379, 384,385: n = A,T,C or G
caagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggangaagtgttctggaggaactacttttaccgntntccctgnntaancagcanccccctcangggcctgctgcccacagcagnccnnagggnnggagg

SEQ ID NO: 9596 - DNA, 384 bp, Homo sapiens
ggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttc

SEQ ID NO: 9597 - DNA, 384 bp, Homo sapiens
ggaggcaaagagctgttgggagtgttttgtggggtctcttcttccttccttgtggctacatgaagcctgagtctcagcctctggtttcttggtttctttccactgccctgggcaaaccagcttcgactgaacgtcagccagtccagagagtaattaaaagagttaagtctcaaaagtaaatctccgggaagagccctcagtggtttcagacccccaggcacttgtcctcgtgccctccctgaggcgtcctgtcctactggacatgctggagcctgcccgtgtccttgtggaccatggaatttgcccggggttggggggcaggggtggagagaaataaaacttcctgtgatctatgtatcggcccagtacatagatctggataga

SEQ ID NO: 9598 - DNA, 374 bp, Homo sapiens
gtttgttaacctgtgctttataagatttgaaggaaaggcattcatggtaattacagacggtgccaccagaaaatgctcttgctaaatgcagccagtagttagattgcttctttctccagtctcccccgcaaagaaatttgacgtgattctgaatgcactggacatgtcttgattgcgtctttacatttcacagtgtcttaaaagaaaggcaagccagttgttaatttcagaatcagatttatgctctctcaatttaaaaaatgctgggcaacaagagcgaaactccgtctcaacaacaacaacaaaaagtttggtatgtttctctcaagaaaaaagcatggtgagtccagacagcagcaaaagcttttgtgaaa

SEQ ID NO: 9599 - DNA, 373 bp, Homo sapiens
gcctctgctgccgccagccgctcatctccaaggcctttgagatcatgttggctgcgggcgaagggaagggtgtcaacaagaggatcacctacaccaacccctacccctcccggaggacattccacctgcacagcgaccacccggagctgctgcggttcagagaggactccttccaggtcgggggtggagagacctacaccatcggcttgcagtttgcgcctagtcagagagtgggtgaggaggagatcctgatctacatcaatgaccatgaggacaaaaacgaagaggcattttgcgtgaaggtcatctaccagtgagggcttgagggtgacgtccttcctgcggcacccagctggggcctgtctgtgcccct

SEQ ID NO: 9600 - DNA, 348 bp, Homo sapiens
gtgaccatagagatcatgctttacatgctttgcattttgtttgtagcattaaaaagatgacatttttcaatgtcaattactatagctgtacattgtacttcataattgcacaatatgaatgtaccatggtttatttaactaatctcataaatttttgtgatttttttcccccacggaatgcttcattattgtaaataacaatagaatacgcatccttgtaacatatctttactaattatatctttactaacatgttaatgttaatttgtagatggactgttggtcagattatttatgttcatcaaatgctttttccactaattcctaaattaccctccagaaacattg

SEQ ID NO: 9601 - DNA, 347 bp, Homo sapiens
gtccttaagaatctagactgacatagtggaaaataaggtacagttggagcgaggtgagaaaagcccagtaagagtttgatctggtccttaagaagcctcggaaggtttttagcgatgaagagcattgtgtgtgtgtgtataaagaattgcaagggggcaaggctggggccccaagcctggatggtggcaagaaatcgggttgtgtgtcaagtgtctgtataacctgggatactagaaatgaaggaggggagtggtttgaaagatactgaaagcaagaatcatgggatttctgcctgtcagataggggcattttaataagtctcctaagaaaggaatgccctttgatt

SEQ ID NO: 9602 - DNA, 348 bp, Homo sapiens
gttacactgtatgtcctgttgtaaatttctgtctctgtttatcaggcaactttctctcagaagctcacttggaaatcaagggaaataatacaccgtgcagaggaaagagaatctggtcccttgtgcctccctgctgtggtgcagcatggtctgatgaccaagggcacaggatcctatttctaggattagtcagaaagaattgagcacatgtctgtagacttttgcctcagtattatattttagatggtttagtcggagctgttacatttggcagcattccttgttagcatttgataaacaattattgccaaatgttagcaaggaaacctgccaaatgttacagctcaa

SEQ ID NO: 9603 - DNA, 349 bp, Homo sapiens
gggactggaagcctgccatggcggcttctgcggcggagacgcgcgtgtttctggaggtgcggggacagctgcagagcgcgcttctgatcctgggagaaccgaaagaaggaggtatgcccatgaatatttccataatgccatcttcactccagatgaaaacccctgaaggctgcacagaaatccagcttccagcagaggtcaggcttgtaccttcctcttgcggtgggctacagtttgttgttggagatggactgcacctgcgactgcagacgcaagcaaaattaggcacaaaactgatttcaatgtttaatcaaagctcgcaaacccaagaatgttgcacgttttattg

SEQ ID NO: 9604 - DNA, 345 bp, Homo sapiens
ggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaa

SEQ ID NO: 9605 - DNA, 339 bp, Homo sapiens
  misc_feature 118, 127, 133, 140, 145, 147, 150, 155, 157, 161, 181, 186,188, 202, 206, 209, 213, 221, 226, 231, 236, 246, 255, 257,266, 272, 274, 279, 281, 291, 296, 301, 306, 316, 319, 320,322: n = A,T,C or G
ggaggctgaggcatgaggtttgcttgaacctgggagatggaggttgcagtgagccaagatggtgccattacactccagcctgggtgacagagcaagactccatctcaaaaaaaaaaanacaccaaanattttnttaatcnctgancnctnttttntntcanttataagaaattgaaaattntaatnancctcctatttaatnaatnaanaatngatttaangattnagttnaaaangttaaattcnttttaaaanancccattacntgttancncaaanancatgtttttnttttnttttnttttnaaacaaagtntcnntntgttgcccaggctggag

SEQ ID NO: 9606 - DNA, 338 bp, Homo sapiens
  misc_feature 318, 325: n = A,T,C or G
aaacactttaattattttctgttaatattactcttaatataaaattcaggtgcattgaaactgtagaggataagcacctaatcttgcagcatcagagctgatgctagttggaattgcttctttgtggtaatgaggaaacaacgctcttttttgcatatggagagagctgtaccttaggcccaacatgttacttggccaaatgtttttgtgcagtgtaccccctgtacagctgtatgtgattggccaaccttatctcttatctcccatagcagccttaatgtctccttgttaactctcatctcacttaaagttacttgntgaatgnctctcattcttgc

SEQ ID NO: 9607 - DNA, 417 bp, Homo sapiens
  misc_feature 392: n = A,T,C or G
gtcaatgaataaagaaactggtctcagtgcctgtgaaaacatcgaggaaaaggacagctttaaaaacttgccttctgacctcaggtgatccgcccgcctaggcctcccaaagtgttgggattacaggcgtgagccactgcacctggccagttgagctttttaaagataacagaaaggactgctgagaatgagtaaacctatgtccgtaaagagaattgcatgatttactgcaagtattcctgggagtgaagcatcacgtacacactgctggtctcgtgtcctcctgaagatagcccctcacacttcacagtggttggagaaggttctttttctctcctgtcttccctctgggtcccacctggtctagcattttcatctgtgttgaaatttgnttttcatttctgttttaagtccttg

SEQ ID NO: 9608 - DNA, 418 bp, Homo sapiens
  misc_feature 168, 170, 173, 176, 184, 201, 227, 248, 253, 262, 272, 274,296, 366, 408: n = A,T,C or G
agtgggtacctgcattctttgctctatttttgtgtgtctccgtatattcgttttttgtttataattagttgcatttatttttatggtttctgtatcttaaaattttttttaagttatagaagaaatacatgctatcagcaaaaaaaaaagaaaaaaaaagtccagctncncanaancgaggagngcgaagcaaatagccgnttcacgtcccacaccctggcagcagntgcgcccgggtctgtccgganatggngtgtgcaancgtattccancncaaaaatctggacttctgtttnttatgaaagcagctgatgccacactgtgtgccctgtgccgtactgtgccaggcacctggacggacctggnttctccctgtgcctctgaagggcggacggcgttgtgtctgcncagcctgcag

SEQ ID NO: 9609 - DNA, 414 bp, Homo sapiens
  misc_feature 409: n = A,T,C or G
ggtgctcctctggcttttcaaggtttggtaagagctaggggtcccggtgctcctctggcttttgtaggtttggaaggaggggatccatctggcctcactctgcctcacccattaaatgctttgcccataggaaagtctgaagataacaccagcatgggaatttatttaaggggtgggaaccacaagctgggacaacctttgcccaagcaggaagcttataaaattcatctcagacagagggatggcaggctgctgccgggggtgggggccgccctcttctcccacccacccctgctggcatcagcagctgcaacagaatcctcctcacacctggtgcttatttataaactacccccttgctcagctccatcagaattggtaaagccaaagctacaggagaataaaatgnagata

SEQ ID NO: 9610 - DNA, 408 bp, Homo sapiens
gtaggcaaggacgtcagagggctgatggggccatatcaggtggggccttgagggctggccatggggactttgcttctaccctgagtgagatggagctatggatgtgaactgataggggtgttcacgggctccttgggaggagggaaggaggggctgagagaccagggagtaggctgctgggctggtccaggcaagaggtaacagtggacaggaccaggcggagtgagaagaggtcagatttggaattattgtgatcagcagacagctcttacctggggtgtgagggaaagaggagccccagaggactcccctgtttttgcaactggaaagcaatggtcagccatggcagggtttgtcctgcatcaagacaagcgagcccttgctggcacaatgctcatgctgtaattc

SEQ ID NO: 9611 - DNA, 423 bp, Homo sapiens
ctttggactcacgtaggcataggagaacgaaacttctgtacattttaatctgaataattcttcaggatttaaaattaattggctctggcttggttggaccgtactcggatctcgccacctctgcgtttcccgagtcactggcgaagagaaccacatcacatcaccgtcagggagaagaagatagcaaaattggggaagcctatttctgtgtagaatgtatgttaataacttatttacttctaaagttggaaggcaaagaagagagtgagtttactgttctaaaccctgtgacctaatagtcctctaatgctccggtcccagttcctctgggaatcgtcctgtatgcaacatcttcacaagagtggcaggcagttgaatctctggccttcgtgggaccactggacatctggcagagaaccagga

SEQ ID NO: 9612 - DNA, 397 bp, Homo sapiens
gcgagactccatctcaaaaatagcaaaaaacaaaaaaacaaaaaccaagaaacaattttagacattagcttctttttccccatcattataaagttattttgccatttgtttttggttcctatattggttttatcagaattaggtaaatcctttttttcttgcttcttccacctaaaaaatgatagtaaaacatatctttctgcagacttctgaagaaaattatataaaattacatgaagtggtaccattagtgttatcaagtagaacctacaggataggtggcagatttggaagtttcccacctattttaatgttagagaccacatatctattgcattattgctaaaaaaaaaaattcctcactcaatcaaacatatttccaatacctgggaaaagc

SEQ ID NO: 9613 - DNA, 419 bp, Homo sapiens
  misc_feature 411: n = A,T,C or G
gagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaataagtatgaatgtggncagaggat

SEQ ID NO: 9614 - DNA, 390 bp, Homo sapiens
cttatccctgtttgatttctgagtttggattaataactatgttttttaacttcaacattctcacaaacaatttctgcataaaacttcttctttaaagcttaaaaagaaaaaaaaatctacctaatggagcactgaactagaacacaaaatacttgggttctaggcctggttctgccatcaactagcagtgtgtgagtttgggcaagttttttcatcatctatccaggcctgctttgctcgtttgtcaaagagggatggctttgcagatggctaagtttccttcaggctctgacatctgcctcatgactttggcactcttgtcatgaagatgaagtgacagttcttttaaagtgggaagccagacacagggtttctagtttgcctgagatt

SEQ ID NO: 9615 - DNA, 392 bp, Homo sapiens
ggtgcgcgctgtgggctgcctccccgtgctgtgtagcgggacggcaggtcatttattggggaggcagtgttccctaaacaccttaccagcagcttccattttggcatggaagagtgttctcggcaatgtgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagaacaggagaaggtggaggcagacatgatccagcagaaaaaaaaatgggacc

SEQ ID NO: 9616 - DNA, 415 bp, Homo sapiens
ctgtttttcccagcccgttactcctgtagctctgaatggaaacagcagctcacatgtcacctctgtgtgacggactcggccccacccagacacacaggtgtggttgtcagcgagcacctcaggagaactgagaagctctttttcaccattctttccccaaatcagtcaaaaccttttaaaaaccattatgagttgtgagaaggtttcaacagctatgttttcaaagtgtgtgtatatgatggcactgtggtcagttcaccaagagcagcactgagatgggtggatccaggtgcaccttgaaaagttaattgcacaaacctttgctttgaccccaaatacgcttgctagtgcccttccctgcagcttcccagacaatcaacagggtccatgggggcagggcctggcacagcaatgc

SEQ ID NO: 9617 - DNA, 393 bp, Homo sapiens
  misc_feature 382: n = A,T,C or G
gctttttccagaacctcgggatccctggagagagcatttcccttggcttcagctgcagcccctctttctagatggagggagctccatcgcgggggtcccccagggggacagataccttcctgttccctctgcccaagggcccacgctcagagcactgcctcccacactgtccctctgcagatcaaccgaggcattgactccaacagagagtggattctaatttagtcttggctgggacccctttcccgcaaaaagatatctgacctgatgtcttgccaagtctctaccctcctcgggcttacatcatggaaactgtctcttttacttcatggaattcaagaacactttcttccttctgggcctgaatctgaagccagtcacnaagggaaggcc

SEQ ID NO: 9618 - DNA, 392 bp, Homo sapiens
gttcaacatactacagactcttctctcgaagaaaaacaaaggacattagactcaggcacctctgaaattgtgaaatctcccagaatcgagtgttctaagacaagaagagaaatgcaatcagatctcatatatagaacctgtgacaatgctttcattttggcgcttttcacttctattgtggttcaactcataatgacaagagacagtgatggttatgaaaactcaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagagga

SEQ ID NO: 9619 - DNA, 401 bp, Homo sapiens
agcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttgaggaagtttcggatgtggagatcatcacacggaaagatgaccaaggaaacccacagaaagtttttgcatatatcaacatcagtgtagcagaagcggacctgaaaaaatgtaatgctgttttaaataaaacaaaatggaaaggtggaacattacaaattcaactagcaaaagaaagctttctgccagattggcccaagagagagaagcagcaaaagctaagaaagaagaat

SEQ ID NO: 9620 - DNA, 396 bp, Homo sapiens
gttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaagtttcatgacccacctcacagggtatgaa

SEQ ID NO: 9621 - DNA, 385 bp, Homo sapiens
gtaactacaagttactgggcagggatggttagctgggaggtatggatttcatttccattactaatgcctgcaattgctgataatagacgtgccccaggaatcgctgcaagggaaatggaacatgggtctccttctgtggcccaatctggaatgttagtggtgcaatctcgactcactgtaacctccgcctcccggattcaagagattctcctgcctcagcctcccaagtagctgggattacacgtacgcaccaccatgcccggcaaatttttgtatttttagtagagatagggtttcaacatattggccaggctggtctcaaactcgtgacctcaagtgatctgcccgcctcagcctcccaaaatgctgggattataggcgtgaa

SEQ ID NO: 9622 - DNA, 376 bp, Homo sapiens
  misc_feature 225, 232, 247, 253, 257, 263, 270, 281, 285, 290, 296, 308,313, 325, 342, 363: n = A,T,C or G
aatttttgtatttttagtagagacggggtttcaccatgttggccaggttggtctctaactcctgaccttgtgatccgcccaccttggcctcccaaagtgctgggattacaagcatgagccactgtgcccagctgagtctacctttttttttttaggagttgtaaataaaacaagaaaataacactattagttattttattactaactatacaactactttaacanaacactnttttttcccaggggnggggtngggngtaaangggcctnttgtaaaaatnactnttggncatggnaatgggggattnataanaattttgccatnttagggctgctcacagnatttggggccaaaccctacgngaatatatgtggg

SEQ ID NO: 9623 - DNA, 381 bp, Homo sapiens
gctaaatgcattttagaaatggtgacttctgtggttttcttagcatttgtctctaacaaatggtgaaataattactcatggccctctctgccattgtctttcattttttcacagtgaaattagacccctttacttcaccattctgccactgcaaattaagtataaagaaaatagcaagagtgtccacaccagtagacagtaagcttctctacctgtaagtgatgaaatcatagctaatgcacttgccatggagttttcaagatgattggtgtcagacagttttcactttgtttaaaaagtgttggtggccttttgtggtggtgttacaatcctctgggggcttaggaggatgttgatgcaacttttagaagcttttaattt

SEQ ID NO: 9624 - DNA, 393 bp, Homo sapiens
  misc_feature 336: n = A,T,C or G
gctcattatctcttgttgaattaccatagtctaaggggtaatttaccatggatagtattagggattccaaaaccccatcttatcagtgttccacagtttatcagactcagctagtacacactaaatgactcttaatagatagtttattaacttacaatgagaaatattaggtcaagcggatgtttgcgttgttataaacacattgtctctgttcaggcacaacttaaagtcacattgccacaggtttcctggggcacacagaatcagtgcaggaagagaggctgctgctttgcgtggccgatggcatgagtcctttctaatccgaccaaccgctgnggcatcatcctgctgcagctgaggtgaacggggtgcttgcatttgctgcagtatggg

SEQ ID NO: 9625 - DNA, 393 bp, Homo sapiens
gcggcttccttccggctctgcgctcctggctggggctgctgggcggctggggccgggtccccgcacccggctctcaagtccgggattacccgcagggcctgagaagcgctttgccccctacagcctctcgagccagcccttggctcggaattggagaatggtcctcattcttacccagatctcacacgccgtccccgctcccgatcccagggggtgacaggcgcgcacgcctttcaaacacgtgttaaaatccaagacgtcgtctcaaatgccagagatttgcgggaatgctcctggaaggcctcaaaatcgccgcaagaacagtccactttggaaagtgaagaatggaatccttgggaaggagatgaaaaaaatgagcaacaacacagattt

SEQ ID NO: 9626 - DNA, 374 bp, Homo sapiens
gtgcccctccactccgggtcccaggggagactgacacccaccaaggcaaccacctgcttgttacagagccctgcaggaggcagctcaccacccacgaggagggacttaggcagcggacttgctgagggcagagccttgtgaggcaaatattatcacactaatttcacaaaggaggaagtcaaagctggccctgcagtatgaagactcaagcccagacttgctggctcctgcctgcatctccctccacctgggtctcctgtctccctacctgcggaaagctcacactctgaatcattgtgcatggctcttaccccgccaccccatccttgcggctgctcacctcctgcatcacctgtgcccactcaacagcacac

SEQ ID NO: 9627 - DNA, 382 bp, Homo sapiens
gcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtca

SEQ ID NO: 9628 - DNA, 381 bp, Homo sapiens
  misc_feature 364: n = A,T,C or G
ggcaagtcaatcttttttatttccttataaaattaactcttcaaaagctgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggnacatactttataaaacc

SEQ ID NO: 9629 - DNA, 366 bp, Homo sapiens
  misc_feature 360: n = A,T,C or G
gtatttttgatctgagaataatctctatgacttcggtaaactctagtgtgtgttgataaaaagtaatcatcagttttcttattttgccaaatatatatactttaaattttatttttttccaggaacactatgttgagatatcatttattttataattaacgcatgttcttttatttgtttttgttttttttttgaaacggagtcttgcttgcattgcccaggctggagtgcaatggtgcaatcttggctcactgcaacctccgcctcccaggttcaagcggttctcctgcaacagcctcctaagtagctgggattacaggcatgcgccatcatgcccagctaattttttgtatttagganagatga

SEQ ID NO: 9630 - DNA, 368 bp, Homo sapiens
  misc_feature 360: n = A,T,C or G
gctggacccagcatgcacacttctcggctaagagtcaccctggatgaaccaccattgccagcggggagcatgttgcagctttcccacgcagtggatgagaacgaaggttacgaccattgtgtgggaggcgtctgtgtagcaattgctggaatcacttgtggcattgtagaaagactgagcgtgggaaagaagacgcattctgaagtcaccccgatttatgttaaattatcaccttgactactgctatagaacgaatgtttatgtcccccacccaaattcgtatgctaagacctaatagccaataagatagtattaatagatggggcctttgggaggtgagtggctcatgaaggcagaagncttcaaaa

SEQ ID NO: 9631 - DNA, 361 bp, Homo sapiens
ggaaggccaagttactttcatggtcttaccctctgcttttcccctttttgcaaaaaaccactggccaaatccgaaccattgcccttgtttcccccacgttctctctcagatctttgtctcgaagggaaaacatagtggatgaaaaggtgtggcaggctttggcaccttgttaaaatttctagtcatctgtggatgttaccttgcttgtccacagcagccagtcaccctggccagtcccacttcctggataattctctaccctcaccccacagagccatctctctccagaccaaaagctggaaggagagttgctttgagagcttgtttttacaactgcatgtttattatgatctttctcttc

SEQ ID NO: 9632 - DNA, 361 bp, Homo sapiens
  misc_feature 337: n = A,T,C or G
gtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagntttaaattatgatatatattaaaa

SEQ ID NO: 9633 - DNA, 386 bp, Homo sapiens
gtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcacaagtatatggaacctctgcaggagattccatttgttatcccacgacccatccttgaagaaggtgatgcttttccttggacgatcagcttgcataatttcagcatatatacccttcttggaaaacaagtgacactttgcctagtggaacctatgggttgcacctccactctagctgtcacgtctcaaaaactgcttgctacgggacctgatacacgacattcatttgttgctgctc

SEQ ID NO: 9634 - DNA, 352 bp, Homo sapiens
ataacttggacagtctatccttactagaagttgttgacttggtggagactactcaggatgttgtagatgatgtgtggagacaaacagaacatgatcattatcctgagtcacgaatgttgcatctcttagacatcataggtggttcatttggaaggtttgttcagaaaaagttgggaactttgaacctgtgggaagatccttattatcttgtgaaagaaagtctgaaagctggtatttcaatttgtgaacagtgggtgatagtctgtaatcatctaacaggtcaggtgtggcagcgctatgttcctcatccatggaaaaatgaaaaatattttccagaaacacttgacaaact

SEQ ID NO: 9635 - DNA, 345 bp, Homo sapiens
ctaaaccagagctctgacctagatgtcactgtagttggagagtcttaacagtagctgatttactaattgtcatttcagaagatagtaagaggtggaaatgccccagtgaattttgttaacattattattgagggcctgctgtaataaatatctaggaactatttaggtagtagaaaaagagtatatgtcctttctgtctgccttcttttggttttttgcttctcttctgccttaattaaacatgatttggaatagttatttttaccttattactcaagttaatactttttttaatgagcagtatgtcacatcacctaaagatgactgctttttaaccagcttcta

SEQ ID NO: 9636 - DNA, 346 bp, Homo sapiens
ctttttaaatcttgaaaaaccaattgtttacttgaaacttgaaagtagcatatttttctgttttttggttgtttgttcatttgtattagcacaatttaatgtaattcctggtttggaggcagcaagacctatgagcaagaactatttacttgaccctcgtttttttctcttgttcttgtgtggtctgaaatctaaaactagactttattatgatagatttcctataagccaatttctaataacaaatagatttattatttaatctgtaccttctatcttctcataattcgtggtcttacagccttccaaaataactccagttgggcacccatgagctaggatcaaa

SEQ ID NO: 9637 - DNA, 337 bp, Homo sapiens
gccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtgg

SEQ ID NO: 9638 - DNA, 344 bp, Homo sapiens
ctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatgg

SEQ ID NO: 9639 - DNA, 347 bp, Homo sapiens
attcttacgtgatagtttgttttccttggttgcttacttatctttcttcattagaacatcaagttccatgggaagagagacttgggctgtcttccatgcctgacagtagtagatgcttcataaaagtttgcatatgcaaatatggaagttttcatcctttttgctataaaggatatctaagtttattatgtggaaattttaaaaagatacttttacattgaagatttttttccagatgattagagaaatggaaatagcttaactagtacaaagagcactggacaagaagtcaaaacaacaggattctttaatcattctgcaactaattacatttgccttatagcaga

SEQ ID NO: 9640 - DNA, 346 bp, Homo sapiens
gcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgccgtcgccacctctgtatccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcaaaaaaaacaagtgtcttccaccagagcac

SEQ ID NO: 9641 - DNA, 342 bp, Homo sapiens
  misc_feature 221, 240, 260, 277, 280, 290, 291, 292, 302, 303, 320, 326,329, 338: n = A,T,C or G
gagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggcttcgggctgtccagacccggagaggcagggctgtgggggcaagaacggtagtgggccctcatgggcgattagcttantgagcttaccccgccggancgggggagcgctagaggtanttgggtagagaagccanctnggggctacgnnngacccatatnncaccccaggcggaccanatgtgnaangcgcggcgncgta

SEQ ID NO: 9642 - DNA, 345 bp, Homo sapiens
ggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtacacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctggg

SEQ ID NO: 9643 - DNA, 418 bp, Homo sapiens
gaaagggaggcaaaaaaaggggaaataataagagaaaaaaaagaacaaaaaaagaaaaagtcctactgctctgcctgtttttaatactgacaccccataaacaaatctgtccctgggatatgatacagaggcctggagcctgtgacctcctttctgaatctatcaggagacacagcccacaccaaaacaccaggagtgttgcttctgccaaatatcctttactaacttcaaagaaagaacggggaaagagctgtaataatgcttaacacgaaatactgcctttctgcttcctttcctttccccatagactgaatgaactgtcattataagacaacatactgctgagttaatgtaacttaaaaatttacagcaggttgtatgcctggaggcacattatggggcccctgtaggcatctaa

SEQ ID NO: 9644 - DNA, 416 bp, Homo sapiens
  misc_feature 401, 402, 404: n = A,T,C or G
gtgatatgcttgtcaaagtgctgggattacaggtgtgagccactaggcccagcctcagtttcttttatggactcacttacctctgcagattggctcaaatgtcattattctcaggcttctctcctgtttacaggtgtcctgggccatccagtccagtctcatgatatttgccacccaatgtgctcatgtttcccaaaccagcatctcttctctagacccatcctctaattagctgtttctcaagcaaccttttgactgttgtttctttttacttccctggtaccagggataaaagtcccctgaattcaaacatgaatattcacctcacccagtcctctgggaggtccataagtccctgttttgggaagaatgaagctgagctctagctaaaaaaaaacaannanatttggggatct

SEQ ID NO: 9645 - DNA, 410 bp, Homo sapiens
gtggcgctgtgtttccgtgctgtggagttgcctggtccgcttcctccccgcgaataagaataaaagattctggaggagttggagaagagtgtattcagcccccaaaccacgagatcaacaaattaggtccacaaagatgtgagcaccagtttgggtggtggcaccacttgaattttcccatacttaaagctgactcactagaagtcttgggacaagtcatcgaattctataatgaaatgcacaattttgaggaagaattaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaat

SEQ ID NO: 9646 - DNA, 408 bp, Homo sapiens
  misc_feature 390: n = A,T,C or G
atttccctgtgcttaaaccccttccttgttctttctttcatgtggctggcgttcagggccatttacaatctcacacaaactgcccttccagctccaccttctgattcttgccaccatgagcagcttctgtgtttttttgttttttttgtgtgtgtttttttgtttttttttttacaaacttccctttgaaaatgctgtacttgttcacctccctgtgcctttacacataccattctttctgtctgaacatacctgttgaccctttaatacccactgtaataaatgttgcctcttctctcaagcctttcagtccctataccattaccgttttgtacatacaacgtgctaggtgtgctcccacgtgagattgtaaacttcttgaggacaagnctgggttttattgatttt

SEQ ID NO: 9647 - DNA, 408 bp, Homo sapiens
  misc_feature 402: n = A,T,C or G
accttttatagatgtaatgaaatcccagatgttacagctaaaatgttttctgaatagacttaatttaggtgtgtatctactttataagtatattataaggatcatatttcggatattccttcctttccagattaccttatattctggtcatctcttccccttcacattcattgcctgttttcaatgtgggggttggggggatactaaaatatcaaggaatgggagccaaaaatcaaactaaagcttttctgtatctaaatttttctggatatgtttttagatgcaagatactgtttacttgaatccgtaaataaaaatggctgtgttttgatagaaacttacacaaatgtattgattggtgaaaattcagcagggtattcatttaatacctattcattttgncatatg

SEQ ID NO: 9648 - DNA, 399 bp, Homo sapiens
  misc_feature 370, 388: n = A,T,C or G
attttagtgactatgatccagtttatccccaaatgcaagaagtcagtttttcagttataaatgctttcaatcatttccagcaaaccttgctcagccaattcttttacaggtgaagtaatcccaagaacattctgttgcttattcattcaacaaacctggggcatctactgtgtgccaacatttgtgtgatactcctgggagtcaagatgtgatcctggccttgaagctattcttaaatgctttgactcttgagagctagtggtgttttagccacttactttttctgtacccattttttcttcactttgattttttcatttttctacctgtatgaactccaggtacttgttagcttttcgtttttaaaaanttgcatctttcctgatgnttctttagctt

SEQ ID NO: 9649 - DNA, 395 bp, Homo sapiens
  misc_feature 256, 274, 284, 315, 336, 354, 362, 388: n = A,T,C or G
ggaaggagaaaataggaaatgaaaggattaggacttgggcatttatattaatacaaaatggtgtaaacggcctgaatatcactgtagtagtatcatacgggggaaagtgtgatggaaaataggtttaaaaatcttaatttttaaaactttagtaagctttatttatattttttaggattttctgaacatagcatgaagggtttagattcatttttctgaaaaacgattaaaaaaactaccaattttttttttgagngcccacacttgccgttgngctgtatacntgattttaccttaatcctctataagggaggngctaattgctccattttatanatgaggaaaggctcaaanaaattcanaaacttggctaatttaacacagctgnacagagc

SEQ ID NO: 9650 - DNA, 418 bp, Homo sapiens
gacaccatgtacagggactccagatgccccaggcagaggtaaaatgctcgaaagagaggaacatcactacctggcgggcaggtggggacaggcttgccacggatggtctggggatgggataactctctggctcccactctgagaagcaggaggtgatctggccacaagccctcaagacgtgttgagtttgggaatacctcactgctagggaataccaggaattatgcaattcactgtcttcattttaaaattctgtatgggagaagctaaaaagtgaagttggggggttttagtatatttcatttgcattggtttactcttctcgttccttgattatctgagaggaggctgctgttacggaaaagcgaaaaccaggagtggtttgaatattcttccttgagacttttgactgtttcta

SEQ ID NO: 9651 - DNA, 389 bp, Homo sapiens
gcaggtctcaaactcctgagctccagagattggcccgccttgacctcccaaagtgctgggattacaggtatgagccactgtacctggcacaccaatactttcttgcccactttctctcctgttcattccattttgttatttatgtgattcttaggttataatcagttttgagaggttgtacatttactcatctttgtatatcatccccagcatcctacacactgtagatgcacaaatatttttctgacaacttaaccctctgaaggacagcatatacttttggagggtgtgggaaacactgggtaaaaaaaataaatttgcatttaatagagtgtactcatcattccacagaatttcacaacacactttgaagtacagaaaatttatag

SEQ ID NO: 9652 - DNA, 410 bp, Homo sapiens
  misc_feature 406: n = A,T,C or G
gtctttccctctctcctgtgtttgcctctctgtcctgcccctgcgcacccctccctgtgcccaccctgtttctgtcgcctgcggctcttgggggtgctccattctcccgccttcccttctcctgcacctggtcctgcctgctttctcgctgtctgccccaggaggtaggtacacgacctgtttttgtctcccatcactagacgaggggagggggctgccctggcgccctggcgccctggcctcctgcccacaggaggagggggctgggggctcaggctcctgggctgggactgacagactcagaaaatgtggagccccaagctgggggtggacgattctggaccccaacatgcctggcctgcttgtctgtctccccaacgcaacggctttgtctaagccccaagancccc

SEQ ID NO: 9653 - DNA, 386 bp, Homo sapiens
cccttatagtaagtttgtttaaacaaagtacagttaatattactaaataaataacaaggaaataagaactgagtagtaacttaatgttttgatttaagactaattttaaagcatgcaatgtgtttgccgtggcagcacatgtactaaaaagtgtgcaatataatggcttattttcatgggaccatgcttaactagctgtattattaaacaactccatgtttctgaggggctcccaactctttacttccattttgattgaatttgttttcagaagttgaagaatctgccattgagaagcactttctggactgtggaagtatcatggccgtgaggattgtgagagacaaaatgacaggcatcggcaaagggtttggctatgtgctctt

SEQ ID NO: 9654 - DNA, 386 bp, Homo sapiens
atcagaagaggtcagttaaatattcacccaggccctgggggctctcttacagctgttctggcagatattgaagtaatatggtctcatgcgatacaaaaatacttggaaatcccactgaaagatttaaagtattatagatgtatcttgttaattcctgatatctataataagcagcatgtgaaagaactagtgaatatgatactaatgaagatgggtttttcagggattgtggtccatcaggagtctgtgtgtgccacctatggaagtggcttaagcagcacgtgtattgtagacgttggggaccagaagacaagtgtatgctgtgtggaggatggggtgtctcatcggaatactcggctttgtctggcatacggaggatctgatgt

SEQ ID NO: 9655 - DNA, 402 bp, Homo sapiens
ctcatgtttcttatgtctcacctctttccagagccaaatcagccccttttggaatgatgacttcattggaatgcaaatcaagtcattttggtgcatcagtggctcttaggcctgcacacacgagacatcagaatccaatcctctgaccctgtgccagccctttcccccagtttatttcccaccaaaggctgacctctaagaggtcttgctttctatgaactcaagatgggtcccacctctaggtgtccccaggtgcactcttctaccggttggcttccgatgtgacaaggccaagggcccaaagacttgaccctcttacacccttgctgacatggttccatcatgtccacccgcatgcacttttatggtttcatcacccagcctcttctctctggccaccca

SEQ ID NO: 9656 - DNA, 402 bp, Homo sapiens
tggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactc

SEQ ID NO: 9657 - DNA, 377 bp, Homo sapiens
gcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggcaaaggctgtgccaaaat

SEQ ID NO: 9658 - DNA, 373 bp, Homo sapiens
ggaaagtcatcataacttccttcactcagtttctgtcttcttccagtcagggatctagtagcttgactattcttcattggttccctttcatttacaggtcacccaacaagacaaaccacacaggtaatctcttctgatccctgccatcgccaagagtcatttcctgccctcatcactttctaaattctatccaattcccagaatatccatgctccttctcactgtccctcattcacataatgcctaaaacactattcctgctctttgcctgatgagcccttactcacttgtcaagactcagatcaaattgtcaagactcagatcaaattgtcacctcttctgggagggcttcctcaacctctctaagtggagt

SEQ ID NO: 9659 - DNA, 374 bp, Homo sapiens
gtgggggagttggttctagtactgtcacaaacttgccatataacttgaaataagtctctttacatatttatgccacagcttccctctgtcaaatggattgtttgggtgtttttttagactgtctgcctcagggatccgggtacctcaagggcttctaagaaggaaaaaattagtgggattctggtcctccaactagaagcagccccgtgttttgtctgttttttagacaaaccactatcttagatgggggagcagtgtgttctgagttccttaggatttctccatgattaaaatgagtgtggttttgattagtatctccttatcaattaaccagttattttgattattttatttttaccaggtttggagaaaat

SEQ ID NO: 9660 - DNA, 398 bp, Homo sapiens
  misc_feature 370, 381: n = A,T,C or G
tggaaggctgcggtcgcgctgtcgctgctgttcccaccgtcggcgcggggcgcggagggggcgaagaggtgcctgccagtcgcactgcggtctaggggtgaaaggaaaagggtccatgtaaaggagaaagggcaggcagagactcttgctggtgccagcaggcacggaaggatgtggccgcggggacttggagtttagagggcaacgctgggtgtcataatgccggagatgaccccgggtgcagaggcgattccagttgggtagagctacagagaacgtggcccgagaaggggagcttccttaaattagacatatcctgtgttgtcctaaacctagcatttaccctctcccaccccgctcccacaacctncagggtcctancggagtcatttaagccc

SEQ ID NO: 9661 - DNA, 389 bp, Homo sapiens
  misc_feature 170, 174, 176, 180, 189, 196, 200, 208, 209, 210, 219, 224,232, 234, 252, 259, 261, 266, 268, 270, 271, 276, 277, 283,284, 297, 299, 308, 316, 331, 336, 337, 346, 347, 348, 351,352, 353, 354, 359, 361, 368, 371, 373, 375, 381: n = A,T,C or G
cagggttttgctgttacccagattggagtgcagtggcatgatcatggctcgctgcaacctccaactcctgggctcatgcgattctcccacctcagcctaagtagctgagattacaggcacacgccaccatgctcggccaacctttttaatctattttttgtagagatgangctntnctgngtgactcantctgggnatantctccctnnntaaagtganccttnaaaattgnanaacaattccagtcgtcancccccanantttangntnnttttnngccccnnccccccccccccnanatttttttntttttaanaaaaaacaggggganccaannatggggccnnnagnnnngctananacaccgnccngngnaaaaancccccctt

SEQ ID NO: 9662 - DNA, 384 bp, Homo sapiens
  misc_feature 338, 340, 369: n = A,T,C or G
gctgattgcttttctgtcgctaaaacctatcaggtctgcaacatgactttctagtagagattttccagttgggccttcaaagcggcaagatgctttgcagacactaagaaataataccagggaatgccttcataagtattaccataaacacaagcttcccattttccagttcaaggaaggacacagagatagaattattgtgagtgcccagcaattacaactaggaccagaggtgtgtgccaaatcctacccctaatttcatttacttggtgtagtaaaagttaagagtgggatgttaatattaagcttctggtttgtctatttagcctttggcttangnatggtgtgaaagtctatttctgcaaatgngataaaaatggcttt

SEQ ID NO: 9663 - DNA, 363 bp, Homo sapiens
gcggaattggccacatttccagtgtatgtgccctctctaaggaaagatgacaaagaaatcaccgacttcttactgtgttcactgggatttgcctgccacttggttatcattactgttgggtgaacccgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtgggttacctaataagttttgttctgttcataattcttatttctcaacctgggtgatttttt

SEQ ID NO: 9664 - DNA, 363 bp, Homo sapiens
gggacccttctggatgacctcttctctgaggcgcccatctcgtgctcccagggagcactcccatctcctccctcccaggggaagtacacattgccttatctccatgtgtcttaggatccttcttgtccttacactggtgtcttcaaacgacatgtcctaaaagtaaatgtgggtaagttgaatgacctgagcatccattcctcagctattcaaaaagtaggggtagtgccacctatcttggcagtgtgttgagggtgcccagcacgtaccttgccatccctcgttctgtaggctctcacttccagttcctcagatgaagtacagggcagggaggagcttctccggtactggcatcttaagcta

SEQ ID NO: 9665 - DNA, 362 bp, Homo sapiens
aaaacgggctggggaccactactcagaggaccctccttcttgctcccttccttccctccccgccaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggccgcctccccgtttcgggcccagcgctcacaaactctgctaccacctggatgttac

SEQ ID NO: 9666 - DNA, 361 bp, Homo sapiens
attcaagacgcaagagagcctggtgtgtgaagcgttggcagtagttcagcctggctagagagtacaaggggagaggggatgtactgggaatggtaaacagaggccagataataaagggtctgtcttctctgtctcaaagatagaactctctctgaatgtattatagtagtgaaccctatttttagtagaggcagcgatgtcatcgtattggcgtttcagaaagttgccttaggctgtgatgtggaaaatggatttggggagagcaaaactaaagtcaggaaactgctaagataatccaattcagtggattcagtaatatttaaatattgcattcaaatattcagtgagtatcttctgtatg

SEQ ID NO: 9667 - DNA, 384 bp, Homo sapiens
ggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacaggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagctttagaagaaataaaagggcaggttgttgaaaacaactctgtaactgaattttctgagg

SEQ ID NO: 9668 - DNA, 343 bp, Homo sapiens
atataacatgggaaccaatgttatctttaatgttgcttgttctggtgaacagagaatcttaagagctgttagaaagtagcacttgatgcaagggatgttttgaaaagaaaaaattggtaatgcgaatgtatagaaagtaaaggtaggatgctcaggttttctgcatagttcttaactaatcttgtctgcagtttggtattgataatattagcatggccacttatgctaaatacacaataagatacatttagaaatccttaatgtactggttaggtcagtggtacaactgtttgacttaattatcacaatttccccaatggtaaccttaccttggaaactatca

SEQ ID NO: 9669 - DNA, 345 bp, Homo sapiens
gttcaaaaccatcaaaaaatagtgatagcaaggacatgaggaggcacctggggtgctcgctgttttctattattcatctgtggaatggtcacatgggtatatatatttagtgaaaattttatcttgctatatactcaactatttgtacactttaatacatgtacgttttatacttcaaattaagcatttacttacaatgtcagagactttgatttttgtataacagaacaaaaagtatacagaatgaagtgtgtttctgttttttgttggaatttaaattcttattttgctcttcgtgtttgccccttaaaattttctcctttatagtccctctggtgataatat

SEQ ID NO: 9670 - DNA, 340 bp, Homo sapiens
aaatgagataacaagagtgctttacttcatttgattttggggaagatgaaataatttatgccaagagcttatagcatagtgcttggcacagagtactgttcaatactgatgtttaatcaatgctgctgctatcattattatttttggaaaaaagggaaacaaatatggaacttaaatagttcataagggcatagcctctagcagcctctacattccaggtagggggcagtgaaaaagagcaggtggaggtcaggagttcaagaccagcctggccaatatggtgataccctgtctctactaaaaatacaaaaattagttgggcgtggtggtgggtgcctat

SEQ ID NO: 9671 - DNA, 418 bp, Homo sapiens
  misc_feature 151, 154, 161, 172, 178, 181, 185, 197, 201, 204, 206, 218,225, 228, 271, 281, 289, 320, 327, 341, 349, 358, 364, 382,384, 409: n = A,T,C or G
gggggacgggtcgggacaccagtgaaacttgaaccgggaagtgggaggacgtagagcagagaagagaacatttttaaaaggaagggattaaagagggtgggaaatctatggtttttattttaaaaaagaaaaaggaaaaaaaaaaagtcantancaaaaancccagctcaanaacccnttntacnccaaactggaangganaananagcaccaggaanattccanaancggggggccccagtttttgaaaaactttatgaacttttcaaanattattttcntatggcancaagtgatacggaaaactgctgtcagggacncctgatntggaaatcaaatanatttttanttaattgancataanatttagggatttttccananctcgaaagggtcaacagccctccanaatgtcggc

SEQ ID NO: 9672 - DNA, 421 bp, Homo sapiens
gttaatcttcacactagcctttcaaagtggttactgtatttctgatgagaaaatgaagccttgttcagtaactctagaatcacttagctgataagtggtcaatctgggattcaaatccatatctatttggcttgaaaagttgggtgttcttgtcactaaatttgggaatgagcaggcaaaaagaaacacatggaaggaatcatctcgtttgagggattcagtactctcttagcagtacagtgtgtaagggaaggggatttgagtttgttagtcctgttggtgtttgttagttgccactttatcctgtcccactatgatttgtatgcacaggaggaaaaacaaaataggaaataatctttggaactctttatggacattatcatgaacaattagaagaaatggcaatgtagcttctgacatt

SEQ ID NO: 9673 - DNA, 417 bp, Homo sapiens
gtgagcccaggaatttgaggctgcagtgagctacagtcataccgctgcactccagccttggtgacagagtgagacccttgtctctgaagaaaagaagaaaagattttatgaaaacgtctaattagaatcaagaaagtcaatttcagacaggaaggaaccaggagcaggaaaagtacaggatttatgtaagctgtttacactttggtttaattgtggtttggggttggcatgagacagaaggaaaacagaagttgaatccggatggagagttatgaaagccaagggtggggctttatttggtaagcagtggagagccatggaaggtttttaatgcggaagataggagattgattcattcataagagcactctggaatgccatgtgggatgaatatgagtgaggcaagacagaagacat

SEQ ID NO: 9674 - DNA, 396 bp, Homo sapiens
aacagaagaaagcaatcttaatatgttcacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgacgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggccagcttctcctgcaagaccaagatccgattatcttccgcaggaccaagaagtc

SEQ ID NO: 9675 - DNA, 388 bp, Homo sapiens
gtggaactataaaaatctgttcttatataaggtaatctttgtgaaaatacctggtaatatctacatcaccactaaaaaatgcaatatatttaaatgtgaattaagtattttagtgtataaaacattgctagtttctacttaaagtttctaaaagggtgtgtaggggaaatagaatgagtatgttgaaaagtaacataaggaaatatatcttgaggtccaaatgacaaatgcagacaatgactgctatagggatttgttaagaggggaaatgatttaagagatgtcagaagacttcacaaaggatcaatactgaggagtagtgttagataagtggaaggcaatgcagtggtaagatagtaagggaattctagagctggtgggtaccata

SEQ ID NO: 9676 - DNA, 397 bp, Homo sapiens
gtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacataacagggtttcctgattatatttac

SEQ ID NO: 9677 - DNA, 382 bp, Homo sapiens
gttttgggctgatttttaagtgtacttatgtattttattttaaaaaggtacagatagtgttaagttttttcttttgattattcccaacagctaatttgtattagagataattttcttatctaattaacctattttattttaaataggggctgataaaaatgaacttcaatttaatcatatcttcattagttggttgtttttactgagaaatcgtagggctcttgaatactataaattttgaggtcatcctgtggatatatatcagaaaggaagaaacaagttatcatttggtacactatcttcattttgtgtaaaaacaaaagccttataaagataaggacttgttggattatttatttgtttaaccaatattaattgaatg

SEQ ID NO: 9678 - DNA, 384 bp, Homo sapiens
gaaagactttggaaggagggtgtggtccagcagatttcggcttcctcccagcccatcagtgactccttcttcctgctcctccctttcctctccacttctatcccagttcaattcctcagatccaaccagagccagctgtcaatgaaataccttctgcctttcttttctattacagtgtgggttagactctgtcaggtaggaaactactccccataatcaaactcattatgtttgtgatctcagcatatttgcaaacttagacatagaccagacaataacatttaccttctccatttctcccattctgggatttttagccaaggtaataataacaataataatacagtatttagaaggcctctagcaatatttcatcttctgaga

SEQ ID NO: 9679 - DNA, 382 bp, Homo sapiens
agtggtcagtaatggccgggcgtggtggctcacgccttggcctcccaaagtgctgggatgttttcaacccctatttgtctatactctactacagtatcgacttgtgttagctttttaaaatcccatcgctacctttaatgtgtaaacgtgtggtcttagaggaaagatcatgccagcaagaacagattccacacttaggagggcagaacaaatgatgacctgatcattagtacaatatatattcattttgagctgaaaatttttttaaatagcccccaaattattgatagcttcattagaattgtttttacaaatgtttcatttatcagtttaagaaagatcttttgatagcttttatcatatggacctgtggagaatctct

SEQ ID NO: 9680 - DNA, 409 bp, Homo sapiens
  misc_feature 405: n = A,T,C or G
ggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgacatggaggaaaagatgtatatncagg

SEQ ID NO: 9681 - DNA, 381 bp, Homo sapiens
agaaatatagtaaacataaatttgcaacaattttaaagctccagtttttaggtgactcaaagaaagtcattatgcctattaatagttatttgatgccatcaccaaaagtctatgtgaaaatctcctaaagtcaaaacccctgcctttggttttacagacggttattaccattgggtggagctgcaaggtcaaatttctcctaagttcccctatttagaggaaaagtcactggttattgtaataaaccacccatggttctttatgtacattttgataacacattattatagcttgattttaattttttgcattaatttttgaaatccacatacatctcatttgtttaaattaaggccatgcacaaatattttttttagttca

SEQ ID NO: 9682 - DNA, 354 bp, Homo sapiens
  misc_feature 345, 347: n = A,T,C or G
gaaaaatgagtaggagatgactgagagcttaaagtttgggagtgtcaattaactcagcattcttttaaaaaacgtgtcatatattacagcattttcttttatttgaagtgagtaaatgtatctttttaaattccttagtaatttttgagcactccatatgtataaagcatgtgaatatttggtagcattttacaaatgtccagagatttgtgagagttcctgagatcttcatagggggcccacaaagtttagtattacttttcacggtaatactaaagtgtattttgcctctttttactttttctcttaatagcatacagtggtaactgaaggctaatagtatgngnggttatg

SEQ ID NO: 9683 - DNA, 386 bp, Homo sapiens
  misc_feature 316, 328, 343, 345: n = A,T,C or G
ggagcttgcctttggctttccaggtggctccgtgcagctacagccaggccggctgcctcatctcagctctagggggcacgagccatatggggtctgcacaagagaccctctcccctgcagtaaagccaggggccctggcctgatggggcccccatggggagctggagcctgccctgcagcctggagaagagggtggctgtggtgggcgtgctcatcccctgctaaggagcaggagctgctgggccaggtctgcggcagtgctggggtggcaccaggtgggcagtggtaggtggggtggcttgaggtctgggagggnggccctggccanccaggacacatgcananccctgctttagtctggatacaggcttccttttttcttccaa

SEQ ID NO: 9684 - DNA, 360 bp, Homo sapiens
  misc_feature 256, 260, 263, 264, 267, 268, 269, 270, 271, 278, 284, 285,288, 289, 292, 293, 309, 312, 313, 321, 323, 334, 337, 346,349, 352, 354: n = A,T,C or G
cccaaatctgtagattttaaaggtaaaaccgacttaagctaaacttctctgaagagaattagtacttgttttggaggtagggagtgggatagagaacttaaatgagaactaaacagtgccagacctcatgctgtcttcttgattttcttttctgctttctgcttttgtgtttgcttttggtgtgtgatggattactgatttttttttcttttgtttagattggtatagttggtttttttttgcttttttttttttnaaanggnngtnnnnnttttttncccggnnggnnggnnaaggggcccttttaanttnntggaaccntngcccccccggntcnagggaatcnccnccncncccccc

SEQ ID NO: 9685 - DNA, 340 bp, Homo sapiens
  misc_feature 257, 261, 264, 323, 325: n = A,T,C or G
ggtcaggctggtctcaaactcctgacctcaggcgatcagcccgcctcggcctcccagagtgctgggattacaggcgtgagccaccatgcctggcctaagtttggccaacttttaaactttgttttctcttatgagttttatttaatcatgaatttctgagaattgctatgagagactgcttagagtttgtttagggaaaacaaaatatgaataggagtataaacttaccattcttatttatgtcatgtaaataatgntggntgntcttctcgaggctatttagttcagtgaattagaacatagtgcccagcaaaaagcccaangnctcagctttgatcct

SEQ ID NO: 9686 - DNA, 344 bp, Homo sapiens
gatcaacattcctgatatgttgaaattatatggcttgaaatgatcaacatctcctttgcttctgtctctgagcagtcctaaatcccgttaattcctgcttagaattcctcagatcaccctctcctttccgtctcctctgccaaccctcaatcacgcttattacctctcgctggcatgtctgaaccctcctggctttccctcttctaaacaagtcagccacatttaactttctgatacaatattttaagaacatcatgttttaaatatattcaactataatttgtcaatttctaattttaaaaataaaaattgaaagagcatcatttttttcctcagaaaccttc

SEQ ID NO: 9687 - DNA, 417 bp, Homo sapiens
gaaaaaatggatggttacatctctactaaatatgtgcagtccttttatttgtcattattctctaaacaatacagtataacaactattgacatagcatttatattgtatgtattaggtattgtaagtaatttagagatgatttaaagtattttacataagggacttgagcattcctagattttggtaactgcagagggtcctggaaccaaccccctacagatatcaagggaccactatacacattaggatgatctatattgaaatctacatggaacagagtgggacttctaattgtatgacttcaagattttgctttgtttaaattaataactgttttcagaattaagtgcttaaaaacaaatttgattgaaaagttcaagacaagaattttgctctctatggctgttccatataaat

SEQ ID NO: 9688 - DNA, 397 bp, Homo sapiens
atcctaggtccctggtacctgccaggtatctctagcccagatctttctcttgccccagaccccaactgcctaggggcagcctcacagtggctgctatagcaaactaccacgtacttaccgccttaagcggcacaagtttatcttatggttctggaggtcagaggtccaaaatgtctctccctggtctacaaatcaggtgtcagcaagctggttcctcccggaagacctagaagagaatccgtgtcttgccttttgcatcttctagaggctgcctgcattctttaactcatggcccctccctccatcttcaggcccacagatgagcatcttcccatctctctgactgattctcctgctccctcttacaaaaactctagtgactacactgggccacctg

SEQ ID NO: 9689 - DNA, 410 bp, Homo sapiens
cctgagtggtatacacaaagcaattgaggaacaacctaggaccttgtagtccattaggatttccaaaaatagaaagagaatggaaagtcacctggctaggagaagccagtggaaacttgacacgaagaaaaaagagcagctaatttcattcctgtccaccagttatttatgtgtttatctttaattacatttgtttgatttcccttattaaagtctgatgtctataaaaaagcagaaaagtgaggcaggtcagcaggggatgtaagttgggaagaaagacaggtgagggcaagaatttaggcaggagccacagtgttggttgtgcaggtgaaggtcaggtgacgagggtaaccagtcatggatgacccaggcaggagccataaccaaaatgttagaaaaagttggtaaga

SEQ ID NO: 9690 - DNA, 386 bp, Homo sapiens
  misc_feature 338: n = A,T,C or G
gagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcagcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgnttgcaactatgattttgtatttttaaaaagtgagaccacagctgtccc

SEQ ID NO: 9691 - DNA, 382 bp, Homo sapiens
agcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggct

SEQ ID NO: 9692 - DNA, 351 bp, Homo sapiens
gatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacagg

SEQ ID NO: 9693 - DNA, 345 bp, Homo sapiens
ctgaaaggaaatgtgccaaaatattagcaattttttttttctgagtgatgagctttctggtgataatttttatttactttatggattttactcctttccaattacttatataatagacatataatagtattttttaagaaaagtgttatttttataataaggaaaagtaccatttaaaaacctttagtggctcccatttgccaattaaaaatcctctctatgacattcaaggttttggcaatactgctacaatccttctgacctcaccctcttctctctctgccctcactccaagaaacagcagcagaacggagttacccactgtcaccaaatacatttgggctt

SEQ ID NO: 9694 - DNA, 377 bp, Homo sapiens
  misc_feature 171, 183, 184, 192, 212, 220, 279, 284, 287, 289, 291, 292,293, 297, 299, 300, 303, 305, 307, 308, 311, 313, 315, 319,329, 334, 336, 339, 340, 343, 349, 350, 351, 354, 361, 362,367, 368, 373: n = A,T,C or G
gctggctactagtatatgtaacaggactattatagattaacaaaaatgcggggagtatatttcttgattattttttaaaagaataaattattatttaaaaatacatgaattatttattgattcttgaatctttaccagctttctataattctaggaagcctataagcaganttgggcaggatnnactggcanaaaatgtaaaaagtaggccnggcacggngggctacagtgagtcgtgaatgcgcagtgcacctgagtgatagatcaagatcctgtctntttanacnantnnnaacnanntanananngangnantccncccctgacgngaaancnaannatntttttnnnggntttaacnngaagnngggtngttc

SEQ ID NO: 9695 - DNA, 350 bp, Homo sapiens
  misc_feature 343, 346: n = A,T,C or G
gtattttgagttgaaacgttgatgggagatgcttataagctgacgaattttttttgtaatgactgttatttatgtaaaaatttaaaagcctcatttaaaaatgaccttccattaatttgttcctcgatagcaataatctttgcaatagtttgaaccagtgtcattttacaggttagaacccggcatgcaaatttaaagtcttgtttacatccttgtaaggagttggatacaaagctgactaaaagccaggtctcttagctgtcactgctgttccctttctttaaaacgttaatacctgatagatattgttgctgtatatttacatacacctctgctaatttgntgnctta

SEQ ID NO: 9696 - DNA, 355 bp, Homo sapiens
aacaatttaaatgaaggctcaaaggatgagagacatcagccatatgaagaggtgtaggcagaacattctaggcagggggagctgtaagtaggcaactaaagtgccagcaccattaaataaaatactgcttatgtggaggagaaaagctcaaaactcatttgttgtcaaaagttgacaagcattcaagaataatggtgagaatagcctgcttaatagcattattccatatgcaggttgatgccgccttacctttggacatcctaacctatgaagagaagaccttgtcagccatcttgagaatatgtagcagtggtcttgcaaattgtggagctctttgaccctggtaggatcctat

SEQ ID NO: 9697 - DNA, 377 bp, Homo sapiens
tactgatagtaagtttaaaatgtagaaattgaccagtagatttattgtactgaggatgattctgtagtttaggagacatgactagaatttcaatgagaacagattgtaaggacagaaataaataaataaaaagaatttctaaatgattttgttaaatgcaataacaactttatgtaaactacagatgaactgataatagagcacatgtaagaaaatgtctaaaaaatgttattggaaataaaattagagctgtaaatcattaacaaggaaaaaacattaacttatatacaatttattttttccatatttcttaaaatatattaaattctaacatagaaaaccacttaagagatttaaagattcccatctactcagat

SEQ ID NO: 9698 - DNA, 337 bp, Homo sapiens
gaaagttcacatgtagttgagtgtgctttttaaactctgggcctttgcacaggctattcattctaccagccacacacctctctccaactcctaactcatacttcaagtttcagtttggaagcccctctgttttttggagatggcatcttgctctgttgcccaggctagagtgcagtgacgtgacttcagctcactgcagcctctgcctcctgggttccagcaattcgcctgcctcagtctcctgggtagctgggattataggtgcatgccaccatacccagctaatttttgtatttttagtagtgacagggtttcaccatgttggccaggctggtct

SEQ ID NO: 9699 - DNA, 350 bp, Homo sapiens
aattaaaggcgtgagccaccacacccggccaatttttgtatttttggtagagatggggtttcaccatgttggccaggctggtctcaaacacctgaccttgtgatccgcccacctcggcctcccgaagtgctgggattacaggcatgagccaccgcgcccggccattctttgagttttcatcaaccagtggatacagaagtgtgctgcccattttgcagattagagaattgaggctagtaaataagtcgggacttagttgatgcccttgctctttgagttctgggctctggaggctttggattcaaagccctgctgcaccatttactcatcatgtgactttgggaaggtga

SEQ ID NO: 9700 - DNA, 341 bp, Homo sapiens
  misc_feature 118, 130, 140, 145, 147, 150, 155, 157, 181, 188, 209, 226,231, 236, 246, 255, 274, 284, 308, 316, 319, 320, 322: n = A,T,C or G
ggaggctgaggcatgaggtttgcttgaacctgggagatggaggttgcagtgagccaagatggtgccattacactccagcctgggtgacagagcaagactccatctcaaaaaaaaaaanacaccaaagatnttattaatcnctgancnctnttttntntcaattataagtaattgaaaattntaatcancctcctatttaattaattaanaattgatttaatgattnagttnaaaangttaaattcnttttaaaanaacccattacatgttaacncaaatagcangtttttattttattttattttganacaaagtntcnntntgttgcccaggctggagtg

SEQ ID NO: 9701 - DNA, 396 bp, Homo sapiens
ttcagattagacttcctgtttatcttttatattcttgcattgatataatgcctgatccttcaaagttctttcacatattatatgatcttctttatgaaaaaaagtagatgctttattctgatatattcagtttcccactttaggcaaaagtggattaatagaatgatgaattcaaagtagatgaggaaaatcaggcacagagaagtaaaggtaggtacagacccaaattcacacaagataatgacatcaccagcgtttaagttgatcatcaaaggctgggctggatttgtcttgctgtatgtgtcaggaaatttatacctattacattttccattttctcaaaataagtcacatgattgtaatgtttagctgcaacttttctcctaataaatagtg

SEQ ID NO: 9702 - DNA, 390 bp, Homo sapiens
gcaaaacctgtctggaaggagcataggaaatggctttagctaagtgcctgactccagtagcttcttgctgttgccacagtttcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagattcacctggggagcttttaaagcacacatgctcgggttctacctgcagcctactgaattagaatctctgggtgggatgaccatctatatttttaataaaagctccacaagttaattctgatgcacagaagatagacgaaccattactttaacat

SEQ ID NO: 9703 - DNA, 401 bp, Homo sapiens
atcggctgtttgtgaaataaagaagaaaatttgtgaaataaggaagatttgtgctgcagagttctttagggatacgggctgcagctgcccaggtgatgagcttgaagaacctaggcccggctggcagagtggagaggagctgggagagacagctgcttttacgactctttcatgttctagcagacgccagatgcgaggcttctccttacagggaagggttatgtttgatttatcatacatttctggagtttttgtttagtttttgttaaatgcaaagctctgtgctggacattgtgagaaacaggaagttgaacgcccataaggagtttagaatagaagtggaagaagtcagtaggtgcccaaatgctatttgagggttgaataaagaatgggtagagggg

SEQ ID NO: 9704 - DNA, 371 bp, Homo sapiens
gggcatccgggcaccgccgggccgggaggcaggaggcggggtgtccgggcctggccctgcctttttttccatgtggttctctaaacctcttgttcgtaaaaagacaaaaaaacaaaacaacaaaaaagcgaaattggaacaagtaaaagtcaaatcgattcagcaaatatttacggtacagcgcagttgcaggagcccctccgtcggagcgagtaggccagtggggaccgaagtgctgagagctggccgggtcgctgggaggggtccccgcccgggggtggaagggacgggagcctacagtgagtgatagaaacgtggagttcttgattattttacacgaaattttgaattattaaacttctttttcttaa

SEQ ID NO: 9705 - DNA, 351 bp, Homo sapiens
  misc_feature 270, 302, 312: n = A,T,C or G
attcttctcaaatgcacatggtctattctccaggatagaccatgtgttagcaagtaaaacaaacctaaataaattttaaaggattgaaatacataaagtatgttctctaactacagtaaaataaaattagaaaccaatagcagaaggaaatttgggaaattcacaaataagtgaaatttaacctaccttcccaaataaccaatggattaaagaaaaaaaaaagaaattagagagtaagtttttgttggattttgttttgttgtttttganacagggtctcactctgtccctcaaactggagngcaggggcanaatcatagttcactgcagccttgaacctcctgggctcag

SEQ ID NO: 9706 - DNA, 406 bp, Homo sapiens
  misc_feature 203: n = A,T,C or G
ctgcacgtgtggtgaggcctacagaagcggccttcagctggaccttggtctccccgccggacttcgagggtgtcatcgccgcccctgttgggggtgagcgccgcgcggctgcagcatgcctcacaggaagaaaaagccctttatagagaagaagaaagctgtgtcttttcacttggtccaccggagccaacgagatcctttancagcagatgagagtgcaccccagagggttctattgcccacacacaaaatagacaatgaagaaaggcgagcagaacagaggaagtatggagtgttctttgatgacgactatgactacctgcagcacctgaaggaaccatctgggccttcagagcttattccctcaagtaccttcagtgcacacaacaggagagaggagaaagat

SEQ ID NO: 9707 - DNA, 358 bp, Homo sapiens
ggcgcttgaggacaccctgcagctgtgccaggctgcactgggggccagtgaagcaggcgggctcttgcagttggacacggccttcgtgtgacgcagctgaaaagcaacaacaaaagggtttggttgcaacagccagtgtgggtacctctggggagagaggacctcctctgacaaactggtctggtacccaccatgtgccaggatccaccctggcctctttttacccactgactccccagaacaacccttccaggcttctcttgtcatctttctctgcctgaggggaaactgaagctctgaaatgcgatgtgatctgtaccaggtcacccagctatgctgcaaaagtgggttggccaag

SEQ ID NO: 9708 - DNA, 381 bp, Homo sapiens
  misc_feature 315: n = A,T,C or G
gccttaacctgggagtggcgagggagtgatgcatctgccaaaacgaggagggtcactacatctcatgtctcatctccttgctcagctcatcctagccatgctggcctcctggctgttcctcaaccagctagtcgtgctccccatctcagggcctttgcctggatgctctttcctggagatcttggctatcctgtcaaaacttgtgttccccaccccgcctttatacactccctattctatgtattccttaccattttcagacatactgtgcatcttattttgtttcttgacaggctagaaagcttcaagaggggnggggtgggctcttattcatttccatacatattactatgtactgacttctgcctgcctttttgccct

SEQ ID NO: 9709 - DNA, 348 bp, Homo sapiens
ctagactctatgattgacagggtgaccagctgtcccagtttgccctggggcacaggattattcgtgctgaaaatgagaaagtcctgggcaacctgggatgaattggccaccttcactattgatccaacttcccaaatgctttgtctacattgctggtatctggctcggaggaagccctgtgggaaaggctgtgagtgtgttgccccaggttccacaggacacttagagtttgggggacacctgccgtcaacgcactgcaacaatctttagggatgttaattgttcctcaggaggcatacgtaggaatcacatccaccttaaacatgcccacttatggcatttgggctc

SEQ ID NO: 9710 - DNA, 395 bp, Homo sapiens
  misc_feature 388: n = A,T,C or G
gtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaccatcttatgaatggccatgggncatttaa

SEQ ID NO: 9711 - DNA, 388 bp, Homo sapiens
ctttgcttctctctttctttccttgtgtctcttccttctcttttctttttttttttaacatatagggtatttttttcttttaacatatagggaattaaccttcattttgttaatttccatttgttcccttcttcattcatgtcatctctgctattccttctccctccaaaagggagggaaaccctatttttttttttccaaaaccatggtgggtctgcttccctcactcgggctccttgacagtcttctaaaaaagagaaggaggaaaaaaagcagttcctgatgttacaaatgaacaaggatctcccaggtaaccagctccccacacccatttctgttactaatttctcaaacagaaatttctggttccccttcttccttatcactg

SEQ ID NO: 9712 - DNA, 396 bp, Homo sapiens
  misc_feature 361: n = A,T,C or G
gcgaggaagaaatggaggatgagcaagaaagcgaggccgaagaagacaaccaagaagaaggggaatccgaggcggagggagaaactgaggcagaaagtgaatttgacccagaaatagaaatggaagcagagagagtggccaagaggaagtgtccggaccatgggcttgatttgagtacctattgccaggaagataggcagctcatctgtgtcctgtgtccagtcattggggctcaccagggccaccaactctccaccctagacgaagcctttgaagaattaagaagcaaagactcaggtggactgaaggccgctatgatcgaattggtggaaaggttgaagttcaagagctcagaccctanagtaactcgggaccaaatgaagatgtttatacagg

SEQ ID NO: 9713 - DNA, 347 bp, Homo sapiens
ggaactttgacagtgaaataaatatcagaaatgaaaactttaataaatgaaattaacagctgattagatgtgtagaagaaaaacagctgtataacatagaaatagaaaagacccaaactaaaacacaaggaggaaaaaagagcttcagtgacctgtggaacagtatcaggcagtgtgacataacctagaagtcccagaagaggaggagaagaaggtgtgaagaaaaaaaatatttgaagaaacaatggcaggcaatgccagaaaatacttcaaatgtggtaagagcaataaacccacaatttgaagatgcttaataaaactcaagaaagataaagaaaaccatattg

SEQ ID NO: 9714 - DNA, 350 bp, Homo sapiens
ggaactttgacagtgaaataaatatcagaaatgaaaactttaataaatgaaattaacagctgattatatgtgtagaagaaaaacagctgtataacatacaaatagaaaagacccaaactaaaacacatggaggaaaaaagagcttcagtgacctgtggaacagtatcaggcagtgtgacataacctagaagtcccagaagaggaggagaagaaggtgtgaagaaaaaaaatatttgaagaaacaatggcaggcaatgccagaaaatacttcaaatgtggtaagagcaataaacccacaatttgaagatgcttaataaaactcaagaaagataaagaaaaccatattgagg

SEQ ID NO: 9715 - DNA, 398 bp, Homo sapiens
  misc_feature 389: n = A,T,C or G
gaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagacgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcangccacagaa

SEQ ID NO: 9716 - DNA, 369 bp, Homo sapiens
gtttttatttgtgaactctgcgagttcaggagccatgtcagtcaccattgtacccctgtgcctggtggttaacaaatattgatcaacaaactggaggatataattatcattactccatttttcagatgaagaaacagaaactcagagcaactaaacatttgcccaaatgactccaactgtaggtgtcagacaaaagaaaagaaaaggacttttaggtactttgggggattttcaacaaggcatttttttttaaactatagccccaaagaagggaaacaaactggtaaattcggttctagttatgccccactttgaccgggggtggggtctggaagcaggcttttgtgccctggtgcaaagcacctaatg

SEQ ID NO: 9717 - DNA, 386 bp, Homo sapiens
gctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgc

SEQ ID NO: 9718 - DNA, 345 bp, Homo sapiens
ctttttaaaggatttagtagattatgtcatttctctattcctgttctccctatagtaggcttcctatgtgttacatttagaataattttcagtgtccttaccatggtctacaaagaaccttccaagtttctgcaactcactgtaggtgatacgtgtttgagactcaacacatgcacacacacatctgatgcaaaagtttcacaaaacagtactatccttattgtatgagatgtactctaatattcttctgtggtattttaatgaaataaaatagaaaatcctgttcttgatcttctaacttgattttgctaccaatgtggagacatagtttaaaagaacactgcc

SEQ ID NO: 9719 - DNA, 408 bp, Homo sapiens
gggagcggtctggggagagagagagaggcataggcaaaggccctgtggcatggtatgggcagaaccaagggagaagatcagtgtggctggagagcagagaacagagttgaaacaaggctggaaggtaggccagtctggaccaagcagccttctttcaactatgtttccagtgtgtttggtgaacaagggcctcagaccactcttaagtagtatgttacattactcctttagtaggacatggcgccttgtctctgacagggtctatgtacaccctacaggtcatctggaatctcatttcttcagaagaatctcctctttcattccagtccaatagtgacagcccaaaagtatgtttggaagtttattcaaaagtcacgtgttggccggacatggtggctcacacctata

SEQ ID NO: 9720 - DNA, 354 bp, Homo sapiens
  misc_feature 342: n = A,T,C or G
agttaagcagtctagttcttcggcctcatactgtcactgtgggtttgtatacgtagaactttgttgtacctttttaaaataaaacctgaagccttagatatgtaaattgattcatttaaacttactttctttttttttctggagacagagtcttactttgtcacccaaggctggagtgtgcagtggtgtgatcttagctcattgtggcctcaacctcctgggctcaagtgatcctctcaactcagcctcccggttagctgggaccataggtgtatgccaccacaccccgctaattttaaaattttttgtagaggcagggttttgccatatgcccaggctggnctcaaactcctg

SEQ ID NO: 9721 - DNA, 422 bp, Homo sapiens
acggaagttccgagcccggccccatacctttaccagctgcttggccttgcacttaaccagctctcaaccctcagttttctcatcagcaaattgggtataatatttatagccctgcttcaaagggttgttggttctctcaaataagatgatatatttaagtgacttacaagtcttattagccagtagcaacaaatcgcttacccaaagaagttttacaggttacatgtgtgagccagccccaggcatgtagtcacagtgtgtgtcagagggcacagttgcttcctctcagtcaccaacagaaatcatatggaaattttcagagacccatgaacagccaaagcattataaatgctttggtaacatggattttgcatataagcatttatgtatttttttcctgacattagatacttacttctaag

SEQ ID NO: 9722 - DNA, 373 bp, Homo sapiens
  misc_feature 192, 198, 205, 209, 247, 252, 265, 272, 275, 282, 283, 286,294, 335, 342, 344, 347, 356, 358, 359, 368, 369: n = A,T,C or G
gtttccaagaggagggaggcatgccacaccatgcaggccatgtggagaagcacaagggttggtcaggaggcagaagtagcaaggagaagcatgggtgagagcctttttatatagtggtgggatgttccctattggacagaaagtgaaataccgatgttggggtttgtagttggagggtttgtaatataattnccaagngcccacnccangacaggaatggtgaggatgtggacaactttggctgttnttttngtccatgatttcnagatgcnaanttttttnntanaatatcangaaggattattatatgcctgcatctgttttggctattatgnctcctangnganaaattgctntnntggaggaannatta

SEQ ID NO: 9723 - DNA, 387 bp, Homo sapiens
gaagaattcgcggccgcgaattcttcagtggattgccaccaagtccagttcccagtccaagacgattttcaagcaggagaagtcagagtccagtcaagtgcattagacccagtgttcttggtcctcttaaaagaaaaggtgaaatggagacagaaagtcagcccaagagactcttccaaggcactaccaatatgttatctccagatgccgcgcaactgtctgatctcagttcatgttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaacc

SEQ ID NO: 9724 - DNA, 396 bp, Homo sapiens
  misc_feature 68, 69, 70, 71, 75, 82, 89, 91, 92, 96, 101, 117, 130, 146,155, 160, 162, 165, 180, 185, 188, 194, 196, 200, 214, 215,224, 229, 233, 236, 238, 240, 245, 247, 249, 252, 257, 258,290, 299, 301, 303, 312, 316, 321, 322, 325, 330, 331: n = A,T,C or G
  misc_feature 333, 336, 350, 352, 359, 362, 365, 366, 367, 370, 381, 385,388, 390, 391: n = A,T,C or G
ggatacgcagacaattcctcaactgcagctccctatgggggagctctctaatcatctgatggtcatgnnnnttancgccttnacccttnanntgantcatnccttatgacatgactnctgccatttatcntgagatcttttatgtngcctttgcngaatncnttnttgctgaccctcctnattgnctntatgantngccntgtgggaacctatnntatgttatnaagtnactntgngnanagagncncngcnttatnnaagattgcctttgactcattgacccatttggnggaaaaagntnanctatttgcntggntaaannatnagctnntncgnatttttctgggccncnaacaacnaanaannnacngtcgtttttcnttgnccncnnggaaa

SEQ ID NO: 9725 - DNA, 397 bp, Homo sapiens
  misc_feature 319: n = A,T,C or G
ggctgaaagagttttgaggtgcatgctagaaaaagcctatggtgctttgaagggactcttcgcagaaatataaatgctaagggtgattctagtgaggtctcaggtggaagtgaaaaacatgttattagaagctgaaggaaagacattcttttcataaagtggcaaagaatttggatgaactatttgttttttattattttggagaagagagaacatgttttctagacgtgttgataatctggccttatttctctttagttcttagagtaaaatgcaaaaggagagagagaaactgaaaaatttcttggctgggtgtggnggctcactcttgtactctcaggactttgggaggccaaggcaagatcgcttgaactcgggagtttgagaccacctgggc

SEQ ID NO: 9726 - DNA, 404 bp, Homo sapiens
cttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggtgagccgcgccctcggccttcgctgggctaagccgaccccatgcagacgtcaaacccccctaggtcggcacagcctctctgcggggaggcttaatgg

SEQ ID NO: 9727 - DNA, 357 bp, Homo sapiens
  misc_feature 347: n = A,T,C or G
ggagccctgggtgggctcggagattaggggcacccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcacctaccagctgctgcatacaggagattgtggccactgtgactatnaccaacaagg

SEQ ID NO: 9728 - DNA, 392 bp, Homo sapiens
ggaactgagaagtgggtggttgggggagtggaagggagtttcccctgccctgtgcccacagtgcaatgggcaaactcctgcctctggcaccccccacctctcccacccaggcccctggtcagcaggctcacatgagtggcggtacagcttgacactgttggtatataggaactccagcactgccaggaaggcctcagttggcacagtgcttagcaccacaggactgggcaccccggggcctggctctgtgcccagaagtcgctggaagaagttgcatctacaggccaacaagcaccgatgggcaaatacctcctgccgttcttgaccaaccacgaagcaaacatcactgtgggagacaggcagagaggcagcggggaggaggccaacacccg

SEQ ID NO: 9729 - DNA, 409 bp, Homo sapiens
gccggcctggtgatgaacaccattcaacactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccaaaca

SEQ ID NO: 9730 - DNA, 334 bp, Homo sapiens
gtaccttcaaaaggacacaatgtaacagggttagggaaacagaagtccgcagggcctccctaatgtctttggagcttaaaccccttgtatatttgccccttttcaataaacgccccacgctgatagcacagaggagcccggcatgcactgtatgggaaagcagtccaccttgttacagttttaaatttcttgctatcttagcattcagataccaatggcttgctaaaagaaaaaaagaaatgtaatgtctttttattctcaggtcaatcgctcacactttgttttcagaatcattggtttatatattattgttttttcagtttttttttttttt

SEQ ID NO: 9731 - DNA, 467 bp, Homo sapiens
  misc_feature 18, 25, 27, 30, 48, 53, 57: n = A,T,C or G
tctagaatacaagtttcncgctctntnatncaggatcccatcgattcnaattncgcngctgacggtaccacacacttcttgaaccctgatactgtacttaatatatcactgtcttccataatactgccctaggtctttttagtttttaagagaccgggcctcgctatgcttcccatgctgaactcaaatgcctgggcttaagcaatcctcccacctcagcctctggagtagctgggactacaggggcatgcaccaccaggcctggcttcctaggagggtctttaaagagaaaacatttgttcaattgaaaacaggattcttgtcatctacaactccaacacagcctgaaaatatccacattataacctggaccttagacctactttctccactatcctgcaaagctacatctgtaactacctattggctatctatatgagtcctcaagcatctcagactttacatga

SEQ ID NO: 9732 - DNA, 407 bp, Homo sapiens
attccagataaagggagtagccagtgtaaaggtcttaagttaggaacaagcttggtatattaaagaataagcaaggaagccagtgtggttgaggagagagcaacagaagatgaggtcgagtaagtaatattggtgccttgtaggctctaattaggaattgggcggctggaagtggtggttcaggcctgtaatcccagcacttctgggaggccgaggtgggcggatcacgaggtcaagagttcgagaccagcctgaccaacatagtgaaacgccatctctactaaaaatacaaaaattaactgggcatagtggtgcgtgcctgtaatcccagctacttgggaggctggggcaggagaatcgcttgaacccaggaggcagatgctgcagtgagccgagaatacccactg

SEQ ID NO: 9733 - DNA, 467 bp, Homo sapiens
  misc_feature 7, 221, 231, 243, 247, 253, 257, 262, 275, 278, 286, 301,304, 318, 333, 339, 355, 362, 365, 368, 415, 419, 421, 449,463: n = A,T,C or G
actctanaatacaagctacttgttctttttgcaggatcccatcgattcgctttgtgatggagtttcgctcttgttgcctaggctggagtccaatggcatgatctcagatcacttgaacccaggaggtggaggttgtggtgagccgagatcgtgccattgcactccagcctgggcaacaacagtgaaactccgtctcaaaaaaagaaaaaaaaaaagaaaangaaaggaaangaaaaaaagatntggncctgtntganccagngaaatttttttgnggntaaaattnaaaattgcaagccancanatacatacccaganactgaacattttcancaccancgtaaagtcatgacanaaaaaancanaanttttccacaaactccctctgctgaggttcctggaactgctgttcccnaggngnggtgttcaaagctactggaatttatganaggctcagtttttntcca

SEQ ID NO: 9734 - DNA, 355 bp, Homo sapiens
ggctcattgaagactctgtgggttacccagaagcccaactttccagattcaatattttttctatttcttagctgtgttaccttgggcaagttaattaacctctctgtgcctgcatgttgcatctgtaaatgagactaatactagtacccaccttctaaagtgattatgagcattaaatgaattagtacgtttaaaggcttagaacagtgttttatgatatgataaacactcaataaaatgttagctattgatattggtgtgcccagaaggcttgttactactagttgatttatgtgcttgccaaaagttgttgtgttggtaattaagtacgacataaactaatgaaaattgagtt

SEQ ID NO: 9735 - DNA, 378 bp, Homo sapiens
  misc_feature 138, 148, 155, 160, 164, 171, 174, 196, 213, 229, 231, 236,260, 266, 285, 324, 345, 349, 355, 357, 368: n = A,T,C or G
gcccagcaggcccagcatgcaggtggtgggacactgggcagcaaggctgctgccggaatcacttctccaatcagtgtttggtgtattatcattttgtgaatttgggtaggggggaggtgtgggaggatttcaatccantctagagaanatataanaaaanctanccaggcncantggcttacacctgttatcccancgctttgggaggctaangcaggcagatcacttnanaccancttgggcaacatggcaaagccccntctctncaaaaaacacaaaaattanctggcattgtggcgcacacctgtattcccatctactcangaagctgatatggaagaattntttnaccccnanttcaaggctgnattgattttt

SEQ ID NO: 9736 - DNA, 386 bp, Homo sapiens
ctttctcaagcaggagctggtattgtagggagtggccgggtattctgggctgggctcttctggagtagggggtcaagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggcaaaaagcatatgcatccttatccgtcaactcatcagctcttcctcaaggcaacctgaggccagacaccaagaaaccaagcg

SEQ ID NO: 9737 - DNA, 390 bp, Homo sapiens
gagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccgtgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagcccagacca

SEQ ID NO: 9738 - DNA, 407 bp, Homo sapiens
ggccagggccacaggggcacgtggcgccgggaggagagagaatgtcttttcgaggcggaggtcgtggaggctttaatcgaagtggtggaggtggcggcttcaaccgaagcggcagcatcaaccacttccgatgtggaggcggcggtggaggcggcggcaatttcacaggcggcggcaagggaggatttggacgaaggggtggccgcggaggctttaacaaaggccaagaccaaggacctccagaacgtgtagtcttattaggagagttcctgcatccctgtgaagatgacatagtttgtaaatgtacccatatgaaaataaggtgccttatttcaatgctcctgtttacttagaaaacaaagaacaaattggaaaagtggatgaaatatttggacaactcagagatt

SEQ ID NO: 9739 - DNA, 344 bp, Homo sapiens
  misc_feature 338: n = A,T,C or G
tggggcttcaccatcttgaccaggctgggctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatntttccg

SEQ ID NO: 9740 - DNA, 395 bp, Homo sapiens
gtgatacaatattatattggtaatggaaatggaagtatattgttgtagtgtactacttatggtgttcatgaagtggtataatattacttgaaggtagattgtgtgttcaaaatgtatataatgaaccataaagcaaccattaagaagaaagcaggagggaatgaattgttaatatgccaaccaaggggataaaatggaatcagttaatacaaaacaaggcataaaatgagtaaaaacaaagaacagatgggataagtaggaaacaaagaataatatggtcaatttcaattcaaacacatctatatttacattatcagcagtcacattaatgtaaaaggagtaaatgtttcagttaaaagacagattatcagatttaaaaaaagaggtaactgctg

SEQ ID NO: 9741 - DNA, 217 bp, Homo sapiens
gaatacaagctcttgttctttttgcaggatcccatcgattcgaattccgttgtttgacggcaacggactctgcagagcttcataactgggaatttgatttgaagaagtccatgtcatatgtgtaactagtactaattataaatataaaatacacaatataaaatatgaaactcaataataaacagtgccacctgtacatgggcaaaaaaaaaaaaaa

SEQ ID NO: 9742 - DNA, 395 bp, Homo sapiens
  misc_feature 215, 220, 227, 229, 233, 235, 242, 251, 254, 262, 283, 307,310, 320, 324, 328, 338, 348, 351, 359, 388: n = A,T,C or G
gagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaaaaagggaantaaantaaaaantngccntntgcaaangaaaaagcnttnagccgacnccaaactgccagggcctttgnttttggactttcagcccccaaatntgngaaaaattantttntgtngtttaaaacncctaccctgnggnttttgttntcgcaatccaactgctgaacaggccgtanggaaaaa

SEQ ID NO: 9743 - DNA, 414 bp, Homo sapiens
  misc_feature 409: n = A,T,C or G
cacaagggtttgtctacgaatggtttagcgccaggttccccacgaacgtgcgctctcttcagcagaacaagagattgtgtttgtgtggtggtgagggatggaatagagagctgaagatgagcaaaaggagggaggagtcaggaaaaggcagctcctatatgttgaatttatttttcattagtactgagtatttaaagaagagggcacccaggctggagccctgggaagtcccatatgtggtggtctggtggagtgggttgaggaggtaatagaaggtcagaaagtaaagatagtaaatatagaccattctttcaagaagtttggctgtggggctggcatggtggccatgccttaattccagtactttgcgaggcctaagtgggaggattgcttgacctaagaatttganacaac

SEQ ID NO: 9744 - DNA, 403 bp, Homo sapiens
ggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtcggcaagtgat

SEQ ID NO: 9745 - DNA, 416 bp, Homo sapiens
aacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggccta

SEQ ID NO: 9746 - DNA, 413 bp, Homo sapiens
ggcctggtccgcagcgccctgcgcccacccgccccggacgtggggcccaagcccccgtgaagatggtgtcctggatgatctccagagccgtggtgctggtgtttggaatgctttatcctgcatattattcatacaaagctgtgaaaacaaaaaacgtgaaggaatatgttcgatggatgatgtactggattgtttttgctctctatactgtgattgaaacagtagccgatcaaacagttgcttggtttcccctgtactatgagctgaagattgcttttgtcatatggctgctttctccctataccaaaggagcaagtttaatatatagaaaattccttcatccacttctttcttcaaaggaaagggagattgatgattatattgtacaagcaaaggaacgaggctatgaaacc

SEQ ID NO: 9747 - DNA, 400 bp, Homo sapiens
accacttaaaaggattcttacaacaaattaaaatgaggagggagaacttatttctcctatagtaactgtgcattaaaattttatctcgtttttatttattttttaaagatagggtctcactctctcacacagggtagagggcagtggatgatcatagctcactgtaacctcaaactcctgtgctcaagtgatcctcccacctcagccacccgagtggctgggactatgcacataggctaccacatccattattataattgaaaaaatttttctggccgggcccagtggcgcatgcctgtaatcccagcactttgggaggccgaggcaggcagatcacctaaggtcaggagttcgagactagcctggccaacatggcaaaaccccatctctgctgaaaatc

SEQ ID NO: 9748 - DNA, 496 bp, Homo sapiens
  misc_feature 414, 469, 472, 492: n = A,T,C or G
gactatagaaacaagctacttgttctttttgcaggatcccatcgattcgaattccgttgttgacttaggctggctctgggagcttctggaagctcccaagctttgtagctcatgccaacagagcccagggacagaggcagagccccagaggggtgacaccccctctgagtcccattcgctttgctgcccaggtgatagttggcatctattttggccttgtggcactgattagcctttcttccatggtcaacttctatattgtggccctcccactggcagttggcttaggggtcttgctggtggctgctgttggcaaccagacctcagactttaagaacactctggggtcagcatttctcacttcacctatcttctatggccgcccatagccatactgcccattagcgtggcccncattacagctcagagcatcgccgctacaaagctttggtggcatcagagccgtcantgngcggtctatcgctggcttgnttac

SEQ ID NO: 9749 - DNA, 388 bp, Homo sapiens
ggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgcctgcacctgaagaaaccaagtgcatcttcaagactcctgctttcgggcaact

SEQ ID NO: 9750 - DNA, 387 bp, Homo sapiens
ggggagaggtggtgaaggttttgcccactgcaggggtcaacatgtgcttccctccaggagtctgccgtgcacccgagggagattttcaagcagaaggagagggccatgtccaccacctccatctccagtcctcagcctggtgagctctccctttgggcctggccatgaggcagcagcaggctgagggggagcctggggtcctatgtgggctcccccaaggctagtgacagatatatcggtgacgggtgagtgagtgaggagaagggacacctggggccattgacctcatcagtgaccacactggtcaccagtttggcctccaaaagatattgggctgcgctgtctaccacgtcaccacatagcacatggccctggggcctctgttcc

SEQ ID NO: 9751 - DNA, 368 bp, Homo sapiens
atttggagaaagttttagagagtggggctcaggctcaagaatacaatgaagtaataaagttgttaacctcatgtataaaatcctccatccagatgttgcttagtgatgcagctagtgcttctggaggaaaagaagcaagaaccaaataatgaagactacatcaatgggaacaagtgatacttttaggtgttttgttctcagaatattttaaaagaaaggaaattaacaacagaagaaaaatatttccctatatgaattaatggtttttataagaaaaatatctttctggagatactaagattgacctagaaattgatccaaggaccagatgcttaaagttcacttcaattggtcactagaaagatcca

SEQ ID NO: 9752 - DNA, 385 bp, Homo sapiens
gaataactagacagaatatttgtaaggaaatagagggcttgaacaacataataaattaactcgatctgtcagacatatacagaacactctacccaacaacagcagatgatacattcttctcttctcaagtgtacatggaacatcctccagataaactacgtgtttggccacaaaacaagtcttaataaattttcaaagattgacatcattacaaaatttctgatcacaatgaagtgaaacctcaaaccaaggaaggataactataaaatccacaaatatgtgaaaatttaaaaactcactctacagcaaccattgggtcaaagaagaaatcccaaggaaaattggcaaataccttgaaacaaaaaaatacatcataccaaaattt

SEQ ID NO: 9753 - DNA, 485 bp, Homo sapiens
  misc_feature 7, 10, 23: n = A,T,C or G
tttgaantcnataatacaagttncttgtcctttttgcaggatcccatcgattcgaattcggcacgaggctggaggcattcgaaagggactcccgatgtggtgggcggggctgaaccctgtggcttctgaggtccctgccagccagagacttgtgtgagtctttgaatggcttcacatgaacaaaagagcatttctgtcacctttcctctagttttttccaccacacccaccagggagctgaggcaaggttgtttctgttgctgtttccttaggtcagctgaggctgtccattgatgcccaggaccgggttctgctgcttcacagtgagtacggctttgtgcaggctcaccaaggaaggggcgggccactcagcagagcagggccacagaagagttttcctatcttccctcccttctttattccatcctttcttcttttctctatttttctcactcattcatttattcattggttgacaggcagca

SEQ ID NO: 9754 - DNA, 405 bp, Homo sapiens
aaaaaattcatactggagagaaaccctatgagaaccctaaccctaacgcttcagttgtcccagttctttcatgagcatgaaaggagtcacatagagaaaccccatgaaagtaagaaatttgggaaagccttcagtcctttctgtttctttcaactacgtgaaaggattcacagtggagaaagaccctgtaagataattggctttaaattacgagagacttgtgataggacagtaaaacctagagttggagttggatctctggattgtgttatgtcagtgttggtaggttaggaactagatttcccagaatccattccatttgtgattccatgatacaattcaccagtaacctatcttacatgagattcggaagtaagttaaagaaggcattagtcatgggttgga

SEQ ID NO: 9755 - DNA, 466 bp, Homo sapiens
  misc_feature 5, 6, 7: n = A,T,C or G
tttgnnnccctttaatacaagctacttgttctttttgcaggatcccatcgattcgaattcggcacgagatatagtccagatgaggaaaataaggctgaaggcaagctaaacttgcctgaagccacattgctaggaagtgacagaaccttgtaaacaagatttaagatttgatatactttcttattttctaaaaatttcaatgtgcatgtagttctcagatgctttcctcgaagaaaagggagtgtcatctatttatctgaccttgcaattatgacatttcttagaagtttttttttttaactgaccgtatcttatgaaatggtcttgcgatggtgttgttgaaatgacttttttgctgcagtgtgccttgccctgataattccttcttcctactatgcttcagggtaattatttctcttactcccactgatactgggggaaggagaggaaactccctgatgtgcct

SEQ ID NO: 9756 - DNA, 418 bp, Homo sapiens
  misc_feature 347, 362, 374: n = A,T,C or G
cccatctgcttgtcgttttaaacctagaaaatagtggctattggctgggcatgatagctcacgcctgtaatcccagcacttcggggggctgaggcaggtctgtacaaaaaattcaaaaaaattagctcagtgtggtggcacacacctgtagtcccagatactcgggaggctgaagtgggacaatcacctgagcctggcagtcaaggctacagtgaggcaggattgaacctctgctctccagcttgggtgacagagtaagactctgtctcagaaaaaaaaaaacaaaaaacaggggctattaatcttcccctcagttcctcccatcctcctcccctccccggggctanaaagccgaagctganattcaatcccanaggccagctggatttgggagacctcaaatgccaggtcaggcata

SEQ ID NO: 9757 - DNA, 390 bp, Homo sapiens
  misc_feature 188, 194, 207, 213, 215, 229, 241, 257, 278, 287, 288, 296,314, 328, 329, 337, 339, 341, 345, 346, 356, 358, 359, 362,363, 365, 367, 370, 373, 375, 377, 379, 380, 385, 386: n = A,T,C or G
gcagggactactgggacaaaaatcagatgagcagcaagcagcccacaagccaaaccctgcacacctgggcagagttctcaccgcaacataaagcagagtccgaggagccgggcacctggtttcagtgagtgagctctgtttcggttgacccaggtcatggaatggaaacggtgaggcccatttgcgtnatttcncaaaacgacatanactggnanatgcccatttgcantcattccatagngaaatgtgtgacaaanatgctctggaggaagattcanaaagcgttnntgaaatangaagtgatgaggaatctnaaaatgaaattacnngtgttggnanancttnngtgatgactntnnaanngnanatnatnanangnngatannataa

SEQ ID NO: 9758 - DNA, 395 bp, Homo sapiens
  misc_feature 379: n = A,T,C or G
gatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcataaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcancagcagaaaggaagca

SEQ ID NO: 9759 - DNA, 389 bp, Homo sapiens
  misc_feature 224: n = A,T,C or G
gcaagacccaccaggtgccagctgcccctgccccttgcccatgccctgtgtgtgggcggcccctggccaaccagggctccctgcggaaccatatgaggctccatacaggagaaaagcctttcctgtgcccgcactgtggccgggcgtttcgtcagcggggcaacctgcgtgggcatttgcggctccacaccggggagcgtccttaccgctgcccacactgtgcngatgccttcccccagctgcctgaactgcggcgccatctcatctcacacaccggggaggcccacttgtgcccgtgtgtggcaaggccctccgagacccacacacgctccgagctcacgagcgcctgcactccggaaagaggccctttcctgtccccaatgtggccg

SEQ ID NO: 9760 - DNA, 411 bp, Homo sapiens
aggaattatttacacagccctgttgcagagttaaggagcaaacaagatggcaaggcatccaattctagaaatgataagacagaaccatccctagggatgatgagacaaggagcaggagtttccttaagagcccagtgtaagcagaggcacaggagggcaggatggagggacgtacagcctgaaaggacactgccatggtccaggcaaagggtcaaagcaggaacagatgaagatgtatctcctttaaaaacaaacaaacaaaaaaagacagtttccctctgtcacccaagctggagtgcaatggtacaatcttggctcactgcaacctccacctcccaagttcaagcgattctcctgcctcaacctcctgaatagctaggattacaggcgtgcccagctaatttttctatt

SEQ ID NO: 9761 - DNA, 396 bp, Homo sapiens
ggcttggtggctcatgcctgtaatctcaacactttgggaggccaaggtgagaagaacacttgaggcctggagttaccagcctgggcaacatagcaagaccccatctctatgaaaaaaaaataaataaatagaaaagaaagaaatgcagaatcccagtccccaccccagacctcctgagtcagtctgcattagaataagctcctcaggcaattctcacatgtgttgcagtttgagaatcctggaagcccaccatgcctcgtgcctaattagcagtcagtgtttgcatcatgaacggacggcctttctctctatttccattttgtgttacaggcctggtgggtaggagatgaagtttttgcagatgtctggagaatatgtaccaacaacacgaattgc

SEQ ID NO: 9762 - DNA, 414 bp, Homo sapiens
  misc_feature 408: n = A,T,C or G
gtttttgaacattttcttgaaaatctggataaatcccgaaaaggagaacttcttaagaagagtggtaagacgctatgcctttcccttctatctagttagatcttattattagtagaaatgagcaatttttgagttctagtctttctttgccctcctcccaaaatttacagatttatcttactatccttaatgttttggaaattgaggttccttaattcaatttaacacatagttattaaacacattctaagtatcaggtctataagggagacaaagatgaattaacatcatgcctccttgcccttaagaagtactaacttggccaggcacggtggctcacgcctgtaatcccagcactttgggagaccaaggcagttggatcacttgaggtcaggagttcgagaccanctggcc

SEQ ID NO: 9763 - DNA, 398 bp, Homo sapiens
  misc_feature 391: n = A,T,C or G
cctgtatggtcccattgtgaaacatatttcattttttgatttcttcaagcataagtatcaaataaatatcgatggcactgtagcagcttatcgcctgccatatttgctagttggtgacagtgttgtgctgaagcaggattccatctactatgaacatttttacaatgagctgcagccctggaaacactacattccagttaagagcaacctgagcgatctgctagaaaaacttaaatgggcgaaagatcacgatgaagaggccaaaaagatagcaaaagcaggacaagaatttgcaagaaataatctcatgggcgatgacatattctgttattatttcaaacttttccaggaatatgccaatttacaagtgagtgagcccccaatccgaganggcatga

SEQ ID NO: 9764 - DNA, 389 bp, Homo sapiens
gcaggctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaactaccctttaaaaggctcggcatccagtgtggaagaccagcactcacacatccggagaccttacccggagccaggctgcccctgatcatctctgataactttaaaaggaaggcctcagaagcagccccagaagcaaaagtttctctctgaccttctcctgcctcttgtctctggcttttcattctcccccaaggctacccatagaaactagaatccctc

SEQ ID NO: 9765 - DNA, 409 bp, Homo sapiens
gcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatcactaccgcttccatgggaaatcccctctgggcaactta

SEQ ID NO: 9766 - DNA, 381 bp, Homo sapiens
  misc_feature 326, 351, 375: n = A,T,C or G
cttgacagctcatgttggtgtagtcttgtttagattgaatcttttgaccttctggtacctgaagatttatgtttttcatcagatttgcaaagttttatgctattatctctttaaataatctttctatccctttgtctttctcttctcctctatgaatttctgcaactcaaacatttgctcttttcacagtctcataaatcctgtaagtgttccttattacttttcattcttttttctttttccttctctagctgtattttcagacaacctgtctgagttcaaattctttcctctacatgattaattctgatattgatgctctttgntgcattttttcattttattcattgnatttttcagctccagaatttctgnttcttt

SEQ ID NO: 9767 - DNA, 167 bp, Homo sapiens
gaagaattcgcggccgcctaccgtacaaccctaacataaccattcttaatttaactatttatattatcctaactactaccgcattcctccccacactcatcgcccttaccacgctactcctacctatctccccttttatactaataatcttataaaaaaaaaaaaaa

SEQ ID NO: 9768 - DNA, 381 bp, Homo sapiens
  misc_feature 369: n = A,T,C or G
ggagaacaggagggcatgtccctttgggagcccgccttgtggatccaccacaccccaccgagcactagaagctgcataagctacacaggatgtgcttctgcagcctacagatgcagaaccagaatgagggggacaattccacccactcgagggctgccccctcttccttagcagacgaaccagtaatgggggcaaggctggggcatcccagcccacacaccctggatgcccagcaaggccacagaaagagcctgatgtccatgatccaggtggctctgagaagcttggcctggacacctgagcctgcggccggtactcctgcttctccccatctatccccaaggcctctgctctcacctcttccatggncgggttaagctg

SEQ ID NO: 9769 - DNA, 419 bp, Homo sapiens
  misc_feature 411: n = A,T,C or G
gcgcgagaatctgcaaagtcaagccacttggggcacccagtggggcacagtgtggtggctcctgggcaaggcgggaaggtggtcagtgagcagtatggaaacagaggaaggtcccaagtgataggacggcctgacttggcacttgagtcagatttgtctgtgttccaatcagcattgccacttcctgggttttacaccttgaaacatttttttcacttaattcaaccttagttttttattaactgtcaattgcattttaacagtagagtttcaaaggtaagaaaatgtttaagaggtggatttcagaaaagacattacatatatagtcaaatattcacttgttaaaaattctgatttacctttttcttcactagagtatagtaagtttgcagcctgttcctttttaagggngattttaa

SEQ ID NO: 9770 - DNA, 410 bp, Homo sapiens
gttctttaaagaaagagggggaagaaaaaaagcccaagtgaataaaacattgaaactattccccttcgaaaataaattctaaaatcgacagcaacggaattccgttgctgtcggggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaat

SEQ ID NO: 9771 - DNA, 489 bp, Homo sapiens
  misc_feature 6, 12, 13, 14, 15, 16: n = A,T,C or G
ttgaancccttnnnnntttgaaaccctttaatacaagctacttgttctttttgcaggatcccatcgattcgaattcggcacgaggaactatctagtagctggttccctccgaagtttccctcaggatagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaa

SEQ ID NO: 9772 - DNA, 416 bp, Homo sapiens
  misc_feature 411: n = A,T,C or G
tgctattttaggtatatcaagcacaagaacccattatagagagtgggttttttcattgtatttctgagactcctctcttagaatcatctctacccgcatatcgtgttttcttttcttcctacaattttagtacagaggaaaatcccaagagagaagattattttggaatcacaaatcttgttgaacatccagcccagctcaatcctccaggtaatgtatagattcctgaatcaagtctctagagcagcattacccattggaaatttatacagtgaggaacatgttctgtatctatgctgttcaatacaatagccactacccatgtgtaattcttttttttaattcagtttttttcctgacaatagtttgttgtttgaccagtgaacatacattttaagtgcatattcctgngctta

SEQ ID NO: 9773 - DNA, 354 bp, Homo sapiens
ctgaggatggaccaggagtcaggcgccaggaagaacaaaaacacgatgactatgtgtatgacatttactacttggagacggccactccaggctggattgagaacatcctctccgtgcagccctacagccaagaatgggagctggtgaatgatgatcaagaaccagaggacatttacgacgatgaagatgacgagaacagtgagaataactggcgcaatgagtacccagaggaggagagcagtgatggagatgaggattccagaggctctgctgactacaacagcctgagtgaggaggaaagaggcagcagcagacagcggatgtggagcaagtccctctggatgtgcagaagga

SEQ ID NO: 9774 - DNA, 347 bp, Homo sapiens
ctaccccagtgccggggagggttctgctgcttcgaaagctgctctacccttctccaaaagaagagccaagagaaggtccttttctacaaatatcagagccatggctcaggagtcagtgatgttcagtgatgtgtccgtagacttctctcaggaggagtgggaatgcctgaatgatgatcagagagatttatacagagatgtgatgttggagaattacagcaacctggtttcaatgggtaaggacatctgtccatagtaatttagattctgcccttggaaggcctacttcctccaatgtgaaatgctcacctggctttcaaaaaccagtcgaattttgatatcctgtt

SEQ ID NO: 9775 - DNA, 402 bp, Homo sapiens
gttaaaggaaagtttccttgttggttcctaccatatgaaagatgctatattctattttagcagtgccaatatatggaaaatatctaaattaaatgttattacaaaaatgaagcagtaatgagattctggctaaagagggcactaaatgagaataatatatatttaaaagggttgctgccgccccatctgctattgcccggcgaggtcgccgctgcctcagctgccatcgccgctacaggcaccagtgccgctgcgcgggagctagggctgtcgaggccaacccttccgcgcccgtgacgcggggcctgagagacggagtgtagggaggggccgagcaggaggaggaggaagccggagctgcatgaaggagggtctgggggcgagcaaacaggcggcgcttaa

SEQ ID NO: 9776 - DNA, 411 bp, Homo sapiens
  misc_feature 407: n = A,T,C or G
gcagagaagaaatacaagccactcaacacaacacctaatgccaccaaagagatcaaagtgaagatcatcccgccacagcctatggagggggatgggtttaaggttgtacttgtcagaaaccaccactgtgctgggggagtggcatatcctggagcagctacgttgctctgacgtttgagggggatgggtttaaggttgtacttgtcagaaaccaccactgtgctggcattcttcttcacaggcaccaaggatggtgtctccagctctagtccagtggaacggaacttggcatgactgggtgctgtggtgcgaagagacttgggcttctccctcttcttctctggggcctcctcagcccgggtctcagccttcacctctgtcaaaggtcgctcaagaagggtagttcnactt

SEQ ID NO: 9777 - DNA, 398 bp, Homo sapiens
acctgcttctgggtcggggtttcgtacgtagcagagcagctccctcgctgcgatctattgaaagtcagccctcgacacaagggtttgtccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgcccgaatcattgaagccaagtacttggat

SEQ ID NO: 9778 - DNA, 375 bp, Homo sapiens
acctgcttctgggtcggggtttcgtacgtagcagagcagctccctcgctgcgatctattgaaagtcagccctcgacacaagggtttgtccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccga

SEQ ID NO: 9779 - DNA, 363 bp, Homo sapiens
ggcccctgcagcagcagcagcggcgtggtcagagcgagcttcggagaagcagtggtgggttccatgtgatggtggagtaggaggcaggtctccgcggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttccttatccctgcagctgtgtttgaacaggaaagaaaaaagaagaaaaaaaacctccatacgagagtgg

SEQ ID NO: 9780 - DNA, 379 bp, Homo sapiens
cccgagtcaaggccggctttgagtccaggcactgcacagggtgaggaggagacgattctctatgacttgttggccaacaccgagtggccaccggagactgaagtacagcctagaggcaaccaaaaacatggtgcatcctttatcatcacgaaagcaattcgagatcgttcattatttttacgccaatacatctggtacagcccggcaccttttttgctccctgatggactggttcgcttggttaataaacagataaactggcatttggtacttgcaagcaatggaaagcttttggctgctgtcaagatcagtgtgtggaaatcaagtctgcaaaagatgattttacatccattattgggaaatgtcaaagttccaaaga

SEQ ID NO: 9781 - DNA, 361 bp, Homo sapiens
gcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatgggttgagcctcggtgcctgggtagcaag

SEQ ID NO: 9782 - DNA, 375 bp, Homo sapiens
gccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactgg

SEQ ID NO: 9783 - DNA, 345 bp, Homo sapiens
tagggccggaccctgcctgccccttggcttctcagggctttgctctgacaccatgacagctgcccggggctgagggcagctggctccactcaaatgaggaagaagggatcactcccattagggcctgctttgcttatgcatgtgtgtgcacatgcatgtaaaccagggaccttcagctcacggcctccaggcctgggccagttcttgctgctcctgccgtctcccccgactggctgtgtcctgagtaactggaacatgagactgtatctgcaggactggccccatggtggccgagtcagaagtctgtttcctgtgagtcgccaccgttcactcagtcttgcctcc

SEQ ID NO: 9784 - DNA, 383 bp, Homo sapiens
gatgttgtaaagtgcatcctggtggccagcccaggatttgtgagggagcagttctgcgactacatgtttcaacaagcagtgaagaccgacaacaaactgctcctggaaaaccggtccaaatttcttcaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcaacgatgagctcttcaggcatcaggatgtagccacacggag

SEQ ID NO: 9785 - DNA, 424 bp, Homo sapiens
agctaatgaccggtattgtgtactgagatcagacttcagggatgaagcagctgtatgttctcatgtcctggacactaccacgttgatggctttctaaatccagggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttccgggagcaaggccacgcccctgggggcacttt

SEQ ID NO: 9786 - DNA, 336 bp, Homo sapiens
gaaagactcttttccagaggctaaaaggacaagaaaatctgatttgcttgcttctaactttgcgttttaaagggggaaggaggaaaggaaagagggggaggtgtcggagttttctcctggttgctgaggagaccccaggctcccggccagcctgtgacacagggcgacagcgattgagcagaaagctgctgtggaaaccgagtggggactttactgatagtgacagtgatgacttcggagaggctgacggccggtacttcaggctcagccagcagtcacactgcccagatttctttcttttcctctgccgcctgctcagcccgctgctcaaggcct

SEQ ID NO: 9787 - DNA, 388 bp, Homo sapiens
ccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatcca

SEQ ID NO: 9788 - DNA, 380 bp, Homo sapiens
  misc_feature 357, 364: n = A,T,C or G
attattttaaatggaattgttcccttaattttcttttcatattgtttattgctagtatatagaagtagaacttttatttctgatcttgtaacctgcaattttgttgaatttgtctattacctctaatatattcttttgtagctcctttagggttttctatgataggatcatgtcacctgcaaatagagatagttttacttcttcttttccaatttatatgccttttatttatcattcttgcctaattactcagactagagcttccagtaaagtgttgaatagcagtggtagaagtgggcaccttgtctgttcctggcatagggggaagcttttagctttcaccgctgaatataatgntagctgngggattttcattaatg

SEQ ID NO: 9789 - DNA, 386 bp, Homo sapiens
  misc_feature 233, 235, 242, 243, 244, 245, 308, 329, 335, 349: n = A,T,C or G
atcggctcccgcagccccgcgtgggctcgtgcgagtcggcctctgtgtctgcgagattaatctctcatggccgctgcacaagaacctggcttttagctgaactaaggagaaagtcctacaacagtttggcgtgcaacatggggcttgagaaagggtgagtgagatgcaaaccaagaaatttttttcctctctttctaagcctatttatcttcggacttctgagggggaggggngnggaagcnnnnacccccacccccttggtctccatggccttttccttacttctggacggatgggcgaacggcggntctctgtcgcccaggctggantgcagnggcgccatctcggntcactggaagctccacctcccgggtcacaccattctc

SEQ ID NO: 9790 - DNA, 405 bp, Homo sapiens
attgctcctagtggaaatacagggttaggtcctatgagcctttggtcataacattttcatcaatggatcaatacataaccttattttatgtgtgtttctgtttaaagatacattatttaatatatattgttgattcattaacactgaactcacagtttgtaagtcatacctgaatgttgtttatcttacacatattttctccgtaaggcacatcacagccttcctgtgcttaggaatgctagatcacccttcagtctggttcagtgttagctgggaacatatgtgagaggagaggttcaaatttttggctggtctgcacatgtctgcaaatgacctcaaaagtgctgtattaacttagaggttacaaatcaattttgagtagataaattctcaaatatgaaatcc

SEQ ID NO: 9791 - DNA, 381 bp, Homo sapiens
ctccctatgcagtctggtttctagcgtgacacgcccttgacttgaggaccatgaaccgcagccgccaggtgacgtgcgtggcctgggtccgctgcggcgtggccaaagagacaccagacaaggtgaggcctggtcgctgggagacaaggggagcagcgtctttacggcactgggggtccgcccagctgggggaacgtggacccggaactcggggcgttggctggtgcgactggctggggtgagggcggctttgcccggattgtcgcgactagagctgcagttcagaaggtctggttcgcctgagcctggagagtcaagggccgcgccttctcactgttcccaccctcaagcccaaccccactcccaaattcgcacgcacat

SEQ ID NO: 9792 - DNA, 346 bp, Homo sapiens
gccctttaggaggatttccttttcctcactaaaagccccctgaaagatgcctcagggtatgcctctgtgccctactgcccactgctgctttcctgtttcctaggaatcccctttatgaagtacccatcctccagaaagatttcttacctaccttgaaaggatcttggcttctccacaagggtactccatcctctgagcaggtatttccgattctacttttgaatggtttcttttcaaatcttcctcagtgctttctctttctggctacccctccagcccactaccagcctttggtgcttctttaaattgctgcttctttgaacacacatatccatctcttcttgtc

SEQ ID NO: 9793 - DNA, 400 bp, Homo sapiens
  misc_feature 327: n = A,T,C or G
cttgactttgggcaaataagagagcttcaaagaacagcttcatccttttctttgggagaggtggagggttgagaagcaggagcagggagatcagaaagaccatgaggttgcttctttagcacatcaaagtgccacattttgggatattcgtttctgagctcagactttcctggacatttcacatgttaacagatgagctagtgactgtggagaggaaaatagagttagtagctgaatggtaaaagatcccattaaaccagtctctcattcctgagaataggccaacccaactaaacagtagtttctcattttaagagatggtattgnagatgggctctcaaaattagacctctatccatgacacaggcaaacagatctttaataagagatatttttatgg

SEQ ID NO: 9794 - DNA, 380 bp, Homo sapiens
tgacacttaagtcagagcattctgtagctgtattttacagaactgtaattgcacagattgttcctcttacaagagaaatatccagagctctaagaaaacaactgatgaaaacgacatgcgtgacatttggtgctgaagacccaggtcagagagactcctttgggggaccagtccgctgtccttgccctcactctgtgaggagacccacctacgacctcgggtcctcagaccaaccagctcaaggaacatctcaccaatttcaaatcgggaccccactggaaaatggactgtccaactcacccggcagccactcccagagcccctggaactctggcccaaggctctctgactgactcctttccagatcttctcgggtcaag

SEQ ID NO: 9795 - DNA, 396 bp, Homo sapiens
gtccgcgcgccgcgacgccaagaagctggtgcgctccccgagcggcctgcgcatggtgcccgaacaccgcgccttcggaagcccgttcggcctggaggagccgcagtgggtcccggacaaggagtgtcggagatgtatgcagtgtgacgccaagtttgactttctcaccagaaagcaccactgtcgccgctgcgggaagtgcttctgcgacaggtgctgcagccagaaggtgccgctgcggcgcatgtgctttgtggaccccgtgcggcagtgcgcggagtgcgccctggtgtccctcaaggaggcggagttctacgacaagcagctcaaagtgctcctgagcggagccaccttcctcgtcacgtttggaaactcagagaaacctgaaactatgat

SEQ ID NO: 9796 - DNA, 363 bp, Homo sapiens
caccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtctgggaggcttttcacagggcggg

SEQ ID NO: 9797 - DNA, 357 bp, Homo sapiens
  misc_feature 345: n = A,T,C or G
tggtcagtttgtttattaaaataagatgtctaatcctctgttataatttaagctataactgttgattgttatgttattaataattggttttcaattgctaaaatataagaatatttgaagatgagaggagaggttaacatttttttttacagagtctcactctgtagcccaggctggagtgtagtggtgtgatctcggctcactgcaagctccgcctcctgggttcacgccattctcctacctcagcctcccaagtagctgggactacaggcacctgccatcacgcctggctaattttttgtatttttagtagagatggggtttcaccatgttagccaggatggnctcaatctcctg

SEQ ID NO: 9798 - DNA, 364 bp, Homo sapiens
gcaggccccaacctatccatggtttggggctgctatctgcctcataaagcaaagtggagggtttgtcttttggaaaaacaaagtcgttttctcctctgaaaaagcctcctacatagttggctttgccatttgccaagaataagagggcacagattgaggcctcttgagtatgggttttcagttgaggttgaagagagaagacagggattgtaaccagaaaattcagaatggaatgcagttccctccagaactcctgagcttcatgacagtcatagaagtggattccttttagtttcccctcaccccgcaaacgtaccgtaataatgcaggatacaggtattaagttcctactcaagctataatc

SEQ ID NO: 9799 - DNA, 355 bp, Homo sapiens
  misc_feature 349: n = A,T,C or G
gcggccggcggggtgctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaaaccagaactgatcatctgtctggaggcaanggaaga

SEQ ID NO: 9800 - DNA, 405 bp, Homo sapiens
gttaaagttagaatagtaatgttgggaggctaaattgggaggatcacctgagaccaagagttagagcccagcctgagcaacatagtgagaccccatctctacaggaaaatttaaaaaaattagctgtgcgtggtggtgcacacctttagtcctagctactcggaaggctgaggtaggaggatcacttgagcccaggagtttgaggttgcagtgaattactatgattgctccactgcatgacagagcatgaccctgtctctaaaaaaaagaaaagtaaaagaatagcgatgttgaaaatgaggtaatgaggtgcccttccccccaaaaaatgagtagttgttagcttttagctgtcatcgtggtacagctaccattttaagggaagggtagccttcccttaaaact

SEQ ID NO: 9801 - DNA, 386 bp, Homo sapiens
gctgcatctgctggcactgggagccacagaagggttttgagcagggaaacgacttactgtgtttttaccggggcgggggggatccttatggcagcagagaggggtgtgagttctgagccagtcctttcccaaggagagagacccttccctcaggttgaggccagtcctagtcccagaagccccccaccccccgatgcccaggacccctctcctgactgcccccatctctccgcagggatgtttcatcttctcgctcgtcaagtacgtacccctgacctacaacaaaacatacgtgtaccccaactgggccattgggctgggctggagcctggcctttcctccatgctctgcgttcccttggtcatcgcatccgcctctgcagactg

SEQ ID NO: 9802 - DNA, 351 bp, Homo sapiens
  misc_feature 326: n = A,T,C or G
cttttgcctagggttgacccgtttccgccactgatcagctgaatgaccctgggacaagtcccttaaactctctggatctcattgcatctgtaaagtctgagagaatgacaaagtgtcctttctagtcctgaccctatgcctcatcctgtactttctccataggtgcccaacgctctgggagagccccaggtgccctcccagcaggccacctcctgctgtttctcacccttggtgtcctttctctgctccttttggtgactggagcctttggctttcacctttggagaagacaggtgagccagggacatggcaaccccgccccccancagctcccgtcttcatcctcagaag

SEQ ID NO: 9803 - DNA, 348 bp, Homo sapiens
gccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggtgagtctcagcactgtgggggcagctgagagggagcggactgggaaggggaacaaccatggccaaggagggccagccaggtagccccaggcttagtgcactggagtgtgttctgcttgtcccccaggccacagatcgccgtccgactgctggcccacaagatccagtccccacaggaatgggaggcgctccacgccct

SEQ ID NO: 9804 - DNA, 379 bp, Homo sapiens
  misc_feature 151, 158, 160, 162, 166, 168, 170, 175, 186, 189, 190, 193,211, 215, 220, 249, 254, 255, 259, 267, 277, 278, 281, 282,284, 293, 296, 313, 315, 322, 327, 338, 347, 372: n = A,T,C or G
tccagctcctctcaacagcccaacccacaccagcctcagacaccaccatgaccggctcctgctgcggctccaccttgtctttcctgacctacgggggaggtgtgggaggattttctggacattacaaagccacctgttgtggacctgatgnaaacatnanantaanangncgctnagaatgttaanagnntantgctaaacacatgggagntgantccanagtacagacactatcctggagaagaaaanatttnntaanaatactantagccagcgnnttnntnattcgactntcngccctgctatgcaaaangngctgatnctggnaggcttgaacnccgtatgtnaataagggttaaatgacaatctttnggttttt

SEQ ID NO: 9805 - DNA, 411 bp, Homo sapiens
ggcacttttgacttcctggggtccttcttcagttaaaaaaaaaaattagaaaattaggccgggcgtgggggcacatgcctgtgatccacccacctcagcctcccaaagtgctgggattacaggtgtgagccactgtgcccggccttgactaccatattttaaatttactggaggacttttttgttctcttcttttttctttttttaatagcatcccgctcttatttcagaataaaaaatttttaaggtatgttgagtaagaatctatagagcaatgaaaatgcaagagcaatagctatgggcaccaaatggtcaatcttcttatcataatgttgagtggaagaagccaggtccaccagacacatgctgctcatttattcaaagtttggacacaggcaaaacaaaatagttt

SEQ ID NO: 9806 - DNA, 407 bp, Homo sapiens
accaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagt

SEQ ID NO: 9807 - DNA, 403 bp, Homo sapiens
  misc_feature 371: n = A,T,C or G
gttttgtttatttctgcaagattgtgaaaacaaaactttgggtatttgtttcccattcaggagatctgggagtgacttcatgtatttctttaacagtctttgatcgtcacctttcaatttagactctagagacagggagattgatgatttctcagcaaagaagcttgtatttgagttgaaagttgaaaatgaaggcaaggtcttcatttaaactttaaaatttctacacatttctttcaagtattaaatttttcttttgcagttattctacctatggaaatccaggcagccaaggctatggacaagcatcacaaagctattctggctatgggcaaacgactgattcctcttatggacagaactacagcggntactccagttatggacaaagttattcacagtc

SEQ ID NO: 9808 - DNA, 281 bp, Homo sapiens
ctgtctttagctttgaagcagttttcatgtaatcattgccacctcttcgctacatgaactactattgataccagcatacaagtgtatagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacataagaagaccgtgtctctggaatttttttttttttt

SEQ ID NO: 9809 - DNA, 398 bp, Homo sapiens
  misc_feature 160, 172, 181, 185, 188, 192, 198, 199, 201, 203, 205, 206,216, 222, 225, 226, 229, 230, 232, 233, 239, 242, 246, 248,249, 250, 253, 257, 258, 266, 271, 272, 276, 278, 282, 285,286, 289, 292, 293, 295, 297, 302, 305, 311, 315, 319: n = A,T,C or G
  misc_feature 326, 327, 328, 329, 330, 333, 335, 336, 338, 341, 346, 355,357, 362, 366, 368, 370, 373, 374, 380, 391, 392: n = A,T,C or G
gccatcacagtcctcctccgaggcctaggccgcccccagcagcacagaccccgccgcctcctacggccgactctgggttcccttcaggtgttggtgtcggcagggctgtcagggcacatgcctggccggctggggtccccacccgcggagacggtcctanacccagtggggnaggtgtggnaggnttnaccnaaacanntncncnntttcatcaanaattanttnntanncnncttttnctntatntnnntcncccnnataattantactnncacncnattntannatnacnntncntcctnttntttatncttnatgntgaagcnnnnnctntnnantcntattnaatcgctantnctaancacngnanatnnccatcntttataaacannctctat

SEQ ID NO: 9810 - DNA, 479 bp, Homo sapiens
  misc_feature 5, 10, 21: n = A,T,C or G
tttgnactcnataatacattntacttcctctttttgcaggatcccatcgattcggttcagagaggccaggccctgtgtccgtggctgcccagggagaaagggcagtgtgatctcctgcctccccagccttctgcagatatcatggccatctccagaaggctaggatcggcaccgtttccctgcacctttaaagactgtttgggcccggcgtggtggctcatgcctgtaatcccagcacttttggaggcctaggtgggcggatcatgaggtcaggagatcgagatcatcctggctaacacggtgaaatcctgtctctactaaaaatacaaaaaattagccaggcatggtggcacttgcctgtagtcccagctactcgggaggctgagacgggagaatctcttgaacccgggaggtggaggttgcggtgggtggagatcacaccactgcactccagcctgggtgacacagtaggaatctgt

SEQ ID NO: 9811 - DNA, 481 bp, Homo sapiens
  misc_feature 6, 13, 20, 21, 29: n = A,T,C or G
tttggnactctanaatacannctacttgntctttttgcaggatcccatcgattcgtttagatgttccagagtcctcagagtccatgaaaggactcacagtggagaaaagccctatgaatgtaaacaatgtggtaaagccttcaaatattctagtaacctatgtgagcatgaaagaactcacactggagtgaaaccttatggatgtaaggaatgtggtaagtcgtttacttcttccagtgcccttcgaagccatgaaaggactcatactggagaaaaaccctatgaatgtaagaaatgtggtaaagccttcagttgttccagttcccttcgaaagcatgaaagagcttatatgtggtaaaaaacaacaacaacaaaacacctctgtcaatgtaagaagtgtgttaaagctttcagttattctagtttcattagaacacgtgaaaaaattaaaaactcaaattagagagaacccaacacatgt

SEQ ID NO: 9812 - DNA, 421 bp, Homo sapiens
  misc_feature 408: n = A,T,C or G
catggctgtccactccttgcctgtccccacagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatacgggcacctgactncctgattgacata

SEQ ID NO: 9813 - DNA, 397 bp, Homo sapiens
aagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcct

SEQ ID NO: 9814 - DNA, 346 bp, Homo sapiens
  misc_feature 318, 328, 333: n = A,T,C or G
gccaccatgcctggcccatgattccacttttatacaatattttaagtagtaaactaggaaatagaagtagaaagatgtttgcctatggtaagagctgtgaaacctcagtggagccagagatcaaggagggttatttagaaaaaggaggtcctcacccaggtggccaactcaaaggcacatagacttggctacagacaaggaaacagtgcagagtttggccttactgaagattatgaaacagttctgcaacctttctcaaactcctatcagctacagtccacaagtgggctttccatcagaaatctgcagggaaacagncagcataatnctggngcaggctgtgatc

SEQ ID NO: 9815 - DNA, 341 bp, Homo sapiens
atcgatgctctcctggctcgcgtaacttcagtaggatcatctgggggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagtaaaatttcattctggccacccagtcagctcaggccttcttggatcagcatggccacaatctcacacctgaggagcaacagatgctgcaacagaagctgggagagctaaaggaacaatactctat

SEQ ID NO: 9816 - DNA, 342 bp, Homo sapiens
atcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctact

SEQ ID NO: 9817 - DNA, 479 bp, Homo sapiens
  misc_feature 5, 27, 33, 329, 330, 332, 341, 351, 356, 358, 360, 371, 373,378, 380, 385, 388, 389, 390, 392, 393, 400, 401, 407, 410,421, 423, 425, 431, 434, 435, 436, 437, 441, 445, 446, 448,455, 459, 460, 468: n = A,T,C or G
ttttnaaccccccttaacaaacccccntttttnatcccccttaatacaagctacttgttctttttgcaggatcccatcgattcgaattcaaggcctgtcgagcctctagacattgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggtttaaannancaacctttncctttttttntaaangngntccccctatgngnttttncnatganaannnannaaccttnnggtttnttntccaaacaagntntnccgggnaannnntttntatnncnaactttntttnnattctccnaaaaaacccct

SEQ ID NO: 9818 - DNA, 401 bp, Homo sapiens
gcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggagggggtcctggatcccaagtcaaccattgttgccatctttccgtctcccatgttatatgctggccccacagaggtccagtggcactgcaggtcccggatgattgcgggtgccaatttctacattgtggggaggaccctgcaggaatgccccatcctgaaaccaagaaggatctgtatgaacccactcatggggggcaaggcttgagc

SEQ ID NO: 9819 - DNA, 417 bp, Homo sapiens
gcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatg

SEQ ID NO: 9820 - DNA, 486 bp, Homo sapiens
  misc_feature 15, 16, 23, 24: n = A,T,C or G
ttgaaacccctttgnnatcttgnnaccctttaatacaagctacttgttctttttgcaggatcccatcgattcgaattcggcacgagtagaggttaatggggttgacctgaggaactccagccacgaagaagccatcacagccctgaggcagaccccccagaaggtgcggctggtggtgtatagagatgaagcacactaccgggatgaggagaacttggagattttccctgtggatctgcagaagaaagctggccggggcctgggcctgagcatcgttgggaaacgaaatggaagcggagtgtttatttctgacatcgtgaaaggcggagccgcagacctggatgggagattgattcagggagatcagatcttatctgtgaatggggaggacatgagaaatgcctcacaggagacagtggccaccatcctcaagtgtgcacagggacttgtgcagctagagattggaagactccgagctggttcctg

SEQ ID NO: 9821 - DNA, 348 bp, Homo sapiens
ggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctt

SEQ ID NO: 9822 - DNA, 339 bp, Homo sapiens
cggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggata

SEQ ID NO: 9823 - DNA, 699 bp, Homo sapiens
  misc_feature 3, 4, 581, 678, 681, 682, 683, 684, 685, 686, 687, 688, 689,695, 699: n = A,T,C or G
ganntcgttacaagctacttgttctttttgcaggatcccatcgattcgaattcggcacgagggtagctgggactataggcacacaccaccacgcccggctaattttttatgttttttgtagagacagggttttgccatgttgcccaggctggtcttgaactgctgggttcaagcgatctgttctgctcagcctcccaaagtcctgtgattacaggtgtgagctaccatgcctggcccctttttacagatttgaggatggttttatatcacctcaatttctgagaacctcaagctatgaacttcgtttaaggtagttccaagtttaaggtagaaccagttccaggttcctaaccccactcccagatacctggcagaatcaaagatgaatctccggaggagggcaccttcttcctaattttcaagggtcaatgagcagtacagtcagaaataacaaagcgtacagggaaacaaaatgtgatgcgagaaacaacagaagcaatgaatagaataaaagaaaaccagactcacaaattctttgtgtattatgagtacagagacaaataaaaacctatgcttattgngttcatagaaataaaagtacccttataaataccttcatggaatgggtaacaattaaaaagtggcttggcagattttaagaaggttaaacaaaaaaanaannnnnnnnnaaaaanctcn

SEQ ID NO: 9824 - DNA, 762 bp, Homo sapiens
  misc_feature 1, 617, 713, 717: n = A,T,C or G
nttatcagctcttgttctttttgcaggatcccatcgattcgaattcggcacgaggccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcaacacgttcagcccccaattacgcctgcctnaaccttgcgatgcgccaacataccatcattgacaccagaatgtgagaacgcctacccggcaacatcacagacaccatggtgtgtgccaacgtgcangaanggggcaaggattctggcaggtgacttcggggcccttttggttgta

SEQ ID NO: 9825 - DNA, 695 bp, Homo sapiens
  misc_feature 300, 330, 387, 390, 433, 435, 467, 535, 570, 578, 606, 617,619, 631, 652, 667, 678: n = A,T,C or G
ttcaaatacaagctcttgttctttttgcaggatccctcgattcgaattccgttgctgtcgcccatctgcttgtcgttttaaacctagaaaatagtggctattggctgggcatgatagctcacgcctgtaatcccacacttcggggggctgaggcaggtctgtacaaaaaattcaaaaaaattagctcagtgtggtgggcacacacctgtagtcccagatactcgggaggctgaagtgggacaatcacctgagcctggcagtcaagctacagtgaggcacgattgaacctctgctctccancttgggtgacagagtaagactctgtctcanaaaaaaaaaaacaaaaaacagtggctattaatcttcccctcagttcctcccatcctnctncccttcccggggctagaaagccgaagctgagattcaatcccanangccagctggatttgggagacctcaaatgccangtcaggcataagttgcactctacccacatcaccaagtgtccccaggaaagcagaagtgtgtcctcttnccttttcaggtctcacttctgctgacatgggctanggctgaanagttccaatgggaaggtcacagcccgtnccaaggaaaananaaatgggaacangcattggggagaccaactgtntgtacccatctcctntttgtcctggnagaaggtcctctttctg

SEQ ID NO: 9826 - DNA, 640 bp, Homo sapiens
  misc_feature 13, 69, 352, 433, 529: n = A,T,C or G
ttgaactataganacaagctacttgttctttttgcaggatcccatcgattcgaattccgttgctgtcgncaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaaggtgagtggccggcagtggaaggctgttgctcattctgatttctgttggctctatttcatgctaacccanttttttttgtttgtttgtttccactttataacatatggatttctatgccacactacccgtaactttgaaaaataactttangctgcagttttcagcaaacaggacagtccttagctgccacatagctcaacataaagtgcacaaaaaacttcacggtgggacagtgaatcataaatncccaaactgacgtgtgtctacagaacagatgagaactgttactcagtgtgtatcttaagagcttttctgcagtttcctcacactccgtcacatttaaaatgtggcacttgt

SEQ ID NO: 9827 - DNA, 669 bp, Homo sapiens
  misc_feature 3, 8, 18, 22, 25, 48, 50, 52, 54, 62, 63, 453, 533, 660,663, 669: n = A,T,C or G
ttnttcgntacaactctngtgnttntgcaggatcccatcgattccaangntncngatgtcgnnagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcaactttcnggcctcaacagtggcatctgtaaaggacctccagataaactgttggcttcaaaaacggatcactgttagccgtgggcagnctttgaggctggtaccattccagtgatgtggtaggagaccagtcaacccttaaaaatatattgcaagccattcttgacatgcccctacttgatagcacccataaaaaaaaaaactctggcgtttctnacnctaaan

SEQ ID NO: 9828 - DNA, 749 bp, Homo sapiens
  misc_feature 7, 308, 310, 446, 526, 572, 673, 678, 697, 744, 747: n = A,T,C or G
ttattgnatcaactcttgttctttttgcaggatcccatcgattcgaattggcacgaggcggtctccacgggagccaccggtcctgaaagcgcggagcatgctttgtttgcggaaacgaaagcgaatacttctttccaaggagacttaggaaagggcagacgctcccactgcctcaggtgttccctggaggaccttcaagtggccgccgtgtgggcggctagcgtcccgctgctgcgctggttccggagcccttcccttgcctctcccagggtccttctcccagcgtcggaggaagcccgccgtctgcnantggagtgcgggtggtgggaatccctgggaggattacgaaatccttaaagtgggatttaccaaacgcattcctttccgctcacttccgttcccgcttaacaaacgtgtttggaaacgtgttgctactgaaaggaaantggcgctgggcttgcattttctgtggctagtctgcgagaaacagccctggaatagggcctctattcttccttggagcatnccttcccgggacctgggaattgaaactctaggttaagcacttgaancaggcccaagactgggtctctgaaatcatggggctctaccctgagttaactaagttttcaaaaatgttactaggctaaagacttgtgcttcaaatgtttanaaganagttgggaaaaggcttttntaaaggtaattttattggaaatgggatgttgttaccgattcggcgtnttntt

SEQ ID NO: 9829 - DNA, 839 bp, Homo sapiens
  misc_feature 7, 9, 13, 63, 118, 119, 120, 447, 465, 492, 499, 533, 544,554, 560, 579, 582, 586, 590, 609, 619, 629, 644, 666, 680,699, 704, 715, 720, 727, 729, 731, 737, 741, 749, 759, 762,765, 768, 805, 806, 833, 838: n = A,T,C or G
tcttttntntgancccatcgattcgcggggacggagctcggcgtgcttgctgctggagggttntggccctgcaaggctgtgggctccgacctcaccgggagtcgacagcgagaggttnnncgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgaccttttctgcggaagggctttctctacgtgctgttgctcatgggtttttgtcggagccccaacgcccttccggncttttgattcctggaaanaaaaggggttggttccccttcaagcanccccaancattccccgggaaaaaatgggggagccaaagggnttttggccaanggccccaatncccggnttcaacccgttgggttggnaantttnaccnaaattaacttcctttcctncaaggcccgnggaaaaaacnttttcccgggccacngggggggaaccaaccttgcaanggggccttgtaccnggtcttcaaacggcgggtnccaanaacccttgccnccatngaaaccnantnggaacncctngggggttnttccccaatnggngcnccnaaaaaacaaccccggttccaaccatttaagggaaaannggcgggggggccccaagggcccttttnggacnt

SEQ ID NO: 9830 - DNA, 668 bp, Homo sapiens
  misc_feature 102, 175, 237, 264, 302, 394, 446, 459, 465, 471, 529, 571,588, 611, 625, 642, 652: n = A,T,C or G
tatacatcaactacttgttctttttgcaggatcccatcgattcgaattcggcacgaggtccgttggaccttctctgacttcagggtgagtcgtgaggtaggnagaggcccgggtttagcgatgagaccagtatgaaacggagggccacgggagggcccgaggggagcaggcgacnctcagctatgggttaccttctctttgggaccgatgggtgctggggaggatcccccatttgcnttttagccgcaccccctgagccgtctncgttcgaccctgggatcctccagatcccagattcttangaaggaccttggagatcagctggaccagcccctgacttgcctggtttcggaagcggaaacccaacggtgcccttagctgtcaaggatgctgngggaagagtggagcctctaacccgagacgctagacccaatttggtgcccatnggaggagtgggantggtanatgcancaagaccactcctttcttggcccaccatttctctcaccatttttactgcagtgaactnctctcagggtggggggctggtcagaagcaacttccgcttttnataactctcacaaggtnctttgtcggaaggtgtgccttgncttctaccccacgngggtggggagtgcgacncccaaggggntttttttttttttttt

SEQ ID NO: 9831 - DNA, 728 bp, Homo sapiens
  misc_feature 3, 6, 7, 8, 9, 10, 11, 17, 18, 19, 21, 22, 28, 683: n = A,T,C or G
ggnttnnnnnnttttgnnntnnatatanatcagctacttgttctttttgcaggatcccatcgattcgaattcggcacgagcttaaaagaaaatgctatctgggagctccaacctgcaattaacctacagaaggaaccttttgagaggctggtgcagcgcttcggggaggcagattaagaactgacctagaaacagaagtgaagtttgaagtctgctctctgcaaagagggtgggagtgggtggagaagaggcttgttttaaaagccaaaaacagaaagtaaaaagaaatgggaaagtaaaaccaaagcagcaagtgactctcttctgatgtgcacttttcatttttctcccccacatttcagtgttagaaagaaaacgagaggagctagggaaagaaggagttggggacagaagactaagatttcaacgtgaaattccatttacaaaggctttactgcaaacaatagctaatttagtcctgtaaacatgcatttatcatacattttaattttaatattaaaaatactgcatgtaaatgttctgaactaaaggtagatagcaatatgtagtttgccataaaatgaatgcatgtcttattcttttccatagttcttcattaatgagacttgtagtcaagaatagattgaagataccattctccttgtgtagttcaaaaaaatctnctctggtaatactgaaacaactaatttttcttatttggttggtcc

SEQ ID NO: 9832 - DNA, 718 bp, Homo sapiens
  misc_feature 3, 6, 7, 12, 16, 21, 25, 34, 35, 39, 40, 87, 88, 102, 103,122, 130, 148, 156, 174, 212, 249, 283, 298, 406, 422, 430,483, 501, 570, 621, 648, 657, 678, 684, 706, 716: n = A,T,C or G
gancannaaacncttnaaccncccngctacttgnncttnntgcaggatcccatcgattcgaattcggcacgaggccgcctccgcgcnnttttttggaggctnngcaagggaacttcgccacntccagatncttcgggccattgggaanggcagctntggcaaggtgtgcattgngcagaagcgggacacggagaagatgtacgccatgaagnacatgaacaagcagcagtgcatcgagcgcgacgaggnccgcaacgtcttccgggagctggagatcctgcangagatcgagcacgtnttcctggtgaacctctggtactccttcaggacgaggaggacatgttcatggtcgtggacctgctactgggcggggacctgcgctaccacctgcagcagaacgtgcagntctccgaggacacagngaggctgnacatctgcgagatggcactggctctggactacctgcgcggccagcacatcatncacagagatgtcaagccngacaacattctcctggatgagagaggacatgcacacctgaccgacttcaacattgccaccatcatcaangacggggagcgggcgacggcattaacaggcaccaagccgtacatggctccngagatcttccactcttttggcaacggngggaccggntactacatcgaggtggactgntggtanggtgggggtgatggcctatganctgttgcganga

SEQ ID NO: 9833 - DNA, 787 bp, Homo sapiens
  misc_feature 3, 6, 8, 11, 14, 19, 545, 637, 646, 706, 707, 708, 709, 710,711, 715, 717, 721, 722, 742, 759, 782: n = A,T,C or G
tantcnanccncgntcgantccgtgctgtcggttatactaggaattctttataaacttaataaatgaaagctttttctcttataggcccgattctctagtggacttctggtgaaattatgtggctaccttccattaatgttaatggaggttatggatataaatccctccatagtgatggaagaatgagccccagagagaagaatgtttctaatgaatcactggattgtgatataggattaacttggtgtccctaataccattttttttcctcctgaaagtttaaggtcttatgtttaggaactagtttctctccaccttaatcctttattgtcaagtctgcaataatgttaagaacaggaaaaaaaaaatgtagattcctggataggcacagtttttatattaatgtaactatataggcatagtttttatattaatgtaactatacagcacctatttttgtgttttactattacttggcagacatcttgagtgttttacaaggttatcgtatatttcactaataatcgttgcttgataatttggngcctgacagactgcagtttattatttagtattaaagctcctcaggaggttgagacaggagaatcacttgaacctgggaggtggaggttgcantgagctgangcccgcaccactggactccaacctgggcaacagaagtgagactctgtctcaaaggacccnnnnnnaaananaaannttcctggggccgtttttccntaaacccaacttgaaanaacccttggtgagtttggccaancccct

SEQ ID NO: 9834 - DNA, 699 bp, Homo sapiens; identical to SEQ ID NO: 9823
  misc_feature 3, 4, 581, 678, 681, 682, 683, 684, 685, 686, 687, 688, 689,695, 699: n = A,T,C or G

SEQ ID NO: 9835 - DNA, 762 bp, Homo sapiens; identical to SEQ ID NO: 9824
  misc_feature 1, 617, 713, 717: n = A,T,C or G

SEQ ID NO: 9836 - DNA, 668 bp, Homo sapiens; identical to SEQ ID NO: 9830
  misc_feature 102, 175, 237, 264, 302, 394, 446, 459, 465, 471, 529, 571,588, 611, 625, 642, 652: n = A,T,C or G

SEQ ID NO: 9837 - DNA, 720 bp, Homo sapiens
  misc_feature 468, 530, 566, 608, 717: n = A,T,C or G
atcgcttgaatccgggaggcggaggttgcagtgggccgagttagcaccattgcactccagcctgggcgacagagtgagactccgtctcaaaaaataataaatgaagtaacaatggtgaagtttgaagtaactcaggtgaagtaacacctaagtggaaattccatactccactcagtaaaccatgcccggcccccctcaaatggttttatctgtcacactggtgctccatgcaatggacaaaggagacgtttcctgtaggaccagcatctctttactcaggtttttcaatcttggaactgctgacattttgggccaagtaattctttgttgcagggactgtcctgtgcatttcaggatgtttaacagmatctttgtcctctacccattagttgcttagtcagaataatcagaaaagtccccagacattgccaaatgccccctggagttgcctggttgcctgggttgagnatcactatgcttaaagaaaggggctcttggttgtaaatcccagcacttttgggaaggccgangccggaaggattcacgaaggtcaggagattcgagancatcctggttaacacagtgaaaccccatctctacttaaaatnccaaaatttagctgggcatggtgggcaagcgtctgtagtcccagctactcgggaagcttaagcaagagaatgtgcatgaaacccgggaggtggaactttcagtgagccnaga

SEQ ID NO: 9838 - DNA, 690 bp, Homo sapiens
tgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggtttttwattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgt

SEQ ID NO: 9839 - DNA, 1042 bp, Homo sapiens
cattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcarctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactkcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagagaacattttccagatggcgaggtcacagcagagagatgtggccacctagcctttccttatccccttcccttcccttcacccccatcctcttactcctttcatgtcccatttcagacagagtaaccattaacaaaa

SEQ ID NO: 9840 - DNA, 382 bp, Homo sapiens; identical to SEQ ID NO: 9382
  misc_feature 371: n = A,T,C or G

SEQ ID NO: 9841 - DNA, 409 bp, Homo sapiens; identical to SEQ ID NO: 9520

SEQ ID NO: 9842 - DNA, 441 bp, Homo sapiens
ccaggctggctgtttttcttggtgaatgttctccaggctggttatttttcttggtgaatgtaatgtactgtctttttagagtaagttactaagctggttactaaatcaggaatattttagttataaaactttagatttttaagaatattggcsaggcacggtggctcacacctgtaatcccagcacgttgggaggccaaggcgggtggatcacctgagatcgggagttcaagaccagcctggcyaacatggtgaaacccygtctctacaaawgaaaaaaatacaaaaattagcygggtgtkgtggygyatgcstgtaatcccarytayttgggwggctgarrcasgagaatygcttgarcytggarggcggaggttgcmgtgagcyragatckygccaytgcactccagcctaggcaacaagagcaaaactccatctcaaa

SEQ ID NO: 9843 - DNA, 422 bp, Homo sapiens; identical to SEQ ID NO: 8873
  misc_feature 399: n = A,T,C or G

SEQ ID NO: 9844 - DNA, 805 bp, Homo sapiens
  misc_feature 744, 802: n = A,T,C or G
aattcggcacgaggaagtactgtggctgtatacagaacctgtatgctggttgttcttttgcgggtccagataaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggcctgtggactttctcctcgagacattaccactattaaacttctcaatgaaactagagacatgttggaaagcccagattttagtacagttttgaatacctgtttaaaccgaggttttagtagacttctagacaatatggctgagttctttcgacctactgaacaggacctgcaacatggtaactctatgaatagtctttccagtgtcagcctgcctttagctaagataattccaatagtaaacggacagatccattcagtttgcagtgaaacacctagtcattttgtttcaggatctgttggacatgggagcaagtgaaagganttgctgctaatgtgtatggaggcttttaggtacccctcaggcaatcgggagaattggnttt

SEQ ID NO: 9845 - DNA, 423 bp, Homo sapiens
  misc_feature 403, 409: n = A,T,C or G
ctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttccctttttngctgtngtttgcattcacgg

SEQ ID NO: 9846 - DNA, 813 bp, Homo sapiens
  misc_feature 501, 512, 531, 701: n = A,T,C or G
accctttgactttctgcaggaacccatcgattcgctggtcagttcagtccctatgaatgtctcttctacaggaggctaccctgcccctgctaccctgggagaagcctcagctttctgggcagagtttgtctccctgtcatttatactctcaggctttatacatttacasagtaagttctccctcctggaggkttaaaaggaataatttcaacagggtgaaggcctggcacggtggctcacaactgtaatccaaggactttrggaggctgaggtgggtggatcacctgaggtcaggaattwgagaccagcctggccaacttggtgaaaccctgtctctactaaaaacaaaaattagccaggtgaggtggcacacacctatagccccagctactgggggaggctgaggcaggagaattgcttgaacctgggaggcagaggttacagtgagctgagatggcaccactgcactccagcctaggtgacaaagcagcaagacgcagnctccaaaacanaacaacaacaacaaaaaanaaccgggaaaacaggtacagacaatagctgcctggagttgtacagaaacttgattgggtaaccctgggacctttccaggctgtggccagcagttgaccctgcctgcctttcctccattgttttcccatgtctgaccttccctgtttgcaaagcagtgggcctacttacangggtctctctggaagggagcaaggaggctcagtggccccattcagcaatttcgaagtcccctttaattgttttgtgcttccaacctgttttgttccccgttcagatttctcc

SEQ ID NO: 9847 - DNA, 844 bp, Homo sapiens
  misc_feature 815, 822, 834: n = A,T,C or G
gctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaagagttgcatgctkagaawttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacmagaaggagcatcactgtcttactcaggaaggactgaggaaacctggctkgttcattatgtagtttcaggatattttatccaccaatccatccctccatttatggggnaggaccnttttttaaaggncattgttttt

SEQ ID NO: 9848 - DNA, 401 bp, Homo sapiens; identical to SEQ ID NO: 9548
  misc_feature 350, 351, 352, 356, 361, 363: n = A,T,C or G

SEQ ID NO: 9849 - DNA, 576 bp, Homo sapiens
gaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagrtggcgatawyttgcaktttakywtctcywtrtcctgtgcatgctkakttkstggtgtaackycwkasaattaaaatwcgctgtttcagccccacgatgccagaatgctgttataggaggtataactggtataactaataattatacaagttatgatttgtattctaaaagcttaatgatgagagaggaatcgtattaataaatattttgagtgaaatc

SEQ ID NO: 9850 - DNA, 429 bp, Homo sapiens; identical to SEQ ID NO: 9114
  misc_feature 401, 417: n = A,T,C or G

SEQ ID NO: 9851 - DNA, 755 bp, Homo sapiens
  misc_feature 688, 699, 709, 724, 731, 740: n = A,T,C or G
acgctctcgggagcagttctgttaatccctgctgggagcagagactgcgaaaagctgagtccgccgatcgtgcccgggacaaggctgccttccactcgccgcatctacctggtaggcggcatgcgcacgggcttagaggcttgagagcctctggaagagaaagggtcccaggaaggaaacctgcccccggcctaagtgtcggcgcccagatcaccacgaaccccgcacctaggcgccgcccaccaagttccaaagaagtccgaggcgacctgggagtcggtcggatcccagccgagaaaagaaacaagcaggatagcaattcttakgggagccaccctgggagttttaggcagcgtttgcctttccctggttttcttcaccaagccccatcctccccccgcataccacccccagtcaaaagagtgggagaaaatgcacagttcgaagtcggtgagagcaaaaatgggtctagtaaatcaacccgtggtggtagctaaaaggtttggggctgcaaagaaacaaactgtaagttttgagcaacaaactttttcttcaatctgtaatatgtcgaaatgggaagggggtgttgcaaaagccaacttaccactgttcaaacttaggcccgtttacaacatgggggaaagggcgtatttctttacttattatcttcaacaacggttaacatggntgttttccttnctttaccctngatgtttggaactgncgattcntcctccggntccattgttccgggg

SEQ ID NO: 9852 - DNA, 871 bp, Homo sapiens
gggtgttttgctggagatcagtcaacagttctctgaagcagtgtcgatgggcctatccacgtcaggtcttcatttctgatattgctttaaatagaaatgaaattctatttgttacgcaagatggagaaggatttagagggagatggtttgaagagaaaagaaagagttctgaaaagaaagagattttatcaaaccttcacaattcctcatcagatgtgtcttatgtctctgatataaatagtgtgtatgaaagaattcgacttgagaaacttacctttgcacatagagctgttagtgtcagcacagatccaagtggatgcaactttgcaatcctgcagtcagatcctaaaacaagcctttatgaaattccagctgtgtcctcatcatccttttttgaagagtttggcaaactgttgagggaagcagattaaatgtacagcattcatgatgtgacatttcaagttggcaatagatctcttccctgcacataaatatattttggccagtgcattctgatatttttcagaaattgtttctctcagatggtaatacttcagaatttacagatatttaccagaaagatgaagattctgcagggtgccatctctttgtggtagagaaggttcatcctgacatgtttgaataccttttacaatttatatacacagatacttgtgactttttaactcatggcttcaaaccaagaatacacttaaacaaaaacccagaagaatatcagggaactctgaattctcatttgaataaagtgaatttccatgaagatgataaccagaagtctgcatttgaagtttacaaaagtaatcaagctcaaacagttagtgagaggcagaagagcaaacctaaatcttgt

SEQ ID NO: 9853 - DNA, 498 bp, Homo sapiens
acagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcasccmagagrwtswcatcttgaagacagagcaggtcaccaagaacattcaggaactgttgcgggcagcccaggagttcaagcatgacagcttcgtgccctgctcagagaagatcca

SEQ ID NO: 9854 - DNA, 575 bp, Homo sapiens
gaccgcggggtgggtggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagrtggcgatawyttgcaktttakywtctcywtrtcctgtgcatgctkakttkstggkgkaackycagagaattamaattcgtgtttcagccccacgatgccagaatgctgttataggaggtataactggtataactaataattatacaagttatgatttgtattctaaaagcttaatgatgagagaggaatcgtattaataaatattttgagtgaaatc

SEQ ID NO: 9855 - DNA, 383 bp, Homo sapiens; identical to SEQ ID NO: 9556

SEQ ID NO: 9856 - DNA, 545 bp, Homo sapiens
cagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcarggggcagtgagcttggccctcagtccaccccctccgcctcctggcctccrccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccaaaaaatc

SEQ ID NO: 9857 - DNA, 530 bp, Homo sapiens
  misc_feature 499, 523, 526: n = A,T,C or G
aattcggcacgaggtggaaggacagcatcgatgaactctcctggaggtcactgcaaagggtggcagaccctgctgaggtccctgaatctgcagcctccagacaataaactgaaccttacccagaaggctggcacaaagcccccagctctgtgggtaggatctccccttcactgccctctctctgagaaaggacagcacacccttgggaaaagggggaggagagagactgagccacaaatcccactgctggaaattacctattcagcagagaagctgggtcttgggctgtgaatcactgcaggcctcctgataagctgctgcctccagccctgcacagctgtctgttgagagataacagcctcataagcttctctgcccaactccaagccagctggggggtgggggtgctgctgtgtgctggaagarctctggtgagttgggggtggcatacagccccaggatctcagaagcagatctcatcccatgcaactcagcagcncccctggaaagggggagatgcggnagnatgt

SEQ ID NO: 9858 - DNA, 610 bp, Homo sapiens
cagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctycagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactkgccagctccatggggaatctgccagaagtggacttccctgtccccccaggca

SEQ ID NO: 9859 - DNA, 843 bp, Homo sapiens
  misc_feature 465, 767, 797: n = A,T,C or G
gcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagaatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcaatccttccgaacatttaatgcaacntgactacaaacctatagcaaccattgatgtgaacggaacatytttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacmccgatgatttagatgagcttgacactgaccagttgctggaggcggagttggaggaggacgncaataatgagaacgcaggggaagatggggncaatgaacttctctcccttctgatgtaggagctagcaaacctttct

SEQ ID NO: 9860 - DNA, 458 bp, Homo sapiens
  misc_feature 439: n = A,T,C or G
ggggccaccaatctggccgacctcaggctctgggaaacaggctgccctcgtccctctgcctgtgggtggctgaggcttctcagcccatctccagttctctgcagcaaaggccctctgtttctgtcctgcagtgggggccctttcgtggttaaacatgtccctcccctcctcacagaactgagtacctattgcggctgggcccgcccaaccctgtgtccctgcacccatgggttctaccacctgattcggctgcagctgtcactgtcccgtgtctgctctctgtcaggcctctgagtgctgcagacgtattaacatatcaccgctagttgatggaaagtcttgtttcttattagaatattttgtgtaggcacagggtkscccagcacctgtctatagcaaccccagtgtcctcacagtgcacgtgagccgtgaccgcagncaacgttgagtcgcgcctg

SEQ ID NO: 9861 - DNA, 389 bp, Homo sapiens; identical to SEQ ID NO: 8913

SEQ ID NO: 9862 - DNA, 869 bp, Homo sapiens
  misc_feature 504, 856: n = A,T,C or G
gcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaagggtgagaggaaggggsaagtgatgtgtaactgctcaagagatgcttaaacctccatagagaggagccgggcgcaggggcatctgtgtgtcccgtcacacactgcagcagggaagggtggctggctggctccctggcatcagtggtttggtttaagctccagaggktcttattgccattgtcttttcctctgccccttgagccagcctaaggcctggangtctgtttctttaaggcggatgaactgacatgctcctaccaatgaccaaggctctgggcaaaggctcctcacagtatccttgagaaggtgggcatggaagtgccaatttctcaggtacagaaaccttcagagaggataaatagctttgccctgtagaagcaggactgaaacccttgtccgcctgactcccccagctactctgcccactgtagccccctgccttacttgtcctggcaaaccctcaacatcctgtataccttaaatatccaagagggcaagagagaaaggcttaaagataagtaatttttaaggaccttataatatttttaagaagtacccaatagtggcgtgnaatgccaaaaaaa

SEQ ID NO: 9863 - DNA, 706 bp, Homo sapiens
gcaaaatacactttcaaattaagaatgggtctgtgatgtcacatctaggagcacctacccatggacagacatgtcttcccatggaggaggctttcgagctacccttggatgattgtgaagtgattgaaactgcagcagcgtccgaagtgattaaatatgagyatcwtgtcttatgcagaytsctstagctascawgtgcstgtwcttwwcttyagrrctctgmagmtkyttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataaggccaaaagagaaacattggctactttgacaaccttaaagcggactccaggaatatcaccaacagcatgacctttgcgaccaaatccagcaaccagaacttcatcattttcctggaataaaataagaagtttatttctggtgttggtggcgatcacaaaaatactttcatgtgaggaaactcccttgcatcagataaaaatgtgagggaggccaccccaacaacagaaggtacgatagagttgaaatactcacctcaataaagttcaagcaaccgtc

SEQ ID NO: 9864 - DNA, 403 bp, Homo sapiens; identical to SEQ ID NO: 9151

SEQ ID NO: 9865 - DNA, 405 bp, Homo sapiens; identical to SEQ ID NO: 8925

SEQ ID NO: 9866 - DNA, 582 bp, Homo sapiens
cttctgctgggactggccattatctcagggcttctgttgcattatagccctgtgttctgctggaaagtaggaaacacttccaggggacaaaacatggatgatgtcatggttttggtggattcagaagaggaagaggaggaggaggaggaggaagatgctgcagtaggggaacaggagggagcacgtgagagagaggagttgccaaaagaaatacctaagcaggaccacattsacagagtgaccgccttggtgaatgggaacatagaacagatgggaaatggattccaggatctwcaagatgacagcagtsaggagcaaagtgacattgttcaagaagaagacaggccagtctgaagaagaggatggtccatggttgtcttgctctgaaagcttggagagctacattgaagacgagctcttcattcagctttgactccactctgccacctggcgggggcttgcactaacaatgtttgggtctcagcaaaaaacaaaaccaagcacacacatctttccttccatgtattgaaaaacattggtttgatttgctctaagttttcccaatgatgtttaaaagctttg

SEQ ID NO: 9867 - DNA, 1101 bp, Homo sapiens
caagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccasctcacggscctggctgcccaacagcaggccgcagggaagggaggagaagagcaatggcagagagcaagatttgccgctgccagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctc

SEQ ID NO: 9868 - DNA, 1471 bp, Homo sapiens
  misc_feature 620, 640, 644: n = A,T,C or G
gtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggartrrysytwmykwytstrrgagsykmagyttscmacgkcgkccgatgatysyragcrgacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccmaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttatttcgtagaacgtttagaagattcgaatgcaggctcaaggaagcttgttccaagggagcatgattggnagctttatcgatatataccnaacnagaaggcaccaggggtctgtggaggggtgtggttcccactgctcagcgtgctgccatccgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaatcacaaaaaa

SEQ ID NO: 9869 - DNA, 912 bp, Homo sapiens
  misc_feature 7, 8, 12, 13, 555: n = A,T,C or G
tatgagnnatgnnaccttcaaacaagctacttgttctttttgcaggatcccatcgattcgccagctcatactttccttcgctgtccctcccgcactccttaggcaagatttcccagtaaagattttctgtgcgtattttaaaagtcgtgttaatactcatgataattattagggacctggcagcgtgattggagtatggatgtttccgtaaaagctggaattccgtaaaagcattgacgcagcccctacactccatcccaaccaagaaactgcatttcctggggccaggtgggagctgcctttgccccactgcctcccctgttctgctctctcagtcaacatgtggaaatccaaggaggacaaagactccagccacgctgcttaaatagggctcctctctcctctctctctctctaggtggtaaggttggggattaagtccaggtacagaagcaaaactttttttctaaggataaacatctcttccaaggggatggagagtgggtccctcaacaaagtccctgtccagtcacctttccatcagggcactagccanggaatgactcctcacactttcacctttactgatttccagaggaaagctagaggatctagttcaagaggcaagaagatctggccctcaattagctaaatgtagaygctgcctaacagttccctcctcaaaggccaccttggtgctgtgggggccccttgcctcttcccttcccactggtgcattacaaaacagtgttcttttgaaatgttcatcaggaataggcttttttaaaaaatgttgtgtatctgtatatagtattgtgatgtctgaatgacaatgtactgaatgcaaaaaggaaaaaaacccacaaacatgtttttaaaataaaatatctttttttgccttgaaaaaaaaaaa

SEQ ID NO: 9870 - DNA, 765 bp, Homo sapiens
  misc_feature 727, 744: n = A,T,C or G
ggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggcactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggatggagctaattgcccagggcctttttggagtctgaggaccgccccgcagaggactccgaggatgagggtccttgcttgagctttcngcaaacgggcaaggctnaagctggaaggcactttagtt

SEQ ID NO: 9871 - DNA, 1033 bp, Homo sapiens
  misc_feature 5, 6, 7, 8, 9, 10, 11, 12, 13, 19, 26, 761, 949, 966, 970: n = A,T,C or G
ccttnnnnnnnnntttggnactctanaatacaagctacttgttctttttgcaggatcccatcgattcgttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggyrygswggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaarggctgcagccacatgagaattcagtccacacaagccccatggccgtgttccccacttcagccacngrgctcagggagccmatctggcgctaaggggaactgctggggtgtgggtgacacctgcctttggcgttctgccttggggaggtttctggttttgttacggggtggaagaataggacctgggggtctcggatgcaacctgcagaccccgtggctcacccaaccccaggttctgcctcccagaccagaancggcatggcctggtccntctncgaggtgcctgctctgtaaatatcaagggattacaactttaataataaagcagaacttgaaaa

SEQ ID NO: 9872 - DNA, 517 bp, Homo sapiens
  misc_feature 506: n = A,T,C or G
aattcggcacgagacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggttgaaaataagacggcccagatattaaatcttcagcaacatttatctrcccttgaaaaagatattaaacacaatgaggaacttcttaaaaggtgccaactacattatwaagaactaaagatgaaaataagaaaaaatatttctgaaattcgggaacttgagaacatagaagaacaccagtctgtagatattgcaactttggaagatgaagctcaggaaaataaaagccaaatgnaaatggttgag

SEQ ID NO: 9873 - DNA, 968 bp, Homo sapiens
  misc_feature 632, 895, 931: n = A,T,C or G
gagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaataagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactaccycgttaacccttttcttaaaatattctctatcttnctatgtctctytctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttagtgaaacactataattaagtagttataattaaataactgttcttcatactnaggactcttaatacatttctttaagacttgtaagtntaattgtaaagcttgttaactgttttatatactaaag

SEQ ID NO: 9874 - DNA, 841 bp, Homo sapiens
ggatgaggcgctgcagtctctgcgctttcgacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggcccaacggtggccgccgccttattgctgactgccaccccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacaggtgctgttccgagactcagtcctaaagggttttttttcccactaagcaaggggccctgacctcgggatgagataacaaattgtaataaagtaacttctcttttcttcta

SEQ ID NO: 9875 - DNA, 662 bp, Homo sapiens
  misc_feature 539, 571, 630: n = A,T,C or G
ctgtttttcccagcccgttactcctgtagctctgaatggaaacagcagctcacatgtcacctctgtgtgacggactcggccccacccagacacacaggtgtggttgtcagcgagcacctcaggagaactgagaagctctttttcaccattctttccccaaatcagtcaaaaccttttaaaaaccattatgagttgtgagaaggtttcaacagctatgttttcaaagtgtgtgtatatgatggcactgtggtcagttcaccaagagcagcactgagatgggtggatccaggtgcaccttgaaaagttaattgcacaaacctttgctttgaccccaaatacgcttgctagtgcccttccctgcagcttcccagacaatcarcagggtccatgggggcagggcykggcacagcaatgccctgcttcctgtctgcatccataagaggcccctccacaccgaggctgctttaggttagccaaccaggtgcaggggaggccccatgcaggtgccattataccaacagtgaggcaagaaatcaganaaaagagggattgcctttattgtttgaggaantgaccagagattgttgttggggccagtgttcattagggaggggagaaacaggttgatgncaggttcggggatgagggcccttcccagggtt

SEQ ID NO: 9876 - DNA, 724 bp, Homo sapiens
  misc_feature 7, 704: n = A,T,C or G
ttggttnctatacacaagctcttgttctttttgcaggatcccatcgattcgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtgkctgcgtgtgagagtggcttcctcctaggaatggactttgttgcccaacagaaaatgagaactcaaacagaggagctacacttataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgangaagctgtaataccaatatt

SEQ ID NO: 9877 - DNA, 385 bp, Homo sapiens; identical to SEQ ID NO: 8954
  misc_feature 348: n = A,T,C or G

SEQ ID NO: 9878 - DNA, 393 bp, Homo sapiens; identical to SEQ ID NO: 9625

SEQ ID NO: 9879 - DNA, 900 bp, Homo sapiens
  misc_feature 740, 761, 882, 899: n = A,T,C or G
gagatgatggctgatgaagaggaagaagtcaagccgatcttgcagaaattgcaggaactcgtggatcagctctactcatttcgagactgctatttcgagacacatagtgttgaggatgcatgggaggaagcaacaggatgtgcggaaggagatggagaaaaccctacagcagatggaagaagtagtgggttctgtccagggcaaggcacaagttctaatgctaactgggaaagcactaaatgtgactcctgactatagccctaaggctgaggagcttctgtcaaaggctgtgaagctggagcccgagctggtggaagcctggaaccagctgggtgaggtgtactggaaaaaaggggatgttgcagctgcccacacctgcttctcaggagccctcacccattgcaggaacaaagtctccttgcaaaacctgtcaatggtgcttcgtcagctgcggactgacactgaagatgaacattctcaccatgtcatggacagtgtcgacagctaagttggctgttcagatggatgtccatgatggccgctcctggtatattcttgggaattcatatctttccctttacttctctactggccagaaccctaagatctcccagcaagccctcagtgcctatgcccaagcagagaaagttgacagaaaagcgtctagcaatcctgaccttcatctgaacagggcgacgttgcataaatatgaagagagttatggggaggccctgggaggntttctctcgggctgcagctgnggaccctgcctgggccagagccccggcaacgagagcaacaacttctgggattcctgggatagattaaccagcctccttgagagtaaggggaaaggtgaagaccaaaaagctgcagagctgntggggaagtttgcgccna

SEQ ID NO: 9880 - DNA, 379 bp, Homo sapiens; identical to SEQ ID NO: 9498

SEQ ID NO: 9881 - DNA, 389 bp, Homo sapiens; identical to SEQ ID NO: 9499
  misc_feature 374: n = A,T,C or G

SEQ ID NO: 9882 - DNA, 1220 bp, Homo sapiens
  misc_feature 897, 928, 1149, 1150, 1153: n = A,T,C or G
gtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggayctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaascatcgagcaggctgacctactgcaagaggaggatgagtcgccacggagttgctggaggagatgggtttggcatagccctgctggccggggtgtggcgatggggtcctggcagcgtggcgggaacggctgcttctcctctgcccagggccctgttcttggtgggactcggctgcccctcctctgctgcctcacctttcggagtgagctgtgggctcaggcccttcaaacattccctccctccaccccctacctccactttccccttttcccactgaaggttttagaagctaggaggcaggaaaatgtgacccagatgggggtgctatttggcttttattccctgcctttgcagaactgatgtcaccycagatgtccttccctccctaataactgtaaatatataaatatgtcaggttaaagggaaaaggtgttcagggcacttcttgtcctctctgtcccataacctanctccacctccaccctccccctagccagccangcagcttctctgcctgggaggggagcctggacccccctctttctccttggctgcagtggggcctttatccagtgccagggaggaacaacatagttaatttttttctaaccttgccactttgagggaaggaagggttgggggaagggcaagctttatgggaccctggtcctgccctggcctttcactccagttctgggtgaggcaggagctgggaggggtgnngangsgggagggggaagtgtctgcctttatgtcctttcttctgaaataaaaggaaaagcatttctggaaa

SEQ ID NO: 9883 - DNA, 410 bp, Homo sapiens; identical to SEQ ID NO: 9652
  misc_feature 406: n = A,T,C or G

SEQ ID NO: 9884 - DNA, 591 bp, Homo sapiens
  misc_feature 420: n = A,T,C or G
atcagaagaggtcagttaaatattcacccaggccctgggggctctcttacagctgttctggcagatattgaagtaatatggtctcatgcgatacaaaaatacttggaaatcccactgaaagatttaaagtattatagatgtatcttgttaattcctgatatctataataagcagcatgtgaaagaactagtgaatatgatactaatgaagatgggtttttcagggattgtggtccatcaggagtctgtgtgtgccacctatggaagtggcttaagcagcacgtgtattgtagacgttggggaccagaagacaagtgtatgctgtgtggaggatggggtgtctcatcggaatactcggctttgtctggcatacggaggatctgatgtgtcaagatgtttttactggctaatgcagcgagcntgggttcccttacagagaatgccagttaacaaataaaatggattgtcttcttctgcaacaccttaaagaaactttttgtcatttagatcaaggacatctctgggcttcaggaccatgagtttcagattccgacatcctgattctcctgccctgctttaccagtttccgaaa

SEQ ID NO: 9885 - DNA, 400 bp, Homo sapiens
attcaagacgcaagagagcctggtgtgtgaagcgttggcagtagttcagcctggctagagagtacaaggggagaggggatgtactgggaatggtaaacagaggccagataataaagggyctgycttctctgtctcaargataggaacctcctccyctgaatgtattaataagtagtgaacccccctwttttwagtagagggccagcgatgtccatccgtattggccgtttccagaaagtttgccttaggctgtgatgtggaaaatggatttggggagagcaaaactaaagtcaggaaactgctaagataatccaattcagtggattcagtaatatttaaatattgcattcaaatattcagtgagtatcttctgtatgccagacacttttctaggccctgg

SEQ ID NO: 9886 - DNA, 645 bp, Homo sapiens
  misc_feature 11, 29, 32, 34, 609, 625: n = A,T,C or G
gaaaaaaaaanttttgaaacccctttggnacncnttaatacaagctacttggtctttttgcaggatcccatcgattcgcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacggaagtcattccccaactcctagcaagtttgactggaatatatncatgtccacagtaganttttcaaggaattcatttga

SEQ ID NO: 9887 - DNA, 418 bp, Homo sapiens; identical to SEQ ID NO: 9671
  misc_feature 151, 154, 161, 172, 178, 181, 185, 197, 201, 204, 206, 218,225, 228, 271, 281, 289, 320, 327, 341, 349, 358, 364, 382,384, 409: n = A,T,C or G

SEQ ID NO: 9888 - DNA, 820 bp, Homo sapiens
  misc_feature 730, 789, 808: n = A,T,C or G
tctagaatacaagctacttgttctttttgcaggatcccatcgattcgcacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcataagtatarkttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttaggaacaatttccagcacatagttnaatatccgggggattctgggtactgttatgtgtggggtgagctgacctgggatgttggntgtttttcctctcttcttngctggacccctc

SEQ ID NO: 9889 - DNA, 600 bp, Homo sapiens
gaccacctgattgcctcctcgtgctagaccttgaaccagaggcactccgctaagctttctgacccacagaaactatgagatcataaatggattgttttaagccactaaagatttgaagtaatttgtcatgcagcataggtaactaatacagtagtgtacttatttgccaaagtaataatttttaaaggaatacagcaaaatataagactccatcataatctggcatgcaatamwaaattcgcgrcyrgwcgamtgaagaagcaggaaaatgtcacctataaccaggggaaaaatcagtcaatagatgcagacctagaacggatagaaatgataggattagcatgcagcaatgtaaatatgatctctgcttaaagtatgtgaagggaagcatgcmcagatgaagaragaartgaaagatatgaaaaagaatagaggaggccaggtatggtgactcacgcctgtaatcccagcactttgggaggccgaggcaggtggatcacctgaggtcaggagttcgagaccagcctggccagcatgcgaacgccatctctactaaaactacaaaaaaattggccaggcacggtggtgtgtgcctgtagt

SEQ ID NO: 9890 - DNA, 694 bp, Homo sapiens
agaaatatagtaaacataaatttgcaacaattttaaagctccagtttttaggtgactcaaagaaagtcattatgcctattaatagttatttgatgccatcaccaaaagtctatgtgaaaatctcctaaagtcaaaacccctgcctttggttttacagacggttattaccattgggtggagctgcaaggtcaaatttctcctaagttcccctatttagaggaaaagtcactggttattgtaataaaccacccatggttctttatgtacattttgataacacattattatagcttsattttaattttttgcattaatttttgaaatccacatacatctcatttgtttaaattaaggccatgcacaaatattttttttagttcagtgctgaccattaaaaactatcatgcttgatacggtgcaaaagttaaaatgagtatcactaaaaatgccttctttttatgtggtgcaatatgaaatacaccaagactgtgtcttgacattctgatggacccaggtaaagttgttaaaagaacgaataaaactttattaaaataatttagacacctgtgtaccagcaacaattgatttaatagacctatagtgtctatactatcccttagaataaaggtttatgattttcctgatactaagatgcagtcacataatcttttgtgcatattcctatacaaattat

SEQ ID NO: 9891 - DNA, 672 bp, Homo sapiens
gaaaaatgagtaggagatgactgagagcttaaagtttgggagtgtcaattaactcagcattcttttaaaaaacgtgtcatatattacagcattttcttttatttgaagtgagtaaatgtatctttttaaattccttagtaatttttgagcactccatatgtataaagcatgtgaatatttggtagcattttacaaatktccagagatttktgagarttcctgagatcttcataggggscccacaaagtttagtattacttttcacggtaattactaaagtgtattttgcctctttttactttttctcttaatagcatacagtggtaactgaaggctaatagtatgtgtgkttatgtgctttaaaaagttcgtggtyttggccaggcgcagtggctcagacctgtaatcccagcactttgggaggctgaggcaggtggatcacctgaggtcaggagttcaagaccaaaaccagcctggccaacatggtgaaaccccatctctactaaaaatacaaaaattagccaggcatggtagtgggtgcctgtagtctcagctactcgagatgctgaggcaggagaatcacttgaagctgggaggtggaggttgcagtgagccaaaatctcgccattacactccagcctgggggacaagagcaagactccatctcaaaaa

SEQ ID NO: 9892 - DNA, 396 bp, Homo sapiens; identical to SEQ ID NO: 9712
  misc_feature 361: n = A,T,C or G

SEQ ID NO: 9893 - DNA, 782 bp, Homo sapiens
  misc_feature 8, 9, 28, 32, 44, 45, 48: n = A,T,C or G
actccttnnacaagccacttgctctctntgcnggatcccatcgnntcnaattcggcacgaggtgacatgctgtattggctactccataaagtaggagtatagatggaatggagaaagaagcaacctctgagattccagtggkgyrygrgggcaagatctgatggaaactgamaaagagaacgaagactamacaaagagaaaggaaagagaagaaaccctaaatgggcaaaggaaagcacatcctgtttgcggagctttgaaatattggaaccatttctaattgctcctgtttttctgggtaacaccagttttctgtagttgccactaaagcagtagactcttgagtctcacttgtctctgagagagacagaagttagaaagttttgacttggcgattccgaaagtatgcctttgttggcacttaaatgtccagtgagacttcttggcaccttagagccctctgagatactgrttattttaggttcttctccctactttcagatgttttcagcccaacactgggtgctctcttccactacagagaatcctgaagaaaagggaaggtgtttcccatgatggtgaatgtcactgccatgaattcctgaatctacctgctgctgggagtcagagtccaagcataacccgtgtagcataaaagcagcgctgtagccctattccagtctttttcgttaatgtccagagtgaacaacaagagttagtcaatcattaactgttgactgttgattctcataataaatgcagcataacgacaaaaaaaaaaa

SEQ ID NO: 9894 - DNA, 688 bp, Homo sapiens
aattcggcacgaggtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgaatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccagggaggtggtataacagacagaaatctacaaaggrtccttgagggttcaggtgctacagaattccacttgttctgctcggtctactaggagactcsgggaattgaagtttycgaaattcatcttgtttgccmtggggagccycacttttctttgctycaggaatwttccccttatt

SEQ ID NO: 9895 - DNA, 457 bp, Homo sapiens
  misc_feature 432, 441, 454: n = A,T,C or G
gagagacttcttcctgcatccttacatggtggaagacaaaagagtggcagagaatgaatatactcccagtccattcgagagggaagagccctcacctcatcacttccctgaggcctcaccttctaatactatcaccttggtgataagatttcaacataggaattagaggggaatacatacatccagactattgcagatgggattatgtaatactttgttcctgtttggcttatttcttagcacaatatctttctggtatgtgcatgtttctgcaaatggcaagattttcttcctttttaaggctgagtaataattcattgcatgtatagaccacattttctttatgcattcattattagtgagagttcttattacaaatgggcgaagtggtttttaatattgatttaatttttgttattaaaaacgtttttngagtggttnggttccttttttngga

SEQ ID NO: 9896 - DNA, 664 bp, Homo sapiens
tttagtaataagactttcagtatttttaatgttgacatttccagatgtttcatttagtatccaggggtctgtctggagacttctagagagggacagctcagaagtgagacccttgagctctggtgctgtaagcttgtgcaattaagttgaacagagcctgggaatttctttcctctgcacagtcccttgatatttggaatccaggttctgcccccaacccctacccacccagtggtctgttaagatgtctcagatggggctgggcttggtggctcatgcctgtactctcaacactttgggaagcaaaggcaggcagatcacaaggtcaggagttcagcctaaccaacatggtgaaaccgtgtctctactaaaaatacaaaaattagccaggcgtggtggtgcacacctgtaatcccagcactttgggaggccgaggcagacgggtcacttgaggccaggagttcgagaccagcctgggcaatactggcggactccgtctctactacaaatacaaaagttagcctggcatggtggcgcatgcctgtaatctcagttactcaggaggctgaggcaggagcatcacttcaacccaggaggcagaagctgcagtcagccgaggtggcaccactgcacttcagcctgggcaagactggagactgcctca

SEQ ID NO: 9897 - DNA, 443 bp, Homo sapiens
gtaccttcaaaaggacacaatgtaacagggttagggaaacagaagtccgcagggcctccctaatgtctttggagcttaaaccccttgtatatttgccccttttcaataaacgccccacgctgatagcacagaggagcccggcatgcactgtatgggaaagcagtccaccttgttacagttttaaatttcttgctatcttagcattcagataccaatggcttgctaaaagaaaaaaagaaatgtaatgtctttttattctcaggtcaatcgctcacactttgttttcagaatcattgktttatatattattgttttttcagtttttttttttttttttgttccagaaagattttttgttttgttaacttaaaaatgggcagaaagtattcaagaaaaacaatgtgaactgctttagctttctggggatttttaaggatagcttt

SEQ ID NO: 9898 - DNA, 607 bp, Homo sapiens
  misc_feature 567: n = A,T,C or G
gagctatggcggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctkscccaaccattatgaggattatgtacacagagcagggcggactggaagagcaggaaacaagggttatgcttatacttttatcacagaggatcaagctcgctatgctggtgacataattaargctcttgaattgtcagggrctgcagtacctcctgatttagagaaactgtggngtgatttcaaagttccagcagaaagcttagggggaaataa

SEQ ID NO: 9899 - DNA, 1139 bp, Homo sapiens
  misc_feature 602, 691: n = A,T,C or G
gtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtyttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggcttttttcccctcaactctggagccccatccccaccctccttggggggctcagcttggctcagatctgatgcttcaagaggctgtaacctcagagggcaccaaggagggtggcagagcctgyttagccaggaggccgaggtccctcagtcctcccctgtcccttccaaggtgggtcaggaggttctggccccgctggggcaggcagggcagggtctgtnaagcttaagagcagatggtgacaagttctctgggcaggtggccatggggaggggccatggcttggcatgtccaacagaaatagtttttnctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatct

SEQ ID NO: 9900 - DNA, 419 bp, Homo sapiens
attccagataaagggagtagccagtgtaaaggtcttaagttaggaacaagcttggtatattaaagaataagcaaggaagccagtgtggttgaggagagagcaacagaagatgaggtcgagtaagtaatattggtgccttgtaggctctaattaggaattgggcggctggaagtggtggttcaggcctgtaatcccagcacttctgggaggccgaggtgggcggwtcacgaggtcaagagttcgagaccagcctgaccaacatagtgaaacgccatctctactaaaaatacaaaaattaactgggcatagtggtgcgtgcctgtaatcccagctacttgggaggctggggcaggagaatcgcttgaacccaggaggcagatgctgcagtgagccgagawtacaccactgcattccagcct

SEQ ID NO: 9901 - DNA, 745 bp, Homo sapiens
gagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaamtggcatycargcactgggcccgtgcagagaaggcacctgcagagagcagggcagcccgkcgcaggggcatgcgcctagawycccagctactcgraaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccsagaccagccttttacctcggggttttgagkccaacagggacgacagagacagtttctagttagagccttggctccatttttggatgatttagccccgagttcctgagtctattttaygccccttacgtactttgatagaactaaggaaatagtggttttragtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgtaaaaa

SEQ ID NO: 9902 - DNA, 409 bp, Homo sapiens; identical to SEQ ID NO: 9311

SEQ ID NO: 9903 - DNA, 576 bp, Homo sapiens
  misc_feature 515, 544: n = A,T,C or G
aattcggcacgaggcgagggcctggacgtagtgtcttcaacagttgtaacagcagctgccatttgctgaatgacagcatgtgtcacacactctgctgagtattacaggcatttttttctaatacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccacnaagaaaactcacttgggcgaacaggctgngaaagattccagctgaaggagagccccatttt

SEQ ID NO: 9904 - DNA, 610 bp, Homo sapiens
  misc_feature 610: n = A,T,C or G
aattcggcacgaggaactatctagtagctggttccctccgaagtttccctcaggatagctgggacagcagctgctgctgtggaaaggccagctggcaagatgatggaagaaatctccattatggtagcctatgacgcccatgtwkwcagmmaggmtrcasgrwgargamwtscymaswagwctgrtggccatcagcargcctgcarkwytawrgtaccaaccaagaagctgaagaaatatgagaaagaatatccagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacaaaaaan

SEQ ID NO: 9905 - DNA, 837 bp, Homo sapiens
  misc_feature 796: n = A,T,C or G
aaaaaattcatactggagagaaaccctatgagaaccctaaccctaacgcttcagttgtcccagttctttcatgagcatgaaaggagtcacatagagaaaccccatgaaagtaagaaatttgggaaagccttcagtcctttctgtttctttcaactacgtgaaaggattcacagtggagaaagaccctgtaagataattggctttaaattacgagagacttgtgataggacagtaaaacctagagttggagttggatctctggattgtgttatgtcagtgttggtaggttaggaactagatttcccagaatccattccatttgtgattccatgatacaattcaccagtaacctatcttacatgagattcggaagtaagttaaagaaggcattagtcatggkttggaagcaccatacagggagacagctgtgtgaatacaggctgtatggacacttgcttccatcccattttcctgcttctttgggttgccaatcaagagtatcctcaaaacgacttgactttaattttctcggaggtgataggcttccacacaggtctccagaagccctgcattgaatatccatccacactttggttttccttcagacattattatgtctgtactaggcaactaattcagactgtcctggtkgggaatattctgtgatgctctgactcccctagtctgtagacggaattggcatacggtctaatttgtgtagtaagcacctttgttcatactagtagtgactgtattctygaktcagcctgatagctaccatgctgcctgtcaaaanccaaccaagaggggagccttggtaccttcctgctggaagtc

SEQ ID NO: 9906 - DNA, 850 bp, Homo sapiens
gcaagacccaccaggtgccagctgcccctgccccttgcccatgccctgtgtgtgggcggcccctggccaaccagggctccctgcggaaccatatgaggctccatacaggagaaaagcctttcctgtgcccgcactgtggccgggcgtttcgtcagcggggcaacctgcgtgggcatttgcggctccacaccgagggagcgtccttaccgctgcccacactgtgccgatgccttcccccagctgcctgaactgcggcgccatctcatctcacacaccggggaggcccacttgtgcccggtgtgtggcaaggccctccgagacccacacacgctccgagctcacgagcgcctgcactccggaragaggccctttccctgtccccartgtggccgtgcttacacgctggccaccaagctgcggcgccacctcaaatctcacttggaggacaagccctaccgctgccccacctgtggcatgggctacaccctcccgcagagcctcaggcggcatcagctcagtcaccggcctgaggcaccctgcagcccaccctctgtgccttctgctgcttctgagcccactgtggtgctcctgcaggctgagccacaactgctggacacacacagagaggaggaagtctcccccgccagggatgttgttgaggtcaccatttcagaaagccaggagaagtgctttgtggtgccagaggagccagatgccgcccccagcctggtgctaatccataaggacatgggcctcggcgcctgggcagaggtggtggaggtggagatgggcacctgacagctttgccttttgctgacacagctccataaagactcgtgctttctcaaaa

SEQ ID NO: 9907 - DNA, 546 bp, Homo sapiens
  misc_feature 474, 535: n = A,T,C or G
gcaggctcttatactatcttgcacaggctggtctcgaactcctgggctcaagcagtcatcctgcctcagccttccaaagctcagggatwrcagacrtgagccacagcaccaggccaacaatatttcttaaagctcctggagtgattccaatatgcagccaaggttgaaaacyaccctttaaaaggctcggcatccagtgtggaagaccagcacwcwcacrtcmggagaccttaccyggagccaggmtgcccctgatcatctctgataactttaaaaggaaggcctcagaagcagccccagaagcaaaagtttctctctgaccttctcctgccctcttgtytctggcttttcattctcccccaaggctacccataggaaactaggaatccctcttccccaagggcaggtcattcaggaaaccaggaaccggtttttacccaaagccaggccataaaaacctaaaattagttcctnttcattcccctttcccttttttgtgttaaaaattggkttgggaaaggaatggttttgaacntacctgttttt

SEQ ID NO: 9908 - DNA, 432 bp, Homo sapiens; identical to SEQ ID NO: 9333

SEQ ID NO: 9909 - DNA, 681 bp, Homo sapiens
  misc_feature 6, 12, 13, 14, 15, 16, 681: n = A,T,C or G
ttgaancccttnnnnntttgaaaccctttaatacaagctacttgttctttttgcaggatcccatcgattcgaattcggcacgaggaactatctagtagctggttccctccgaagtttccctcaggatagctgggacagcagctgctgctgtggaaaggccagctggcaagatgatggaagaaatctccattatggtagcctatgacgcccatgtwkwcagmmaggmtrcasgrwgargamwtscymaswagwctgrtggccatcagcargcctgcarkwytawrgtaccaaccaagaagctgaagaaatatgagaaagaatatccagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacaaaaaan

SEQ ID NO: 9910 - DNA, 414 bp, Homo sapiens; identical to SEQ ID NO: 9346
  misc_feature 210, 219, 221, 222, 229, 230, 231, 232, 255, 261, 264, 266,288, 308, 322, 333, 346, 356, 358, 365, 366, 368, 369, 377,380, 384, 387, 388, 391, 393, 394, 398, 407, 408, 410: n = A,T,C or G

SEQ ID NO: 9911 - DNA, 423 bp, Homo sapiens; identical to SEQ ID NO: 9355

SEQ ID NO: 9912 - DNA, 1586 bp, Homo sapiens
  misc_feature 1586: n = A,T,C or G
ccgctgctcacacctttctactgaagcatcctgatgacgaaatgatgaagaggaacatggcatattataagagcctgcctggtgccgaggactacattaaagacctggaaaccaagtcatatgaaagcctgttcatccgagcagtgcgggcatacaacggtgagaactggagaacatccatcacagacatggagctggcccttcccgacttcttcaaagccttttacgagtgtctcgcagcctgcrrgggttccagggagatcaaggacttcaaggatttctacctttccatagcagatcattatgtagaagttctggaatgcaaaatacagtgtgaagagaacctcaccccagttataggaggctatccggktgagaaatttgtggctaccatgtatcattacttgcagtttgcctattataagttgaacgacctgaagaatgcagccccctgtgcagtcagctatctgctctttgatcagaatgacaaggtcatgcagcagaacctggtgtattaccagtaccacagggacacktggggcctctcrgatgagcacttccagcccagacctgaagcagttcagttctttaatgtgaccacactccagaaggagctgtatgactttgctaaggaaaatataatggatgatgatgagggagaagttgtggaatatgtggatgacctcttggaactggaggagaccagctagcccacagcaaccaaagagacttcctcttggcgttcaggaaacacagattctttgtccttttcccaacagcccaggctgttgatacctcagagccttctctttactctccaaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgtcttccccatgttcatagctgcctttcttaccattttggtttgaagggcagtcttctctggcttgtttttttgtttttcccagaaaatcagtattattttttaaataagaaaaacattcctagaagatgataattgtgaaaacctcctttggcttatttgcttttccaggattttaagtctcctttctccccaatccgggaaaagatgggtggaagacataaggctaaaattttctccaggccttcacaatgggtcctttcactttgggtctggactttgtaaccaatn

SEQ ID NO: 9913 - DNA, 643 bp, Homo sapiens
  misc_feature 132, 134, 139, 557: n = A,T,C or G
aattcggcacgaggccacagccgggtcacgtggccggttgccccccatgacttgctggctgcggggcagtcacggtgacgttcggtccgacctgccgagtggccaggctacctcagtcacctgtgtggtccnantgctngcatcggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccaragatggaaaaccctctgctcgcatgttgctgctgaagggcttcgggaaagatggcttmcgcttcttcactaacttcgagagtcgaaaaggaaaagagctggactctaatccctttgcttcccttgtcttctactgggagccacttaaccgtcagtgcggtgtggaaggcctgtgaagaaactgcctgaggaggaggctgaagttgctactttccacttccccggccccaagaagcaagccaaganttgggggcttgttggttcaagccaaccagaagtttctggtgaattccctggattcggggaagtatctgaagaaaagaaaaaatggh

SEQ ID NO: 9914 - DNA, 675 bp, Homo sapiens
  misc_feature 495, 582, 620, 629, 635, 649: n = A,T,C or G
gcggccggcggggtgctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaarccagaactgatcatctgtctggaggcaaggraagagccctgggaacgtgaacacagagaagacagccaaacactcagagtctcagctctgtcacccagggttgggaatgcaatgggtgcgatcttcggcttcactggcaaactggcgtcccgggtttcagggtcatttctcctgncctcagcctcctgaggtagcttgaggattacagttttgtcttcttatctttacttgaaggacattttgcccagagcagggggccttncaagtttttcattttcccaaaaagttgatgctttaggnagggttttngaaagngtttgttcttttanggaattacggctttagggggattact

SEQ ID NO: 9915 - DNA, 348 bp, Homo sapiens; identical to SEQ ID NO: 9803

SEQ ID NO: 9916 - DNA, 403 bp, Homo sapiens; identical to SEQ ID NO: 9807
  misc_feature 371: n = A,T,C or G

SEQ ID NO: 9917 - DNA, 421 bp, Homo sapiens; identical to SEQ ID NO: 9812
  misc_feature 408: n = A,T,C or G

SEQ ID NO: 9918 - DNA, 3529 bp, Homo sapiens
aagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaatkrcaygargaaacctctaggtccaccacctccatcttacacgtgtttccgttgtggtaaacctggacattatattaagaattgcccaacaaatggggataaaaactttgaatctggtcctaggattaaaaagagcactggaattcccagaagttttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagaggaaaagaaaaagtccaagctagatgagtttacaaatgattttgctaaggaattgatggaatacaaaaagattcaaaaggagcgtaggcgctcattttccaggtctaaatctccctatagtggttcttcgtattcaagaagttcatatacttattctaaatcaagatctgggtcaacacgttcacgctcttattctcgatcattcagccgctcacattctcgttcctattcacggtcacctccataccccagaagaggcagaggcaagagccgcaattaccgttcacgtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacascctagaccctcagcaaatagagagaacttttctccagagagatttttgccacttwacatcmggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggrtaggacccctgaaaaggacaaatttctttaagtgcgccaccaaaaaaatcaaactcaacagagaaactgggaagaaaattggaagtacagaaaatatatcaaacacaaaagaaccctctgaaaaattggagtcaacatctagcaaagttaaaaaaaaaaaaaaaagtcgagc

SEQ ID NO: 9919 - DNA, 401 bp, Homo sapiens; identical to SEQ ID NO: 9818

SEQ ID NO: 9920 - DNA, 415 bp, Homo sapiens
ttcgaattcggcacgagatttcatagatggagaaactgatcacagagctgtaatgaagacagaattgagatatgagggcaaaagctaattaaacgcatcctcacaggtagcctttctttcagtgaacctgtagactagtccagtaatacttattaaaattagttgttagaggctgggcatggtggttcaagcctgtaatctcagcactgtgggaggccaaggcggacagatcactcagagtcagaagttcgagaccagcttggccaacatggcaaaaccctgtctctactaaaaatacaaaaattagttgggtgtggtggcacatgcctgtaatcccagccactcgggaggtgaaggcacaagaattggttgaacctgggaagcagaggttgcagtgagctgagattgcactgct

SEQ ID NO: 9921 - DNA, 225 bp, Homo sapiens
  misc_feature 24, 26, 28: n = A,T,C or G
ggcacgagctctctctctctctcncncnaactctctgtctctctctctctctaggctctctctctctctctctctatctatctctcagactatgtgtgagtgtgagagagagagagagagagagagagagagagagagagagaaagacagagagagacaggatgaatagtataaaagagggggggctagagaaagagagaaggaaaaaagagagaaaaaaaaagc

SEQ ID NO: 9922 - DNA, 437 bp, Homo sapiens
ggcacgagagagactgtggctcatgcttgtgatccccctgccttggcctcccaaagttctgggattacaggggtgaaccactgtgcctggcccatttttctttataaatattgcaacataatgttttatagacaaacattcaagggtactttggctttatgaacttcaggatttctggtgctagaaaagcgcttgaagcagtatcaccaagattttagatattaaaaagtctggtgtaccagacattgagtcataatcatctatattcaagggatactttcattgataactttggtattatgctgcccttcacagaagacaacgtctcgggcaggatcacatgctccctagcagatgctgatcagtgatgtcatagaaattacatgaatgcatttgctttaaatagcagttaaccattgtatatggggcgttttgct

SEQ ID NO: 9923 - DNA, 360 bp, Homo sapiens
ggcacgaggcctggcatggtggcacatgcccataattccagctactcgggaggctaaggcaggagaatcgcttgaacctgacggggtggaggttgcagtgagccgagatcgcaccacttcactccagcctgggcgaaagagcgaaactccatctcaaaaaaaaaaaagggaaggggaaaaaaaaccggaaaagatttggttggggaacttttaggaggggtggggcccttggggcccttaactaaccccagggaatcctttaaagggaaagggggggaagggttgtcaaaccccggggggtcatggtaaaaaaagggttgggttcccttaattctttccccaattttcaaaacccataaa

SEQ ID NO: 9924 - DNA, 600 bp, Homo sapiens
  misc_feature 462, 463, 464, 465, 466, 467, 468, 469, 470, 471, 473, 475,573: n = A,T,C or G
tacggctgcgagaagacgacagaagggtggctaacacggtgaaaccccgtctgtactaaaaatacaaaaagttagccgggcgtggtggcgggcgcctgtagtctcagctacttgggaggctgaggcagaggcaggagaatggtgtgaacctgggagacggaggttgtggtgagccgagatcaggccactgcactccagcctgggtaacagagcaagactccgtctcaaaaaaaaaaaaaaaaaaaaaaaaaggggggggggtttttttccgtaacccccaccttgaaaaaaccctttgggggttggggcccccccccccttaaggggggggaaaaaaaggttttttttgggaaaattggggggctttttttttttttggaccccttttaaggcggaaaaacctgttaaccacaaatttggtttttttttttttttgtttgggggggggggggaggggttttnnnnnnnnnncnangaaagggggggccccaacacggtgtggttttaatcccccttagggcggcccctttttttttttgggggcgcgcggtgggggggaagaaaaaatggggnttttgtgttaccctgtactattttaac

SEQ ID NO: 9925 - DNA, 404 bp, Homo sapiens
attcggcacgaggagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagttttttttttttttttaaaaaaatatttttttttttgcgcgcacacacactctctctttttttttttttttttttacactccgcgcgcccgctttatatacacccacacatatatatatatatatatatatatatatgtgtatatatcttttttttacccccacccgccgggggcgcgcgcacgccctcccccccctctgtctctattt

SEQ ID NO: 9926 - DNA, 358 bp, Homo sapiens
tacggctgcgagaagacgacagaaggggctggtaatttttgtatttttagtagagactgggtttcaccatgttggccaggctggtcttgaactccaggcctcgagtaatccacccaccttggcctcccaaagtgttgcgattagaggcatgagccaccgtgctcaggcttcccacaataatttttactttgacacatacagacttcaatatcacattcgtatgcaccacgctatatgggagaatatctgtcaagactcatgagttgttatgtatagagtgcttaaattgtggacatataaaataatatttctatccagatgcagtggctcacgcctgtaatcccagcactttgggagg

SEQ ID NO: 9927 - DNA, 403 bp, Homo sapiens
  misc_feature 207: n = A,T,C or G
ggcaccaggagagagagagagagagagagagagagagagagagagagagagagagagagagagagagagagagagagagagagagagcgcccccctgggagagagatatatctctcttaggggggagcgataccccttcacccagtgtctctgttagagagattttttttttctttatttctctcacagggggggagatatatacanatctttttatggaggcgcgctcattttcccctctgtgagaaactctatttttttttccccctctttctgtgcacacacacacaggttttgtggggggggcccccatacccccacaccccctctatttatgtgggccgccccccacactataataaaaaaaattttgggcccccccccaaatatctttttttttcct

SEQ ID NO: 9928 - DNA, 390 bp, Homo sapiens
cgttgctgtcggggggctgatcccccctcccccctcccggacggggcggctggccggccggggggctgaccacttcccacaccctgcgggagggggagggaggggctcctaaactcttataacttgcgagagggagggggaggggtacctaggttctcctaacttgtgacacggcgcagacgccacgcatatggcatactcggttctgagacggcggaggcgctcataaactctcctactgtgccagaggggggaggggccgcccacatgcgctactaacatccgacactgtgtagggggatacaggcgctctccgaatcatagacgagggggggccgatctctacttaaatgcagacatgaaaatactctttttgtgaaattcgcgaac

SEQ ID NO: 9929 - DNA, 371 bp, Homo sapiens
cgttgctgtcggtcaccagggaccttgcctgagaatattttccggtggtatttcttggttgaggtcccacacggtgcactgaaaagtgtgatgattcttgcgaatggtgaatcttatgtttaggatatgaacagaaacggcatgttctttttttatgttattttttaaatttatttttatttcaacaagtttttggcgaacaggtggtgtttggttacatgaataagctctttagaggtgatgtctgagaggtgggtgctcccatcacccaagtagtgtacacagtacccaatgtgtagtcttttatccctcactcctctcctaccctttcccccgagtctccaaagtccattgtgtcattcttatgccgg

SEQ ID NO: 9930 - DNA, 428 bp, Homo sapiens
  misc_feature 389, 428: n = A,T,C or G
gaattcggcacgaggagagagagagagagagagagagagagagagagagagagagagagagagagagagagagagagagagagagagagagagagagagagagagagagagagagagagagacaaaaacacagcgcgccgcccgatctctatattgtgtgtctccacacatcagggggggggagagacacacacacacacgagatatgtgtgtgtgtgtgtctctatcatgtatctctctcacacagagagagctctctctgtggtgtgagagaaagacacaggggtgtctctcttttcgcgcgcgggagagacacatatattctgacgcgcgtgcgctgtgtatatatatcttcgcgccacaggcgcgcccacagagagaaaaacctntactcacaaaccacctttggggtgaggtggttttaaaan

SEQ ID NO: 9931 - DNA, 437 bp, Homo sapiens
  misc_feature 31, 32, 33, 34, 35, 175, 202: n = A,T,C or G
aaaacacgtctcttgttcttttatgaggctnnnnnacattcgctcgaactcctgaccttgtgatccacccacctcagcctccaaaagtgctaggattacaggcatgagccaccgcgcctggcctgtctaatcttttatttaatgcatctaggctcctcctttcttccttcatggnttcctttttcctacttccctatctcgntttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgttttctgagaataagtaggtcagaaggtacaggagaaactttcttggaatacacaaaaggaac

SEQ ID NO: 9932 - DNA, 389 bp, Homo sapiens
tacggttgcgagaagacgacagaagggcttcttcatttttgaattgagagtaataatattctgccttgttggaataatataagaatgatatgatgatacctttttacataatacctaccaaatatcaggtgctgaaaaaaatttggctcctgtttctttccatgtctgtcacgaacgcagaagctagatatttgtcctaacacattaagtggaaaggtaaatgaaacttatctgctttcctctagccctttcttttcagtcaggcaatgctgattatgactagataattttaagatgtgagtatattcattgaatctcagctgtgtaaactatataacaagtatgtgaaggcaaaatggagccgatccttttgataacctgatttatag

SEQ ID NO: 9933 - DNA, 428 bp, Homo sapiens
ggcacgagactttccactgtaatccaaccacctaagtttatcaggtgcttcactgaggaagcctagttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttaatgaatataatggtaaactttagaggacgctaaagcctccttttatagcgcttctcaacggtagggagagctgaagggaaaacattctgactg

SEQ ID NO: 9934 - DNA, 368 bp, Homo sapiens
cgttgctgtcggccatctcaaaaggaaacaagttctgctagtgatgctttcatttgatcaggggagagttagaagccagccacccaattagtgacttgcacaaaacccagtgaattaagtacacttgacaaataccaaatgacacatttttgtgccagaccagagcaaggagaaggctgttctgacccaacagaaagggctccccagggcagtgttttcctaacttccctgtgaatgggaattgcctgggacattgttaaaacacagcttcccagacccctctcttggggctcttgatttagtgcttctgggatgggcccaggaatttgtatttttagcaagcatctcaggtgattcttacaagaaat

SEQ ID NO: 9935 - DNA, 400 bp, Homo sapiens
  misc_feature 338: n = A,T,C or G
ggcacgaggagagagagagagagagagattgagagatagagagagagagagagagagagagagagagagagagagagagagagagagagagagagagagagagagagagagagagagagagagagagagagagagagagagagagagagagagagagagagagagagagagagagagagccaccccctctctcccccttttttttttttttttttttcccccctcttttttttttctttttttttttttctaaaaagcaagtggcctggggccggccccccccccccccccaccaaaactttatttttttcttttttttgttgaagatgagtgggggngaaacaagcccttccccttctttcccccccttttttttttctgtggttctcttctccccccg

SEQ ID NO: 9936 - DNA, 429 bp, Homo sapiens
ggcacgaggagagagcgagagagagagagagagagttagagagagagagagagagagagagagagagagagagagagagagagagagagagagagagagagagagagagattttttttttttttctctctatacacgcgcccccgcgcgcgcgtgtgtggggggggacccccataactcactctatactctctctctctctgcgcccccgtgaccgaccacacgcgggggggtgcggagcgcgcgctctctccccccccctctgttttttttttttttttttgttcccccacaccacacatacacacactctctctctcccgcccctcctccctgagatcgagcgcattgatctctctgtgcgctctagagacactccctgggtctctcccccccccccccccccccccctctctgtgctcttatgtct

SEQ ID NO: 9937 - DNA, 408 bp, Homo sapiens
ggcacgagcccagaccaagctagtccttgcttcatcactccaagtagccctcctcagtctgagtccacccctgacattgctgttctggccttcagctgatcacagctagaaactgtcggtaacattagcactaagcgctaataaccattaaaacagatgaccatttaccaagcccctactctaagccaggcgtggttataagtgattcatttctgtatcacttaaagtcatttaatcctcatcctaagaaatgggttatagtataatccctagttggcagatcaggaaactgaggcacggaaaggtgtcataatttgcctaagtattggtgaagctgggattcaaaaccagaggctgtgctgagtcttatccgctggactgtagagcacacaggaggaaaagggcagt

SEQ ID NO: 9938 - DNA, 390 bp, Homo sapiens
  misc_feature 294: n = A,T,C or G
aattcggcacgaggtcccgtcggcctcactgttttccctgccgtttatctgttgaagagcctgggctgtttgtcccatggcttcccacagtgtagattttgctgaccacgtggtcatggtgtagttcagcatggtcctctatgtttcctgcacattggcagctgggtccagaggcttgatgagcctcaaatttgatccctttggcaggagaacaggcggttaggagctttcctcaggaaagtaccatgttgacggcagctgatgctcagtgccaagatccattaattatttggnggttgcaaaatgggggattctcattctggcgtttggcttgctttattagctggaatgggtttctaagaaagggtttcttttttatacttatctcgg

SEQ ID NO: 9939 - DNA, 402 bp, Homo sapiens
ggcacgaggagagagagagagagagagagagagagagagagagagagagagagagagagagagagagagagagagagagagagagagagagagagagagagagagagagagagagagagagagagagagagagagagtgtgcccacacacacacacgcgcgaactctctctctctgtgtgtgtggcagcgcgcacatttaaggcgcgcgcgctctctctctctcacagaggggggggggggcgccctgggggcccccaccctacaaaagagtttttttctcgctctatatatcgagagagagagattgtcccctacacggttgtgcgcgacagagagattttttttttaaaaatccccccacgggggcggggtgtgggggtgtatataactctcccctcttc

SEQ ID NO: 9940 - DNA, 391 bp, Homo sapiens
cgatgctgtcgctttcagtcacccttcttttcgtgagctcccctctggcaaaaagcaagtgcggagatgtcatccaagaacctagggcctagactcatggaccccaagaggggtctctatttgatgctttaccccactgtggccaaggtggtagcaagtgcatggcaggctgggcgcagtgtctcatgcctgtaatcccagcactttgggaggctgaggcgggcagatcacttgaggccaggagttagagaccagcctggccaacatggcgaaaccctgtctctactaaaaataaaaaaaattaggccgggagcggtggctcactcctgtaatcccaacactttgggaggccaaagtgtacggatcatgaggtcaggagtttgagatcacg

SEQ ID NO: 9941 - DNA, 400 bp, Homo sapiens
ggcacgagcttccattagtgccactcagttacaaattgctctttattataataccaatggtaccaagagaaaaaaaaaaagcagagcattatgtaagtttccttaaaaagacatgatcacctctcaaatttcatctctcctagggataataaataatgcactgcacaatacttaatgaccaaaataccttttgacacacctgtataacatgacttgaacttttttttttgctaccctatgttacaaaacagcttataaacctaggtatgacctttacctgggagggtaaacagtaggactaccacttgtcaaaagttttaaacacttgaccgggaacggggccggggtatccatcatttccatggtttcctatttcatcccccccatcaggggagtctac

SEQ ID NO: 9942 - DNA, 398 bp, Homo sapiens
  misc_feature 300: n = A,T,C or G
attcgaattcggcacgaggttgcttgggtggccgctaacaccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttccctgttcttaaattttggcttctcaatccctgttncctctcaacctaattgccagtccaacaactaagagtgaaagattccctagcatttcattaaatctattcctgattcaacaagtggcagaatcttgcat

SEQ ID NO: 9943 - DNA, 394 bp, Homo sapiens
ggcacgagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggatt

SEQ ID NO: 9944 - DNA, 388 bp, Homo sapiens
ggcacgagcgggcgtccaggctggagctcccagtgctgggaagccaagacctgagcgatatcccattgccggaaccatctttgcttctgctcacaccctcctggtcggccattcaatcaacaaactctagccagccccggctctgtgctaggcttgagctcagcccagcagggtgcagagcccatcctcaccaggccccaccctctcggtgccaaggcgggtgggtgcccgggggagaagatggatggacgacagttctgtgatgagatctgaaattcattacggggtgagatcagctccttaaatggggatttgaaaacattagggcttcattatgtacacaacggcagtgcctcattcatcatgcaaaaatcactcccgttattaa

SEQ ID NO: 9945 - DNA, 436 bp, Homo sapiens
  misc_feature 315: n = A,T,C or G
cgcacgaggagtggcatgcagggcccctgccatgggtgcgctcctcaccggagcaaagcagcatgataaggactgcagcgggggagctctggggagcagcttgtgtagacaagcgcgtgctcgctgagccctgcaaggcagaaatgacagtgcaaggaggaaatgcagggaaactcccgaggtccagagccccacctcctaacaccatggattcaaagtgctcagggaatttgcctctccttgccccattcctggccagtttcacaatctagctcgacagagcatgaggcccctgcctcttctgtcattggtcanaggtgggaagagagcctggaaaagaaccaggcctgggaaagaaccagaatgaggctgtgcagaaccagaacacctgcacttctgccaggccagggcagcatgacggcagactctaggaggg

SEQ ID NO: 9946 - DNA, 406 bp, Homo sapiens
cgaattcggcacgagggggcgcgggcgcccctgcactagtcggaaaaaaccgagaggtttctcttctcagggctgagtcaccagcacgcaggagaagagggcgaagcggccacccgcgttctgtgttcggagtcaggacgagaagcattgggtgggagcagggcgaggggctcgagttgggtctgcagcgggcacaggacctagttttgtacagttaacggtggggttgagtaaagaggggggcggtggggaggtgtaagctccctttattcctttcccagcggaccaggaggaagcttcgttgaattgagcgcccctggctcgtatagcaggccgaggagggagctcatgggcagcgttggctaagagttcgagatcatctagaaatgtcagagacgtaggttgg

SEQ ID NO: 9947 - DNA, 386 bp, Homo sapiens
  misc_feature 309: n = A,T,C or G
attcggcacgaggctttccgcaccttaaccccagtgagcgtgaaaaagaaagttaataaactataatacatggaagcaagaaagacactgcctcctctgagggaccttttcccaagcatgtaaacaagggggcccacagccctggctgcaggcatcatgacccatcttctaccaggcagatctttattacctgagcccctaaggcagtgtctcctcagctgggctgcttccactgagacccccgacccatcccctttccaagacacacacctgatgcatgtaagaatgtaaaagggcttttctcagaantgattaataattcagtgggctcttcggagtcgaatggcatttggggcaccacgaaggaaggaatcatcattggctaa

SEQ ID NO: 9948 - DNA, 384 bp, Homo sapiens
ggcacgagcaagactgaaggcaggccgcacccatttccacaatgggtgtctcccttcccccacagccttccagttgtgccctgggcaggactgcactctcaggttctcctatttccgaacgggtgccaactcctaccctaaccaactgacatctacttgttgctggaccagaacgtgcttctgctcactgtaaaatgcctcctgagactgggggggggctggctgtcagggaggccgccccgtcctggggggcacctcagggcaggtactgacttccatagccaggacctaggccgggaatcgggaagggatggccccggaagtgataaggcaggatttccaggcaggggaagtggcatttaggagaactggctatttaagggg

SEQ ID NO: 9949 - DNA, 435 bp, Homo sapiens
tcgcacgaggagagagagagagagagagagagagagagagagagagagagagagagagagagagagagagagagagagagagagagagagagagagagagagagagagagagagagagagagagagagagagagagagagagcgcgcgcgcgctcacacacactctcacgcgcacacactctctatatatatatacccacacaaaatatatatccacacactctcccccactatatatgtggttttatatacacacacatatatccccctctctgtgctctctctctgtgttttatagaaagctcttcttctttatttttcacggccgccccttttctttcagggagagaacacacaccctcactcttgtggcggggggggctttttttaatacccctccccccccaaaagagaaaaaatatctcttgttttttt

SEQ ID NO: 9950 - DNA, 361 bp, Homo sapiens
ggcacgagcaagactgaaggcaggccgcacccatttccacaatgggtgtctcccttcccccacagccttccagttgtgccctgggcaggactgcactctcaggttctcctatttccgaacgggtgccaactcctaccctaaccaactgacatctacttgttgctggaccagaacgtgcttctgctcactgtaaaatgcctcctgagactgggggggggctggctgtcagggaggccgccccgtcctggggggcacctcagggcaggtactgacttccatagccaggacctaggccgggaatcgggaagggatggccccggaagtgataaggcaggatttccaggcaggggaagtggcattt

SEQ ID NO: 9951 - DNA, 418 bp, Homo sapiens
  misc_feature 223, 224, 226, 227, 230: n = A,T,C or G
ttcgaattcggcacgaggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgnnannaangagaaattgtttaaagagttcttataacctgtctggagaaatgcgcatgggggatggactctgttaaggcaggcgtccctgattgtgagctatagctcatcccgagcagctgtgtctctatgctgtctgggcttttatgtctcatgatcatctttggagcagctggtctgtccctcatacgggacccg

SEQ ID NO: 9952 - DNA, 403 bp, Homo sapiens
gtcgcacgagctctctctctctctctctctctctctctctctctctctctgtctctctctctgtctctctctggggctgatgctctggacacggggagaacccttgtgaagactctttcctgccagacacagagggccacacctacgtggcctttattccaatggagaaagatgatgacttcaccacctggacccagcttgccaagtgcctccatatctgggacctggatgtgcgtggcaaccatcggcgcctgtggacattggttcgcgagagaaaccgcttcctggagagggaggtaccgaattccaccgtactcctgtggctcagaatctaaactatttattgactgtgctgagggcctagaaaactagccgaagctggagggtctgcattcttatcgcg

SEQ ID NO: 9953 - DNA, 227 bp, Homo sapiens
ggcacgaggctctcatgtggaggccgtgccccgctccgcgctcacgaagctgcgtcacttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaa

SEQ ID NO: 9954 - DNA, 398 bp, Homo sapiens
tcgattcgaattcggcacgaggagagagagagagagagtgagagagagagagagagagagagagagagagagagagagagagagagagagagagagagagagagagagagagagagagagagagagagagagagagagagagagagagagagagagagagagagagagagagtgtgtctctcccccctcccctccgcgtgtgggggctctcccctctctctctccctctctttatgtcttctctctgtgtctttcctttttttgtgtgtgtttttttctcccccccctctctccacaccccgagcgctctctctttttttctgtacccccccccccccccgcgtgttttcgtccgcgtgggacccctccccccccccccttgtgcgccccccctggtc

SEQ ID NO: 9955 - DNA, 226 bp, Homo sapiens
ggcacgagggggaggtgggggagggtttaaaccgagagagggtgttcaactaaggggggtcaaacagctagtctacggcgaaaccaggactcaaagccagtctacgagccatgtccactttgttcccctcactcttccctcgtgtgactgagactctgacccttaatctggatcgaccctgtgtggaaaacacagagctgcatcagcaggaacacctgcatcatgc

SEQ ID NO: 9956 - DNA, 359 bp, Homo sapiens
ggcacgaggtctgacctcgcacagctgcccatgcaatgatgagtggatcaaacactacggcttatacaagatgctcctcacagaatgaaaaacagctgctcattttcagttagctattagccttttagccccacccttgttttctctttttttgagacggagtctcactctgttgctcaggctggagtgcagtggtggtgccatcttggctcactgcaacctccaactcctgggttcatgtgatttgcccacctcagcctcccgagcagctgggtttacaggtgctccaccacacccggctattttttttgttttgtatgtttagtagagatagggttttgccatgttggccaggctgc

SEQ ID NO: 9957 - DNA, 398 bp, Homo sapiens
  misc_feature 398: n = A,T,C or G
attcggcacgaggccaccccgtgggcggcgggggcacagacactacacccgtcaggcctgttaaatttccaagcctccccagaagcccagcctcttctgccaattctggaaacttcaaccactcgcctcattcatcgggcggctccagtgggataggtgtgagccggcacggtggggagctgcttaaccgctcaggtggcagcatagacaatgtcttgtcccaaatcgctgcccagaggaaaaaagcagccggattattggagcagaaacccagccatcggtcaagccctgtggggccagcaccggggtccagcccgtctgagcttccagcctcccctgcaggtggcagcgctcctgttggcaaagaaattggagaccagcaaaaggcctccatctgn

SEQ ID NO: 9958 - DNA, 389 bp, Homo sapiens
  misc_feature 323: n = A,T,C or G
attcggcacgagcccacctcagcctcgcaaatagctgggaccacaggtgcatgccaccatgccccgctaatttttgtattttttttgtagagacagggttttgccatgttgtcgaggctggtctcaaattcctaggctcaagcgatcctcctgcctcagcctcccaaagtgctgggatgacaggtgtgagccccgtgcctggcctggtcatttctcttgctgtgcccaacctgccattaatcccatccatcctgagcccgacgtggtcatttttctcaccacccagcctaccgcccgacgtggtcctttccctcaccacccangcctaccgccgacgtggtccttttcctcaccacccagcctacccgccgacgtggtcctttccctcg

SEQ ID NO: 9959 - DNA, 392 bp, Homo sapiens
gtcggcacgagggtggctctgtgaggagcagggaacaccgagctcaaagggaggttctgcatcctgtggggacgctcctagagagagtcggccgcagcgagggcacagacaggctcgtggacatcacgactgcaccatggacgtcagccagcaggccccggggcagagtggcatgggggcaggaatggtggttacaccaacggcatgagctcattttccaagatggatctagagcaggtcccacccacgcagaacaagccctctttacagatcaccagacgtggggagagcagggctgcaggccaataagaggaggctggggaaggcgtgctctgtctggatggacttcctggaatagcctcgagtgcaaaaatagcgtgtccatgtgatgg

SEQ ID NO: 9960 - DNA, 393 bp, Homo sapiens
ggcacgagttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcct

SEQ ID NO: 9961 - DNA, 386 bp, Homo sapiens
ggcacgagggtctgctgtgcaccaccttggagaaggctctctgtgctgtagtgtggcagctgcctggtacccgggtggcttggaagaagtcagctcccgtcgtagtgagcacctctggaacctgtcctcagagagccacccttattcgccaagtctttttgacaactcgagctgtgccagctcacagcagggcgtgctttctctatcaatcaatcatcaatcaatcaatcaaatctatcagtgagagcctggctgggctggtgtcattggtcagggaaatgcaagtcttctggtgggtctgggtaaaagtggagacaatagatttgctgtgttgttgcttccatactgagaggagtgaggatcactttgccctcgaaggttttgag

SEQ ID NO: 9962 - DNA, 415 bp, Homo sapiens
  misc_feature 173: n = A,T,C or G
tacggctgcgagaagacgacagaagggcgggcatggtggcacatgcctgtaatcccagccactcgggaggctgaggcaggagaatggcgtgaacccaggaggtggagcttgcagtgagctgaaatcgcgccactgcactctagcctgggctacagagcgagactccgtctcanaaaaaaaaaaaaaagaaaggaaaaattgggggggcccggcccgggggcctaatcttggaattcaaaccttttggggggcccgggggggggggataaaagggcagggattttgaacccagggggcccggaggggaaaaccttttttttttttaaaaagaggggggggagaaaaaaccccattgggggccccttcccgaaatccggggcggtaaaaaacccttggggggtttggccaaacccaa

SEQ ID NO: 9963 - DNA, 376 bp, Homo sapiens
cgttgctgtcgcatgctctggttctgctttcctagcacaggtccatgctctgtgtgggtgcttttgggatggcagccacttccatgtcgcgatgagggcccagctagcgagccggacgaggcgctggtggatgaatgctgcctgctgcccagccagctgcttatccccagcctggactggcgtgccagccagcgacggcctggttagccgcctgcagcccaagcagccccttcgtctgcagtttggccgggcgcccacgctgcctggcagtgctgccaccctgcagctcgacggactcgccagggccccaggccagcccaagatcgaccacctgcggaggctggcactttgcgcttgccccacgtaggaatgcaag

SEQ ID NO: 9964 - DNA, 425 bp, Homo sapiens
ggcacgagcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccactgtgtctgacaagaatttatacttaagcataggagatggttctggaaattctaagaaattctgctctcagtaagagtagaggtttggagctttacctcttggcagtatcccttggaagggag

SEQ ID NO: 9965 - DNA, 415 bp, Homo sapiens
ggcacgagcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccactgtgtctgacaagaatttatacttaagcataggagatggttctggaaattctaagaaattctgctctcagtaagagtagaggtttggagctttacctcttggcagtatccct

SEQ ID NO: 9966 - DNA, 389 bp, Homo sapiens
cgttgctgtcggggatttttttttcctcataaatgttataaggaaatgatgttatccaaggacctgctgtattctctttttctctctttttttttttttcgggaagggaacccccccttggcccccaaagggggggggcagggcaaaaatacgggctaacggaaactttccctcccgggggggacaatttacccccggggggcaaaggcggaatggctccaaaaggcccccgtgcccttcaagcggggggagaaaaagggaacccttgtctaaaaaaaaaaagggcggccgtggtgtctcggggaaagaggccggagcacccctagcccctcaggggggcgcctgcggtaaaccgccaaaagatgcgcccggtttttgaacaaaaattt

SEQ ID NO: 9967 - DNA, 397 bp, Homo sapiens
  misc_feature 387: n = A,T,C or G
ggcacgagcagacgggcatttgtaccagggtctcacaccatgtgcatgtctagtgaaaaagtcatgaaacgattctcttttaaaaagagggagcccacggcacggacgcttcctccgtctctgaccccatgagccgacctctgactgagggaggccactggcacccagcgggcctgcgtctccttcgcgagctgaattcactcgtctcttagatgttttttctggggcttcagttcacactaacgttttagaaacactatttgaaaaagccctttgtgcagtcagaagggtgtgtacgcagccccgtgaaagccctggagcactgggaccttttccttgtgctccggaactgttggcagaggtgagtggggcgggcagctgcccggngcacagtccg

SEQ ID NO: 9968 - DNA, 366 bp, Homo sapiens
  misc_feature 36, 37, 38, 92, 93, 94: n = A,T,C or G
ggcacgaggagagagaggagagaactagtctcgagnnntttttttttttttttttttttttttttttttttttttttttttttttttttttnnngggggggggcccccccgggccaaaagggggaccccccccaaaaaaaaacccccccccccccaaaataaaacccttgggggggggggggggccccccccaaattttgggggggggggggccgggaaaaaaccggggccaaaacttgggggggttaaaaaaaaaaaattttttacccccccttttttttttttttggccctgggccccccccaaaaaggggaacccttccccccccaaaggggccccccatttttttcgggggggggggggagg

SEQ ID NO: 9969 - DNA, 410 bp, Homo sapiens
ggcacgaggttgcgtcctcctggggaagaggaaaggctcggttggagctggcagtttccaactccctggaggtcatctggagttcggtgaaacctgggaagaatgtgctcaaagggaaacctgggaagaagcagctcttcacctgaaaaatgttcactttgcctcagttgtgaattctttcattgagaaggagaattaccattatgttactatattaatgaaaggagaagtggatgtgactcatgattcacaaccaaagaatgtagagcctgaaaaaaatgaaagttgggagtgggttccttgggaagaactacctcccctggaccagcttttctggggactgcgttgtttaaaagaacaaggctatgatccatttaaagaagatctgaaccatctggtgggatacaaag

SEQ ID NO: 9970 - DNA, 397 bp, Homo sapiens
ttcggcaccaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacaaaaagcgtgattttgagttagcccaggcataccttgcattgtttctaaagttacaccttaaaat

SEQ ID NO: 9971 - DNA, 403 bp, Homo sapiens
  misc_feature 394: n = A,T,C or G
ggcacgagcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactntgctggttc

SEQ ID NO: 9972 - DNA, 440 bp, Homo sapiens
ggcacgaggaggaatgtcagctgagtacagttttctcatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagctttttcagcgtctttctggggcggaatgttggtacccattggtgataagccgtcaagcattgctgataggttttacctcgggggacccacaagcgtccgcggattcagcatgcacagct

SEQ ID NO: 9973 - DNA, 385 bp, Homo sapiens
ggcacgagctgtggtcctgtggtcccagctactcatgaagctgaggcagttgaggctgcagtgagccacgttctggccactacactccagcctgggcatcaaagtgacaagaccaaaaaaaaaaaaaaaatgtggtttggagggaggcaaaaaaaaattcaggaaagggggggaaggtaatcccttagggacacatttttactcacaatggtatctccaactttgggcatagggcctaaaacgtaggttttttatgaattatttaaccgaaaacccacccctaatttaaggcatgggcatgggaaaaaaaaaacccaccttgaaaaatatttaagggcctttgccaggggaacttagggactttaggggttaattttatctataa

SEQ ID NO: 9974 - DNA, 383 bp, Homo sapiens
  misc_feature 366, 383: n = A,T,C or G
aggatcccatcgattcgggctgttcattctcctgaacacagcctgccactttaaggaaaacatatgacactatttgttgctggcgaaatttacattttcaagtgaatagcagaattctggacacttgccaccaccaccaagaccttcatagcttcccttaactttgagacatgggtgttcagaggtttttcacgtgagatggcgttagcagcgcagttttgtgatactgcctgaagacatgccgacagtgcccagatctcttctattggtgagccagcttttcccacacggccaagttctgatgttgaaccattgccaggtgggtgaagatccattgacagtgaaaggtgggcccgtgggcttcantgcaaccaagcgcagan

SEQ ID NO: 9975 - DNA, 385 bp, Homo sapiens
  misc_feature 317: n = A,T,C or G
ggcacgagagggaccctgccttgtacccacatcactgggctctgtgctgaccaccagacaggaggaggtcctagtggtgagcaggggcaggacatgcatcttctgggggctgcagggaggcaggggtagagcttgatgccatggtggagtgtaggagaggctcagagacaaggagactcatgagaccaggctccttgcgtggccatggcatcagcaactgccccgtgacacagcccttttctcaagtcactctgattttgagcacttgctacaggcaccttttgggggcacgggtgttcgcgcacacaaatcaacanaagagagatgcagggcaggatcctgagcccaacttgcggccttggcggcttcttcctgcaagtgggcg

SEQ ID NO: 9976 - DNA, 383 bp, Homo sapiens
ggcacgagctcacaccacagctgagagggaaaggaaggttggaatggcggatcgccaagcgcgcccccacctctcctgtggtactggggtccctaaagccgacccccgctccggcggggctcgccggcccccaagtcgccagccgcttacctcacaatcccgcttggactgcatggctctccagctggccccctcgtaccctctttataacttcctccccaccggcctctggaagcttccctacccctccaccccgcaagctctcattggctctgagcgcgaccccgcctcccaggggggtggaggtatccactgcacgtgcgccgcccgggcttcgctcagaccttcaagtgaaagctgcaagtcgcgggtgcgtatgtacg

SEQ ID NO: 9977 - DNA, 383 bp, Homo sapiens
ggcacgagaagacattgaatccattttaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctc

SEQ ID NO: 9978 - DNA, 384 bp, Homo sapiens
ggcacgaggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgg

SEQ ID NO: 9979 - DNA, 380 bp, Homo sapiens
cgattcgctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagagtagttaggtcagaagttacagtagaaactt

SEQ ID NO: 9980 - DNA, 375 bp, Homo sapiens
cgttgctgtcggaatcctgtgcggtgtcaattcaggtgtgcactggcccctgagccttacatacaggacccgttccttaggatgacgttgcgttcccttgcttagagcctcagcaccatggcacctggctctcccccgatgcctgggtcttgctcttgcccatttcctagccagggtttgtggtccaggcaacctgtcacatcagtgtgttccaaacatggcacccagatctcaaaagcttcttcaacgctcccatggtttgggatacacctcaagttttaacttacgtacttcaagtttcttttattcaattagatacaaaccgtctgacttttggcttctgaaacaggaaagtcaattttgttgttttcactg

SEQ ID NO: 9981 - DNA, 380 bp, Homo sapiens
cgttgctgtcgactgtgtctgtgtgagggagagagtgtgtgtggtgtggaggtgaaactgaggcaagaaagggggctacctcaggagcgagggacaaagggggcgtgaggcacctatgccgcggcaccccggcgacaggaagccgtcctgaaccgggctaccgtgtaggggaagggcccgcgtagtcctcgcagggccccacagctggagtcggctccacagccccgggccgtcggcttctcacttactggacctccccggcgcccgggcctgaggactggctcggcggagggagaacaggaatcagacttgagcagctgcccgttgtctcgcaacttcacttgccgagaacccctaatttgttccctccctccttcccc

SEQ ID NO: 9982 - DNA, 378 bp, Homo sapiens
cgttgctgtcgtgttaatagaaagaataatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtg

SEQ ID NO: 9983 - DNA, 371 bp, Homo sapiens
ggcacgagtctgatcatactcactgtttcttcatcaccctactgaccttgtccagaatcccacatcccagttgatatcagggcaatcagtttcctggctgttttccccaatatcaacccgggcttacagaagacagtcaccacagagctcctgccaggagttcactcattcgtgcatttcttccttttttttttctttttgagatggagtctcgctctgtcgcccaggctggagtgcagtggagcgatctcggctcattgcaacctccgccgcctgggttcaagcgattctcttgcctcagcctcccaggtagctgggatagcaggtgtgtgccaccacgcccagctaatttttgtatttttagtaaagag

SEQ ID NO: 9984 - DNA, 371 bp, Homo sapiens
  misc_feature 173: n = A,T,C or G
tacggctgcgagaagacgacagaagggcgggcatggtggcacatgcctgtaatcccagccactcgggaggctgaggcaggagaatggcgtgaacccaggaggtggagcttgcagtgagctgaaatcgcgccactgcactctagcctgggctacagagcgagactccgtctcanaaaaaaaaaaaaaggaaaggaaaaattgggggggcccggcccgggggcctattctttgaatccgaaccttttgggggggcgggggggggggaacaaaagggcagggattttaaacccagcgggcccagcgggggaaaccttttttttttttaaaaaaaaaagaaaaaaaaaaaaacccctttggggggccttttaaga

SEQ ID NO: 9985 - DNA, 374 bp, Homo sapiens
ggcacgagctccaatgagctactcctgactcaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctataagaggccaaagctgggggatttgtggtgggttatacatccag

SEQ ID NO: 9986 - DNA, 371 bp, Homo sapiens
  misc_feature 371: n = A,T,C or G
ggcacgagctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctataagaggccaaagctgggggatttgtggtgggttatacatn

SEQ ID NO: 9987 - DNA, 370 bp, Homo sapiens
  misc_feature 321: n = A,T,C or G
gattcgaattcggcacgaggtgcaatggcagcccgagcgtgtacacgcacacctcctgttctgggggagtggtttcttggcagcttctcaagggcgaagggtgagttttcggcatctggccttcccttgctgctgtgggtcgggtcattctagcatcttgccatcttggatgatctgcagctgtcatctcggcagccaccatgaactggcctgccagtgggttttctcgttcccagcgaggatgtggtggtgtgtctgcagcccttttccacagcagcgaggacctgggaggattagtggcttagcttctttcttgtcggngagcaccgctccttcctatgttccaagtcagtagcaggtgtcagcttag

SEQ ID NO: 9988 - DNA, 363 bp, Homo sapiens
tacggctgcagaagacgacagaagggcaacatggtgaaaactcgtatctactaaacatacaaaaattatccaggtgtggtggcgggcgcctgtaatcccagctacttgagaggctgaggcaggagaatcccttgaacctgggaggcggaggttccactgagccgagattgcaccatccctctccagcctggggacagagtgaggctttagctcaaaaaaaaaaaaaaaggcccaattcctgggcccccccccaaaccaacctaaaaaattttaaaaaaaaggggggggccaaaaattgcaaaaccccattttttttttgcccgtttttggaaaaaaaatttaaaaaggcccagtccttgggaa

SEQ ID NO: 9989 - DNA, 148 bp, Homo sapiens
ataatggagactggagacagggcaatgagtctggtcgggggcacgtggacatgccccataggggccccacccagacttaacaggcaaggtcctgggcattgcgcgacgcaggactcaatgctaaagcaagcctgcctggctctgtgcc

SEQ ID NO: 9990 - DNA, 360 bp, Homo sapiens
ctaatacagacagggtcttactatgtttctcatgttggtcttgaactcctggtctcaagcagtcctcctgcctcagcctgtcaaactgccaggattacaggcatgagccactgagctcggtctatatctttcttgatcatagtttataatacaaatgtttagacaatgtactgttatcccccatatcaaaagaaggcatcattatgatgtcactgcaggaaaacatggaatgaaccctagtgcccacttgaagggagacagtcatcatactacactctcctttgtcctttgatcgtgtagtgtaccatatctgctttaggcataccagtctatcttcagagaccaggaagatataacagg

SEQ ID NO: 9991 - DNA, 359 bp, Homo sapiens
tacggctgcgagagacgacagaaggggagcttggccttctcagacttccactgggagaactcagggtccaattaaactccagaaccaggtgagctgcaccttctcaggtatcaaaacacagggcccgccaggcacggtggctcacacctgtaatcccgtaagtttgggaggccgaggcaggtggatcacctgaggtcaggagttcgagaccagcctggccaacatggtgaaaccgcttctctattaaaaatacaaaaaattggcctggcatggtggctcatgcctgtaatcccagcactttgggaggccgaggcgggcggatcacctgaggtcaggagttcgagaccagcctcaacatg

SEQ ID NO: 9992 - DNA, 360 bp, Homo sapiens
  misc_feature 13, 14, 15, 146: n = A,T,C or G
ggcacgagggatnnnaatggccacaaataccactacatcgacgacctgggggtcatcctgccccagaacgtctgggagcacctgtacaacagattcgggggtggccccgccgtgaaccacctgtacgtgtgctccatctgccaggnggagatcgaggcactggccaagcgcaggaggatcgagatcgacaccttcatcaagttgaacaaggccttccaggccgaggagtcgccgggcgtcatctactgcatcagcatgcagtgggtccgggagtggaggcgttcgtcaaggggaagacaacgagccccccgccccatgacacagcagattgccagtcaaagaagcggcatgtcagcttaa

SEQ ID NO: 9993 - DNA, 350 bp, Homo sapiens
ggcacgagctgcagtgagctgtgatcatgccactgcacaccagcctgggcaacagggcgagaccctgtttcaaaaattaaaagaaaaaaataaatgcagatacccaggcttggcttaaacctgctccccaggtgactcgtccgtgtgctgaagtttgagcagcactgctttcgcaggcaggtaattgcaagattctggtggaggccagacaggtgggcagcccccgagcagtctcagtcacactgaactatggcctggtatgccacatgacactttaccccacgaggtagggattaacctcgttttatggatcatcgtctgtgaggtgaggctccagaaagttaagtcag

SEQ ID NO: 9994 - DNA, 353 bp, Homo sapiens
ggcacgagcagaaagggttggaagttgagcctagaacagtcaggggcttaatggtcacacagcaggatctgcggtttggggcctagggactggtagtgaaaaaaaaaacatggaactagttctgatgtctggactctagtcactgccttgcttcgtagccttgggcaagtcttttgtgagacagggtgatagaatgaaaagtcttgtctttggagtcaggaagacccagatctgaatctagctctgatttgtactagctatgtacccttaggccagttactattctgtgtctcagtttccttatctgcaaaacaggtaaaaacaactttctcagaatatcagagataatgtgt

SEQ ID NO: 9995 - DNA, 350 bp, Homo sapiens
ggcacgagacatgttttaggcatcttaattcatattttatctaaaggcatataaatccttaaaaaaaatcatttgacttcatccttgctccctacatccagccagtaaccattgctttgttttacatcgcgtgcttcaggctttactacagcctacctggattttgcagtagcttcttaaactgcttaaactttggatattgccccagccaacacattctgccacagagatctctctgagttaaatgggattgtatcatgccccacacccaagcagatagaaactgtcaatagatacacttagaatgaatatgcatggaatcaaattacattcagaatctaccactatag

SEQ ID NO: 9996 - DNA, 631 bp, Homo sapiens
tactgctgcgagaagacgacagaagggtggagtgcagtgatgtgatcttggctcactgcaatctctgcctcctgggttcaaatgattctcccacctcagcctcctgagtcgctgggattacatgcatgcaccaccacgcctggctaattttgtatttttagtagagatagggtttctccatgttggtcaggctggtctcgaactcaggtgatctgcccatctcggcctcccagtcgctgcgcctggccttgatttactttcttttttttttttttgaaaaggaaacccctttttttccccagctggaagggaagggggggaatttattttactggaacctccccctcccgggttaaaaaaatttccctggggaggtgggaacaccgggaaggggttcacccccccacttaattttttttttttttttaacagggatttttgtttcccaaaactgggaggagggggccaattttttttaatgggaggttttcccttggggccccccctttctttctccttaccccccaaaaattggggaactataggggaggaccaccccccccgccataattttttttttttataaaaagggggttccctatttgggcgaggtgggttgtctttttgcccg

SEQ ID NO: 9997 - DNA, 227 bp, Homo sapiens
  misc_feature 29: n = A,T,C or G
ggcacgagggtaatctaactgcctgtggncgctccctctggctcttcaatgagacgacaagatgcccccaggcctgagggaagtcctgcggcctttcctgggctcctcctgagtggtatacgggaccaattaccggagagccatattcatcttcatcaacaactcgggtggcgagcacataaaccaagtggcattggaagcgtgacacaaccaacggtaccgcaatg

SEQ ID NO: 9998 - DNA, 223 bp, Homo sapiens
ggcacgagagatagagagagagagagagagagagagagagagagagagagagagagagagagagagagagagagagagagagagagagagcgccagcacactctcttgggggagacccccctctctctcccctctctgtggggggcgcgtgtgtttacacagaccccccctctctctgtgtgatatattttttcacacagagtgagagctctctctcttggtg

SEQ ID NO: 9999 - DNA, 217 bp, Homo sapiens
ggcacgaggcggcaatggtcacctccgggactcagccctgtgctgagccccgggcagtgtgatcatcctggcccttctcgtgcacgtcccctggctggatgctccttgctgccctcacggggtgtgtgtgtggcatacaggacagggaccggccagttggccctgctcattaaccacttgtccccacagggcagtggcggcctcacctctgcaattc

SEQ ID NO: 10000 - DNA, 215 bp, Homo sapiens
ggcacgagcggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacg

SEQ ID NO: 10001 - DNA, 209 bp, Homo sapiens
  misc_feature 8, 9, 203: n = A,T,C or G
acgttcannaccgagccccctcccatcatcacacagtgcacctgggctctgcagccccttgcctccattgcagccgcagcaagaggcctccacttgtccgtcagggacgctccaaggaaagaaaaagccgcccccggacatgagagaccactgtgttctctgtgggcagggaaccccagagcttctgcagagccaacactganggccgg

SEQ ID NO: 10002 - DNA, 188 bp, Homo sapiens
cgttgctgtcggtgaaatcgaatctgtacaaatgagtgcaaaaaagccaggaagaaagctcaggcccattagagatgactctgaaagcattgaagaaagtgatacaaggagaaaagttaaatcaacagagggctgggcactaaggggtcctgtctttttagaagtgacagactcagctggaagaattc

SEQ ID NO: 10003 - DNA, 443 bp, Homo sapiens
ggcacgaggaacagcctggccaacatagtgaaaccctgtctctactaaaaatacaaaaattagccgggcatggtggcatgcacctgcaatcccagccactcaggaggctgaggcaggagaatcacttgaatccgagaggcagaggttgcagtgagcaaagattctgccactgtgctccagcctgggtgacagtaagactctctctctcaagagaaaaaaaaaatatatatacacacacacacacacacacacacacacacacacacatatatatctctctctccaagtgtttagtatgcataaaattttgcgggaggaaaaggtataacctttctcaaataattaactaaatggatatgcgccatctattcaatagtttgtgtttcttcccctctgaaatgctacttctacatttattataaatactatgtgagcatgtttct

SEQ ID NO: 10004 - DNA, 427 bp, Homo sapiens
  misc_feature 227, 409: n = A,T,C or G
ggcacgagcctcaaggcagttcaagcaattctcctgcctcagcctcccgagtagctaggactacaggcgtgtgccacctctcccggctaatttttttgtatttttagtagagacggggtttcaccgtgttagccaggatgatctcgatctcctgacctcgtgattcacccccctcggcctcccaaagtgctggaattactggcgtgagccaccatgcccagcctcanatatgtttttaaaaaatatcattgtcctcctcctcttaagattttttaagtattttgctcaagtacttaagtagtctggctcaagtactttgtttacaattaaaatggatattatagcatttaatagaagaaatggttatggcttatccaaaaaaaattcagcatgacctggtgagacttanaaactacttgttgtgata

SEQ ID NO: 10005 - DNA, 436 bp, Homo sapiens
  misc_feature 357, 369, 372, 376, 382: n = A,T,C or G
tcgaattcggcacgaggcagcctcaacctcctaggctcaagggatcctcccacctcagccttctgagtagctgggaccacaggccctcaccaccatgcccagataatttttgcactttttgtataggtggggtttcgccgtgatttcccaggctggtctcgaactcctgggctcaagcaatacacctgcctcagcctcccaaaattctgagattacaggtgtgagccgctgcacctggccaaagtgttcttatttttgctttttcaacgccacatctacctggagcatcctctttctgataagtctcatggacttcctatggcatgcaagagaggccacccctatgctgagctgctngggaagagccangangacngatccngctgtaccttagggctgagaagtgtgaaagaccactcagaccctgctttgctgg

SEQ ID NO: 10006 - DNA, 431 bp, Homo sapiens
tcgattcgaattcggcacgagatttctatggataggaggtttatttgttccattatgcgaagatgatgggaagaaaagctgtatgtgcagatgcaggtgaatttgtggatatattagaaggaagatgacaggcagtgatggagtgttgaagagctcaaacattagacagtactgggtctgagttctgactctgccttttgcaagctgtgcaaccataggccagttatgaaaccttagttatcaagttataactaataggattgtgttgaacacgaaatgacatgataaacatatgtaaactgcttggatcagttgcccactagctcttgttaggagctaaaatgttagctcttgctgaggggctgtcaaatggcttctgtttctcatggagcagaaatctataaggtcatccactggtagtggtgggagaa

SEQ ID NO: 10007 - DNA, 430 bp, Homo sapiens
  misc_feature 405: n = A,T,C or G
atcccgtcgcttcaaattcggactgaagatccagcgagacacatttgtaattccagtttggggatggtagttgcaagcacctaaacagtttgccaaggaatgtttctcctgagtttgttccttgtgaaggtgaaggaggctttggtttgcacaagaagaaagacctactcagtgataatggttctgaatcacttccgcattcagctgcatacccctttcttggaaccttaggaaataaaccctcacctagatgtacccctggtccttctgaatcaggatgcatgcatataacctttcgcgattctaatgaaagacttggtttaaaagtatataaatgcaatccactaatggaaagtgaaaatgctgcatctgagaaaagtcaaggtttgggatgtcaggaacctncataaaagatgaagggacctagtgg

SEQ ID NO: 10008 - DNA, 432 bp, Homo sapiens
  misc_feature 377, 400, 432: n = A,T,C or G
aattcatcgcgaggacttcggcacgagctgtactgggggctatattttcacctgtcgacatgttgcacatcttatggtgggtaaaaacacacatccaagtttgtggccagatataattagcaaatgtgcgaaggtaaccttcacttatacagagttctgccctactcctgacaattggttttccattgagccatggcttaaagtgtccaatgaaaatctagattatgccattttaaaactaaaagaaaatggaaatgcgtttcctccaggactatggcgacagatttctcctcaaccatctactggtttgatttatttaattgggcatcctgaaggccagatcaagaaaatagatggttgtactgtgattcctctanacgaacgattgaaaaatatccanacgattgtcaagatgggttggtagatctctan

SEQ ID NO: 10009 - DNA, 430 bp, Homo sapiens
atagactttctgctgatcttatcgatgagaatacggcacgaggtcaaaacggactcactccctgaatgcaggctcagggccatcaaccaggctgacgctccaggaggcacagtgggtgtttctggtccacgcccagcgtggaaatcatagtggtgcacatgtactctgcgtgggcattgcggcagcatccgtgcttggacctcaccgcctttggggcccacgtgggattcctgccacatcgtcctcttgccctgcaaagacggagcagcccctcattgttgacaaagaaaccaagaccctgaaggttcagaactgcccatgatggtggcaccggggcttgaaccccggctgtggtggtgaccggcgactggctctgcgtgaggttcctgtggccgccacgacataagaccgcaagcggtgtggcctgatg

SEQ ID NO: 10010 - DNA, 424 bp, Homo sapiens
cgattcgaattcggcacgagctaccctccacgggagacgaagaggtgtttgtttccggctccaccccacctcccagctgtgccgtgcggagctgcctctctgccagtgccctccaggctctgacccagtctccgctgctgttccaggggaaaacaccttcctctcagagcaaagaccccagagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggacccctgtgacataaagaagttgatgcctgtccccagcctctatttgcatggtcagtggtcagaatg

SEQ ID NO: 10011 - DNA, 427 bp, Homo sapiens
gattcggcacgagccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggacccccccaaaatagcctctgtgaaaatggtgatgctgacacaccttctgcctgcgttgtggagagagaaagctcgactcacagcgggacagaagagacgctctgaatctgagcagtcccaaagaaagcaaacagatgcctcctcatttccaaagaagaggctg

SEQ ID NO: 10012 - DNA, 424 bp, Homo sapiens
  misc_feature 424: n = A,T,C or G
cgattcgaattcggcacgaggcaatgcccattcatcgattctcagtcctggccctgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtggtttctgacacaccttttgtggcgtccacttaatttgtgcctatatttgtatgaggtcataatttaatctggtcatatttaactttgtgtgtgggctgcaaataaacagcaggacagaaaatgtgttgttttgtcttttgaaatacaccccaaatctttaaaatgattggtaggaaatgn

SEQ ID NO: 10013 - DNA, 404 bp, Homo sapiens
tattcggcacgaggcactatgaaagggaaggaaacgcttcagggctttgtaactgacatcacagcaaagacagcagggaaagctctgtcactggtgattgtggatcaggagaaatgcttcagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactg

SEQ ID NO: 10014 - DNA, 414 bp, Homo sapiens
attcgaattcggcacgagaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagat

SEQ ID NO: 10015 - DNA, 409 bp, Homo sapiens
ggcacgagccggaatttgagaggaacatagaagcaaaggtccagcctttgcttcgtgctgattcctagacttaagattcaaaaacaaatttttaaaagtgaaaccagccctagcctttggaagctcttgaaggttcagcacccacccaggaatccacctgcctgttacacgcctctccaagacacagtggcaccgcttttctaactggcagcacagagcaactctataatatgcttatattaggtctagaagaatgcatcttgagacacatgggtaacctaattatataatgcttgttccatacaggagtgattatgcagtgggaccctgctgcaaacgggactttgcactctaaatatagaccccagcttgggacaaaagttgcagtagaaaaatagacataggagaa

SEQ ID NO: 10016 - DNA, 413 bp, Homo sapiens
  misc_feature 82, 87: n = A,T,C or G
cgttgctgtcggtcgaatttcgacctgtggtacacagctgtgctgtggctcagtcagcaacctcagaactctgaaaaaacanaacanaaaaaaaaaaaaaaagaaaaaaaaacccggccccttttttattggaaaaagggaatggaaaggaaaaaaaggaaaaactgaaagtttggtttaataaagggtttaaccggttttaaccctgaaaaaattttcttgaaagttttttaaaaacctttttttttttgaaagggtttaaaaacctaataacttgttaagggaaaccggggaaaaaaagggggttttggaaaaattcccccgggccccaattttaagggggacaaaaggtgggcttttaatggtaaagggaaatttggaaaaaaaaaagaaggacccaacccgggggcccc

SEQ ID NO: 10017 - DNA, 405 bp, Homo sapiens
tcgattcgaattcggcacgagatcaagggtccaccatgtgccagccactgaagtagatataaatacaaggatgtgtaaggtatggatgatggtatacgaactgtcatcttactggatttgtccgctctgttaaagatacggttccgaaaactttttaaagccctagagagggctttaaggcaatgtagcatcatatatagaggcatcaacctgttcatatctttctatttaacagaactgtgcacctgggcacaagggtgtgcacaacaggatgtgtacagcagcactgttaaagtgtagcacatccatactacaggatcttatgcaactgttggaaagaatgaagcgatgctgcactgtggtcatgcagtgatctctaagacatattaactagaaagcaaaagg

SEQ ID NO: 10018 - DNA, 405 bp, Homo sapiens
ggcacgaggaaaaacaggaatactttaacaattaaaaagaaaaaaatgttttttgtttgccaaggactcaggaaaataaaaagcattttctatttttaggacaaatcacaaatgaagtgtctaactggctattactgtttacccatataaaatatgctgctaaagtacatattttgctgtcaatggcttgacaattttttttttcaaatttggacatgagaggttatatagggactatattatccaacacatattttcttattttgccacaaatttccacttaacaaataaaaaaaggcgaatgctgttttgcaatcagaaagtgaatttcttttgtggtagcgtacacgtggttcatgtggttctccacgtttaagcacaaaccacagcacaggaagccacacc

SEQ ID NO: 10019 - DNA, 409 bp, Homo sapiens
ggcacgaggtgcggaggtgcgtgcctataattccagctactccagatgttgaggcaggagagttgcttggacccgggaggtggagggtgcagtgagccgggattgcgctactgtactccagcctgggcaacagagtgagactccgtctccaaaaaaaaaaaaaggggggtaaaaacctttgaaaatggaccccggtttttaactttttattggaaatcctaaggggggcttcgggttttcaaaagaattttccaaacccacccaccgccgggggaaaatcgaccttttttggcaaactggaaacatttttttttctggacccccgggggggggggggggaatttttccttaagacccttgggggtttttggggcaaaaaggccttggtaatgccacccataaaaaccgg

SEQ ID NO: 10020 - DNA, 414 bp, Homo sapiens
ggcacgagctaggaggaccttgaagagaaatgggatcagcccgccaaaccaagaagggttagcacttttgctaggagagctgaccacgcacaaacagatgagaaccaaaaccgagtgaagaggattgaagatgaacccacattttaaaagttcttgtctgctggaggtggcattacctgtgacctcgcttcacttctccatacatggctgttatatgcagaaaatccagctttctgaagcatatttcacgacatatgatgagacttatgtgatgtgagacctgagaaaactatgatagaaagaagcaactcacgttgcaaggatattcctcatgtatcatgcaaggatattcctcatatatcatatttgaacattctaagagatttctcataaagctgatattcataatttgag

SEQ ID NO: 10021 - DNA, 409 bp, Homo sapiens
  misc_feature 353: n = A,T,C or G
ggcacgaggagtatggaccgtgtgctcccaggctcctgacatagggtcatgaattagggccgagtgggagcgcagagcccctcccagtcacccggcagcagaagcagcccggcttttggaggacattgtctcctggagcagtgtcagtcccaaaaggtaactcagccctgcttctctcggctcagggttgacagtgacctgggaatgacttctacaacgtaattacgaattcactcagttttagaatatatttagtagtctcagaatcgctaattcatacccccatgaaaagcaaatttactacctaaagtacagtacttggatacaggtctttttgtctttactcttatggnatttagtcaaaatactgttttccaaagttgcttaccccttttctttcctaccactg

SEQ ID NO: 10022 - DNA, 404 bp, Homo sapiens
cgttgctgtcggacgggtccaccatgttagccaggctggtctcgaactcctgacctcaggtgatccacgcacctaggcctcccaaaatgttgggattataggtgtgagccaccatgcctggccgggagcagcattcttaaggaattcaagacacaggaagaacacttgcctttagtgggagcaagacaacgcagtgtggcagaagacaaagaatgggggcacaagtgcaaggtgaattggaggtagaatataggacttaactttctgacggcttctgttttctcagtgaagtctgaggcaaggccggtgacttaaacaaagaaggggtagtggataatttcaggaaagatggacacttcaccttgagcaacaggacaaggaactgagtaactgggaaacaaggt

SEQ ID NO: 10023 - DNA, 408 bp, Homo sapiens
ggcacgagataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggg

SEQ ID NO: 10024 - DNA, 412 bp, Homo sapiens
cgttgctgtcggtcaaagcagactataaatttggtttgttttgatttcaagtttcctgaaacttggctcttcagattgccccccagttctttattctgtgggtttcctgtggggtcttttccatggggctgatcccacctcacagctacatgccttacgggagggcacccctcccctagaattttcatcctctagattggtggactttgtgaaatagacatgatggtaactgctgtaatgggggctttggtaaggaacgcagcagagggccacacaacaggagaatcccgtgttcttgttctagccgccgcatagagaatacggcctttagcacacagagctcacacagggagctacatggggagaaagcgtgttgttctgcggcatgataagtgtgccgccaaagccttca

SEQ ID NO: 10025 - DNA, 407 bp, Homo sapiens
  misc_feature 23, 24: n = A,T,C or G
tcggtccatgtggcttgtggggnnactcatttctttcatgcccactggggaaggttccaccagcaaggctgttactggcggggtcctctgggaggggggcaagaaggccagccacaccaaggcactggagctccacgactcctggccttcgattggaggcccctctctgccagctctgccccttggggggcaccaggcaggactgccagccgctctcctggcaggtgacatcagccttcaagctcactgtgccctcaccatttcatgctcccccaaggtcctggtcatgtcttctcttgggtatcttcccaggacaggcactggcactggagccctggcacttgtttctgggttccatgcttcccaggtgtgatggtgaatgccgagtgtcaacttgactggattgc

SEQ ID NO: 10026 - DNA, 416 bp, Homo sapiens
  misc_feature 416: n = A,T,C or G
attcgaattcggcacgagccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctn

SEQ ID NO: 10027 - DNA, 405 bp, Homo sapiens
ggcacgaggtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagtacaccgtcaccatcaagccactggctgtggaaggagtttggccaacagggtcagtgtcacagccacaacttcagagagcagccatcccgcgtgtcgcg

SEQ ID NO: 10028 - DNA, 410 bp, Homo sapiens
  misc_feature 374, 385: n = A,T,C or G
ggcacgaggcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaaaaggctgcgtgcangtgcgtgtggngggagatgccacactgtgtcggggg

SEQ ID NO: 10029 - DNA, 409 bp, Homo sapiens
ttcgaattcggcacgagggaacacgttcaggggattgtgaggtcttgcacaagccacgtggggcaccttggcttcccggcaggaggtggacacccagccagaggcctggctcaaggtgaccttaccttcaccatgggctttctgggtgcgcgggcctgagcgcaggttgttttgtacatattggaatatgtgttaacttatgccccgcatcccaactcacacggaagcacgggtcttgtctcagtctcttcgctgcatttggaaaacagtctactctcgggccagcgccgggctgatgtgtacagaggcggctgcagctggcatttccctcagcccccaagtgtccatcctggcacttcccattcaggccacctgctttgggtcaacagttcctttgccagcagcatct

SEQ ID NO: 10030 - DNA, 407 bp, Homo sapiens
ggcacgaggtggattactgtgtggccgatggttttcaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacag

SEQ ID NO: 10031 - DNA, 412 bp, Homo sapiens
  misc_feature 346: n = A,T,C or G
ggcacgagccttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagaatgctatgctggactttgtgttcacagtagatgaccctgtcgcatggcattcnaaagaacctgaagaaaaattggagtcactactctttcctaaaaagtttaggcccaagaatatcacg

SEQ ID NO: 10032 - DNA, 411 bp, Homo sapiens
cgccggccgccctgcgtacgctcgcaaggcgctcgcagactccggagtcgccaacatgtcgaccgccatgaatttcgggaccaagagcttccagccgcggcccccggacaagggcagcttcccgctggatcacttaggtgaatgtaaaagctttaaagagaaattcatgaagtgtcttcataacaataattttgaaaatgctttgtgcagaaaggaatcaaaagaatatttagaatgcaggatggagagaaaattgatgctacaagaaccattggagaaactgggatttggagacttgactagtggaaaatcagaggcaaaaaaatgaattttgatgagaagacccctgggccgtgttcagtggtctctcaggacggagggcatcatcctgcctcttaggttggctgaggc

SEQ ID NO: 10033 - DNA, 420 bp, Homo sapiens
  misc_feature 420: n = A,T,C or G
ggcacgagccagaacataaggggcctaaagagagaggaagcaaaaaagattatattcaggaaaaacagaggagacaagaagagcagaggaaaagacatttagaggctgccgctctgctgagtgaaagaaacgcagatggtttaattgtagctagtcgtttccaccccactcccctgctgctgtctttgctggactttgtggccccttcaaggccgtttgtggtctactgtcagtacaaagagcctctgttggaatgctacacaaaactgcgggagaggggaggggtcatcaacctcaggctgtctgaaacctggctcagaaattatcaggttttgccagatcgaagtcatcctaaactgctgatgagtggaggtgggggttatcttctctccggcttcaccgttgccatggacaaccttn

SEQ ID NO: 10034 - DNA, 422 bp, Homo sapiens
ggcacgagatctggtccgaattccaaccatgaccctataggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttg

SEQ ID NO: 10035 - DNA, 391 bp, Homo sapiens
  misc_feature 391: n = A,T,C or G
ttcgaattcggcacgaggtgacctttaaaaagcaaaaaaaccaaaaaccaaccaaccaaacaaacacaaaaaaacaaacccacaaaaaatgaaaaaacagctacttctgaaacacataaaagtatcttgatcttttaaaaacaggtcctgaaactacagatccattgctgagactactcgaaaaactgtaaaacatgggcattattttaattcgtgaacaactgaaaagattcaatggagtgccatgtggtcattttagtatgtgagtcaaagcagaataatagggaaacattaaatctctcctttacagtttaagaggttgaaagcaaaaggaaagtctgaaaaaagaacaggggaggtttggttggtaatgtttttggtagaactggtn

SEQ ID NO: 10036 - DNA, 403 bp, Homo sapiens
cgttgctgtcggctatttgtattatgagctgatcgattagagaatcataggatactagcgcctgaggccatcttttctaggaataggagagagaaaaatgtatttgaattttgcctttagatttgaaattatgttaatagaaataagttaccctgtgtaattcaccttagaacttaacaaaagaccacacattacataacccagaggtatagattcaatataggatttgatggcccagcacactgttttctatgacaggttaatctagaagatcctgtaatgctcattaaggtactgtgattccagaatctacattagactagaaaaataattgtggttttctaacttgataatcaaattatgttaacatggagactttagctcttaaaatgacatgctctgg

SEQ ID NO: 10037 - DNA, 385 bp, Homo sapiens
cgttgctgtcggttcccctccacagactgttcccctgccagaagcacctggtaagcctctgcaagtcctcagaactagaaagattagaaagagagagagagaacacatgtggatgataccacagtcagtgagaagggactccaagctcatgcctctgggggatggcctcattgccatctctggatccagagggcacattattagcagttctattcagaaaaagggctagagagcaggggcaagaaatcatgcttgcagttgctcttgagggcagatgtattagtttgctagggctgtcataagagagtactgcagattgggtgacttaagcgacagaaatttcttttcttacaattctggaggctagaagtccaagctcaaggtt

SEQ ID NO: 10038 - DNA, 384 bp, Homo sapiens
cgttgctgtcgggctgcttaacacattcctatgctacaaaagacagtgctcctctccaggaaccaccaaataaattcagatactaatgccaaaaagaaggcagcatcagcttgggaaaagagtgcctttaaggcactgtttctctctatgaaggcagtgtggaatgatagggatgatctacgacctagaggagagaccttaagtcttacttgcagccaaaagccttcaaacctgagctagccagaactgttacatcagaattctcacccatgacaagaagcctggagggagtccagggttgatggattgacttaaggtgtcatcaaaagcttagactttacccttctgctgcaccacccttattgccttgttgtcacaagagga

SEQ ID NO: 10039 - DNA, 396 bp, Homo sapiens
cgttgctgtcgaaatatctgaaaactaaacttgaattaactcttaatacaaacagtactttgaaaatgcagcatttaaccttgttttaaaatttttttctcaaagcatttttttccagccactcacattttaaaaggttgtattacttttagttagaactgaaagggctcaactagcatttgctgtgaccagtatgcggagtctgtgttggctttccagaattgactttttgggttgtattggcaaatcacagtcctaaatgatgaatgttgaatgatgcactatgtttttgtttaaatgagatttcctgaaaatagttaatttcagaattaagggaaattgatgtcgctatcatgaggcatcataaaaatatgtattttacaaggtgaaggcatt

SEQ ID NO: 10040 - DNA, 402 bp, Homo sapiens
ggcacgaggtgacctttaaaaagcaaaaaaaccaaaaaccaaccaaccaaacaaacacaaaaaaacaaacccacaaaaaatgaaaaaacagctacttctgaaacacataaaagtatcttgatcttttaaaaacaggtcctgaaactacagatccattgctgagactactcgaaaaactgtaaaacatgggcattattttaattcgtgaacaactgaaaagattcaatggagtgccatgtggtcattttagtatgtgagtcaaagcagaataatagggaaacattaaatctcttctttacagttaaagaggttgaagcaaagggaagtctgaaaaagaacagggaggctgggtggtaatgtttttgtagaactgggtatcttgtcgatttagaaggggctttt

SEQ ID NO: 10041 - DNA, 391 bp, Homo sapiens
  misc_feature 367: n = A,T,C or G
ggcacgagggcaatctcatgtgcatttaacattcttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattacgaaaatggagccatttcaatctaatggttagggcaagatggggaagagaaggggaaacattctagtttctggattacattattatgcccctcctgaaaagggtggtgtcatttgcatttatttanagcaggtaatatgcaggaatgtaa

SEQ ID NO: 10042 - DNA, 388 bp, Homo sapiens
  misc_feature 302: n = A,T,C or G
ggcacgaggttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgngatgaatcttacggcaccaaagactaagacagtatctttaagattgctagggaaaagggccctatgtgtcaggcctctgagcccaa

SEQ ID NO: 10043 - DNA, 396 bp, Homo sapiens
cgttgctgtcgggcctctgaagtctttagtctacgggaaaataagtaaaacctgcccacatgcttgtgatggtattggaatatttcagtcctttgagaagaacacttcactttgaaccttacgggctattttccagactgtccaaatatgatttgtttcctctcaccatcatttccagtaccctgtcccaagtgtttgaatatagacattgatatgccctgatttttgctctacttcagaaaggatcggggatgtagtttagccctctaggagcttggaactaatttgtttgtctatttcttgtttgcttccaagctgcttattatgtgttacaggtagcagctacagctgaaggccatggtgaattgctggtgatgtaaatactcccagccctgt

SEQ ID NO: 10044 - DNA, 400 bp, Homo sapiens
gaattcggcacgagagctggggctagaaaaatgaataagattgggttcctgaccccagcccaggctcacactgtagtaaagggaaacagacatgaacactaggtgacatggagtgttaggggcgctatggtagaagtctgcagagagtgcaatgggcgtccaaatgaggaagtgatcacttgcacaagagtgggaggcttggctggaaaggcttctctgaataggatgacatttgatctgtgttttgaagggcatcgttggcaaggtaagtaatccaattaaaggaggttgcctcagctaaagcacagtatgctcaaaggtgcggatcatttgaaaatttgagttcaagtgcagtaggggtaaggtaagtatccaacagaattttctacaatgatggaat

SEQ ID NO: 10045 - DNA, 393 bp, Homo sapiens
ggcacgagagggtgtgtacatgtctctgtagctactgaagggaaggaacacttttccctgcctggaagtgccagcttaggcttcatagcactgcgtgggctggctagtaggaattatcaacttgctgggtgatcttgaaggatgattaacaggtatgtttatagcagcactattcacaatagcaaagacttggaaccaacctaaatgtccaacaacgatagactggattaagaaaatgtggcacatatacaccatggaatactatgcagccataaaaaatgatgagttcatgtcctttgtagggacatggatgaaactggaaaccatcattctcagcaaactattgcaaagacaaaaaaccaaacactgcatgttctcactcataggtgggat

SEQ ID NO: 10046 - DNA, 389 bp, Homo sapiens
ggcacgaggtattaaaagaattcttggaagagcagcgatcagattatgaagaatttgtcttgagaaattacagaggatttaaaccataatgttaggaatagttattctatcaagatgaatgtggaaagtgttagtgtgcatgtgatgagtcttgaagctggaaactaggtaacaggttcttaaatagttcatgtgaaaatcatgacagactaaggcaatggctgtggggctgtccgggagttctctacagaaaacatctaaaacttgaatgtgcaagtgagtagctaacttccaagcttcccatttctgtataatttaagcatgaaaatgagaacactgagatttgataggcatgtagaagtcagagtaagcaagagggcttgagttca

SEQ ID NO: 10047 - DNA, 382 bp, Homo sapiens
ggcacgagagaacaaaatgctatgggagtgtgggggttgcgggggggcacccaagccagccttgggagtcaggaaagacttcctggagaaaaatactttgacttttgaagtagttgactggaagttggccaaagagcgagtgaagagaagggtgtttcaggcaggcagaatagcacgtttacctggacaccccaaaggaagtggcgtgtgtgtgtgtgtgtgggggtgtgtgtgtgtgtgtattttcgggtaggatgaagagctgtgatgaggggtgggctggtgagactagatcataagggactgtataaggagagtgtacatatgtctattgtccctgcatacttattaccagcaacccccttcactctcaaaagggtcg

SEQ ID NO: 10048 - DNA, 397 bp, Homo sapiens
gatcgattcgaattcggcacgaggagagagatgagagagagagagagagagagagagagagagagagagagagagagagagagagagagagagagagagagagagagagagagagagagagagagagagagagagagagagagagagagagagagagagagagagcgctctctctttttctctctctcactctctctgacaaaacacagagagcgctctctctctctgtgtgttcttttttttttgaggggggggtgtatttttatatccctctctctctctcgcccccaaatatagagagagtgtgtgctctctctttttttttttgtggagagacacactctatactctccgcggcgcgagcgcgcttttttttttttttagcgagatatatttt

SEQ ID NO: 10049 - DNA, 386 bp, Homo sapiens
  misc_feature 190, 205: n = A,T,C or G
cgttgctgtcggtttagcccttgttgcctgggctggagtgcagtggtgcgatctcagctcactgcaacctctgcctcctgggttcaagcaattctcctgcctcagccttcctagtaggattataggcgcctgctaatttttttatttttagtagagatgtggtttcagggtgttggccaggctcgtttcnaactcctgacctcangcaatccacttgcgctcatccttccagactacaggtgtgagccaccgcgcctggctaggaatttattgataaagatctttatgctaacctcaatatgagtgacaaagattgggggaacatagcctgatgaggtccttagaaaacgtgcccctgggaaaaggaatttatataaaaggcgatg

SEQ ID NO: 10050 - DNA, 395 bp, Homo sapiens
  misc_feature 56, 57, 58, 59: n = A,T,C or G
ggcacgaggagagagagagagagagagtgtgtgtttgagagagagagagagagagnnnnagagagagagagagagagagagagagagagagagagagagagagagagagagagagagagagagagagagagagagagagagagagagagagagagagagagagagagagagagagagagagagagagagagagagagagagagaccccccccctctctctctctcttttctctcgggggggggccccccccctgtgtgtgtttccctctctctcgagtctcactgtctctgtctctctctctatgtataaaccccccctttttttttccccccccgcgcgcgcgttttttttttttttttatcccacagagagcgcgcgcgccccccccctctct

SEQ ID NO: 10051 - DNA, 387 bp, Homo sapiens
ggcacgagagagagagagagagagagaactagtctcgagagcagttttttttttttttttttcaaaaaaaaggggtttttttaaaaagacatatgggtccgggcccaagcccctggaatttaccaaattttttttttaaagggcaaaccctttccacaaaaaaagggttggccatagggggggcccaaacctttaataatcccggggaatttaaaaccaaaatcccttagggcttggaatataattgtgtcccaaaaaagtaaggggggccccctatgagggctcttaaaaataaaacaaaccttttactggggctgaaaaaaaaaaacggttttatgggggggggatttttcggaaaataaaggtcgggctccgggaaatatttgg

SEQ ID NO: 10052 - DNA, 394 bp, Homo sapiens
cgttgctgtcggttcccctccacagactgttccctagccagaagcacctggtaagcctctgcaagtcctcagaactagaaagattagaaagagagagagagaacacatgtggatgataccacagtcagtgagaagggactccaagctcatgcctctgggggatggcctcattgccatctctggatccagagggcaaattattagcagttctattcagaaaaagggctagagagcaggggcaagaaatcatgcttgcagttgctcttgagggcagatgtattagtttgctagggctgtcataagagagtactgcagattgggtgacttaagcgacagaaatttcttttcttacaattctggaggctagaagtccaagctcaaggtatcagaagag

SEQ ID NO: 10053 - DNA, 384 bp, Homo sapiens
ggcacgaggctatgcaagcagttctcattcttaatatcagctgagattggacaaactggcaactcttgcagatacttttatcatgtgtatgttagtgggactgttgatgtttagctgatttactcatactattgttgcttctcattgatggaagaatttttttttttagtgcattatcccggtcaatgtttgtttaaaaaaaaaaaaacagttttgtttccagggggggtctctttaaagggaggttttggggcccttctttggaaaattgaaacaaatgctggtgaggttggcagtttttatttatgggagggaacagagagaccctttctctctcctctcttattcatcgggcaggataatctagttgttttgaatttaggg

SEQ ID NO: 10054 - DNA, 399 bp, Homo sapiens
atcgattcgaattcggcacgaggcactatgaaagggaaggaaacgcttcagggctttgtaactgacatcacagcaaagacagcagggaaagctctgtcactggtgattgtggatcaggagaaatgcttcagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgg

SEQ ID NO: 10055 - DNA, 399 bp, Homo sapiens
  misc_feature 387: n = A,T,C or G
cgttgctgtcgatttgcactgccaaaggaggctctggaggttaaagtatgtgttttaatttcgttgttgaggccatataatgcagagttgacggaccgaccttatgagtcaccttggagcggagtagtggagacttaaagacagactaccctggagctggcttcaaactagttcttaatattgtgactcgaactccccatccccagaaattctcagatcttataagccaaagactggcaaggatactagagggaactactcgagtaggcgaggtcagactacataccgaataggagtccttccaaaaatatgcagtttcacatacagctgggtactccaagtgtacagttcccatcagctctaatatgacagaaggctgaggccggngtgctagagaaa

SEQ ID NO: 10056 - DNA, 393 bp, Homo sapiens
gattcgaattcggcacgagacattgaataaaagaacatgacaaacccacactggcattggataaatcatattacaccttcaaaatacacactctgaattataaagatgtgtttgttttctttccaaatcatgtagaattgatttccagttcaaggataaaccacaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatga

SEQ ID NO: 10057 - DNA, 398 bp, Homo sapiens
ggcacgaggcaagacactatcagtgcaaagtgagtagaccctcagatgctgctgggtcagagggaaggcccagggatatgacacaggacacagaggtggcagatacaccacctcccaacatttcctctatcacagcaactagaacaatggcaacaataggggtgggtgtggtggctcacgcctataatcccaataccctgggaggccaaggcagaaggattgcttgagcccaggagttcaagactagcctgggcaacttggcgaaaccctgtctctacaaacatatttgtatgtgattgaacaagtagaacaatggaacggaaagtccagatgtagttctaaatatgtacaggaacttagtataggataaatatggcatcttaaatcaatggggaaaa

SEQ ID NO: 10058 - DNA, 402 bp, Homo sapiens
  misc_feature 55: n = A,T,C or G
ccatcgattcgaatatccgtgggcccacaagcgatgggtccgccacatgtctggngttcagaaaaaaatgtgcttttctggaacatagcctgtgatagcagaacaacacctggcaagaaacaggttatgtttggctggagagtcattggcactatcaagaaatattaaagtgtagatttgagagaggaggagaaagacccaagcaaaattgaaaaccaggtgggacccagacagcagcaaagcaatggaagcatgtattttggtcaatatagagttaatacacaattttgcccctcttcttctgatcatgggactcatattaccagtcttcacatttcctttaaattcaggaatcaggaagaatttccagagtttgcagatggacacatttgctgcttccat

SEQ ID NO: 10059 - DNA, 382 bp, Homo sapiens
  misc_feature 195: n = A,T,C or G
gcctacggctgctagattacgacagaagggtccatggcagtgaggcggttacacaggtgtatatatatgcgaaaattcaccacttccacttaagatctgttgacattattttatgtatgtattcttccgtgaatttatttatttatttatttttttgagacagggtcttgctctgccgcccaggctgagtgcccnactcctatccacccccctttgaagagtctccctcccgggctgaagagattctcctgcctgaactgtgctattctctgggaccgcagtggtgtgtcccatccacacctcaactttcacgttcatagaagagacgggggtgcccctctgggtcccgctgtaaaatactcctgtgctaaattatacaaac

SEQ ID NO: 10060 - DNA, 383 bp, Homo sapiens
  misc_feature 276, 291, 294, 300, 303, 309: n = A,T,C or G
cgttgctgtcggttggaaggtgtagggaaatcctgctggaactggtgtttcagagtaaatcttttttctctccggaatttcttgttttgctattaacaaattatatttacctgattatgaaaaattaattttccttatacattttccccttacaacactagaaaagagcaccttgttacagttccggcctctcagtatgtgggctaaatgccagcattagggaattcattaatcatgagactaggctacaaactaggcttgcttgttttggggtgngtttgttgttggtgntgntggtgntgntgttgnttccaaatctctactgccttttgaggaaatgtaaatctgagacatggaaataagtgtttgggagaatggaaaag

SEQ ID NO: 10061 - DNA, 399 bp, Homo sapiens
  misc_feature 399: n = A,T,C or G
cgttgctgtcggttcccctccacagactgttccccagccagaagcacctggtaagcctctgcaagtcctcagaactagaaagattagaaagagagagagagaacacatgtggatgataccacagtcagtgagaagggactccaagctcatgcctctgggggatggcctcattgccatctctggatccagagggcaaattattagcagttctattcaaaaaaagggctagagagcaggggcaagaaatcatgcttgcagttgctcttgagggcagatgtattagtttgctagggctgtcataagagagtactgcagattgggtgacttaagcgacagaaatttcttttcttacaattctggaggctagaagtccaagctcaaggtatcagaagagttggn

SEQ ID NO: 10062 - DNA, 399 bp, Homo sapiens
  misc_feature 147: n = A,T,C or G
cgttgctgtcgaaaagagacacaaaatcttacagaagtttcaaaggaaggacagattgcatctgatacataagaaaggaaaaactacatgaagaaggtagaactggacacttggcagtgccctgggcttagatgtctattcttttanaagatggaggctgggcagtggctcacacctataatcccaaccctttgggaagccgagacaggaggatcacttgagcccaggagttcaagaccagcctggacaacacagtgagactctgtttctttaaaaaagaaagaaaaagagtatggaggatgtgtcttcaggcaggcagatacacaactgaaaactttctagaaaggccttgaggaatgaattgttcttcgacagaagatgggaaagaggtcattctca

SEQ ID NO: 10063 - DNA, 395 bp, Homo sapiens
  misc_feature 395: n = A,T,C or G
ggcacgagcgggcgtccaggctggagctcccagtgctgggaagccaagacctgagcgatatcccattgccggaaccatctttgcttctgctcacaccctcctggtcggccattcaatcaacaaactctagccagccccggctctgtgctaggcttgagctcagcccagcagggtgcagagcccatcctcaccaggccccaccctctcggtgccaaggcgggtgggtgcccgggggagaagatggatggacgacagttctgtgatgagatctgaaattcattacggggtgagatcagctccttaaatggggatttgaaaacattagggcttcattatgtacacaacggcagtgcctcattcatcatgcaaaaatcactcccgttattaaaaatccn

SEQ ID NO: 10064 - DNA, 391 bp, Homo sapiens
cgttgctgtcggttcccctccacagactgttccccagccagaagcacctggtaagcctctgcaagtcctcagaactagaaagattagaaagagagagagagaacacatgtggatgataccacagtcagtgagaagggactccaagctcatgcctctgggggatggcctcattgccatctctggatccagagggcaaattattagcagttctattcagaaaaagggctagagagcaggggcaagaaatcatgcttgcagttgctcttgagggcagatgtattagtttgctagggctgtcataagagagtactgcagattgggtgacttaagcgacagaaatttcttttcttacaattttggaggctagaagtccaagctcaaggtatcagaa

SEQ ID NO: 10065 - DNA, 403 bp, Homo sapiens
  misc_feature 200, 201, 205, 207, 403: n = A,T,C or G
catcacctgtggctgcactgttatgcttcatagtcacaggcacgtagctacggctgggctgggagcgtgtgtgtgcactgtaagaaggagctgatgatactggcgacgtgctggggttcgctcatgtggacacagtgattgcctgggacttccacaaactggaactgctggagaggggagggggtgggtagtgaggtgtnnccanangagcctagggagctccatgggccccggggtcagggccctcccacagcattccagctccctgcaggtcaggagcgcctcccacagtgagtttcccccacactcggctccttggagccccgacagtccatagcaccccaggagatgtctaaccttatggacttggaggcctcccaggggtctaggccagctgagttgn

SEQ ID NO: 10066 - DNA, 391 bp, Homo sapiens
ggcacgaggcgaggtcagcctcaaactaccggaatatatatgtcccagatgtgaatcaggctttattgaagaagtgacagatgattccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcg

SEQ ID NO: 10067 - DNA, 390 bp, Homo sapiens
cgttgctgtcgggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaaaggggaaggggtgttaaaaaaaaaacctggcccaagccaaaaaatttttaaagggggcttccccgggtgggggaaaacttaagcccaaaaaccttttttttgttaaaggccctccaaaacatttggaaaaaattattggttcgggccaaaattctaagcccggtttttttaagcaggggaaacatatccggaaccaggggtgcacagaaaaaatttttttga

SEQ ID NO: 10068 - DNA, 389 bp, Homo sapiens
ggcacgagatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaaca

SEQ ID NO: 10069 - DNA, 398 bp, Homo sapiens
  misc_feature 304: n = A,T,C or G
ggcacgaggagagagagagagagagagagagagagagagagagagagagagagagagagagagagagagagagagagagtctttaacgctctggggtctacacatatacagccacacatacttagacacattgatgagtgggcggacactccttagcttgcgtagagagaaatgggttctttatgagaaacgtgtgtaattctctctctgtataggcctattataattggagaaacatatgtgtatcaccgcccgcgcacattttttatattattgcttttctgaggggggtgtgatgtgagtntcattacacatcgaggacccatgcaggactcactacattgtataatagctatgatctatagtgctcaaaatgttgaagtatcttagagtttaat

SEQ ID NO: 10070 - DNA, 395 bp, Homo sapiens
cgttgctgtcggccagactccatagacacggagaagatcaaactggagctgcgttcataggctggcactctcaatcctacatcaggtgccaccaccaccagactcaggctctggtgtaagaagcggccaagtgcctggacccagaggctttgcaggacagtgttctcaggagctgggcctgaggcttaggagagctgccttcgctgcaggaaatcagggattatcccttaacagaagtgtctggagtagttttcaggtataggaatgagatgcctcgtggtgaaaggatctcaccctgggaagatgtggtgccccctccagggctctggaggatggatgcctcccccaggggctctccaagctgggcatttgggcctggtggatgccaacctgga

SEQ ID NO: 10071 - DNA, 395 bp, Homo sapiens
cgttgctgtcggtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgaggg

SEQ ID NO: 10072 - DNA, 402 bp, Homo sapiens
ggcacgaggagagagagagagagttatgatatagagagagagagagagagagagagagagagagagagagagagagagagagagagagagagagatagagagagagagagagagagagagagagagagagagagagacagagagagagagagagagagagagagagagagactttttttttttctttcttcttttcctccagctcaaggacattctctccctgttctacagctactgtttctctggactcttctcatctcctccccgcgttctttttttctccatggcggccccttcccctcctctttgatctttccttgcctggacctctcccacgacccgcttccttttctctccctattccttctccatccgccttttcctttcccttccttgtgtggg

SEQ ID NO: 10073 - DNA, 384 bp, Homo sapiens
ggcacgagatggcagcacaaagaaagcccacaatctgaaaactccagtctcctctaacactggctttgttttaaatcaagatgggaagagatacatgaggggtgggagggaagatatgccggctgccctttcttatctcagtgacgtacatgcctcgggattataggcacgcggatcactgaacctcttttttgtcattcttcctatgacatttgcggcagaactttttagttgattctgttcacatgaaatgtgacaagcatttttacaccatgagacagctgactacccacatgccacacccattgtatgtgtcatcagccagccccgtaactgcacccataggggtgcagctgcaggggagctgtgcctttctcctctcct

SEQ ID NO: 10074 - DNA, 383 bp, Homo sapiens
ggcacgagaacagactacaagccctgccaggagcagagtaagggaaacagaggagaaaagtgtttttagtctgtgcctgaatgtatttacatctgtttgtagcccaaaagccaaaagcgtacatacgcttggcttttctgtagctatgtttatggctttacagcagattttatggagctgcaattactttgatcatgagggactgatgctagtggatttacttcaccaaatggaactcactttgtggcttctgaagaagggacctttgtggactgtcatggagtagttaagagtgcaggctctgatttagtgatcagagtctgcattgtcaggaatgggacaaaaggaagtatgtgggctttgataggatgccttgagagaat

SEQ ID NO: 10075 - DNA, 398 bp, Homo sapiens
ggcacgagggggcgcgggcgcccctgcactagtcggaaaaaaccgagaggtttctcttctcagggctgagtcaccagcacgcaggagaagagggcgaagcggccacccgcgttctgtgttcggagtcaggacgagaagcattgggtgggagcagggcgaggggctcgagttgggtctgcagcgggcacaggacctagttttgtacagttaacggtggggttgagtaaagaagggggccggtggggaggatgaaagctccctttatttctttccccagcgaccaggaggaagctttcgttgaattgagcgccccttgcttcgatagcaggccgaagagggagctcattggcagccgttgctaagaagtcgagatcttctagaaatgtacgaaccgagga

SEQ ID NO: 10076 - DNA, 391 bp, Homo sapiens
  misc_feature 79, 80, 209, 337, 363: n = A,T,C or G
cgaattcggcacgaggagtatggaccgtgtgctcccaggctcctgacatagggtcatgaattagggccgagtgggagcnnggagcccctcccagtcacccggcagcagaagcagcccggcttttggaggacattgtctcctggagcagtgtcagtcccaaaaggtaactcagccctgcttctctcggctcagggttgacagtgacctgngaatgacttctacaacgtaattacgaattcactcagttttagaatatatttagtagtctcagaagcgctaattcatacccccatgaaaagcaaatttactacctagagtacaggacttggatacaggnctttttggctttactcttaatggatntaggcaaaaaacctgtttcccaaggtgc

SEQ ID NO: 10077 - DNA, 391 bp, Homo sapiens
ttcgaattcggcacgaggggactcggcccagaagccgagggactctctaggctgccgggcgctggtcgtcagcgccgaggctgggctgaggcgccgcggtaccatgaggcgccgcagtggctgaccgaggagccaaatacaaagaaattaaagaagacctgggtcgagagaaataactgaagccatgaaagcatatttcttcaatttcagtagagagaggagctgctggaggaaaaggaaccagaaaaatggtacttaagagattatggcatcagaaacccacaatgttaaaaaacggaacttttgtaataagattgaggatcatttcattgatcttcctagaaaaaagatctctaatttcactaataagaacatgaaggaggttaagaag

SEQ ID NO: 10078 - DNA, 389 bp, Homo sapiens
  misc_feature 364: n = A,T,C or G
attcggcacgagaagaaaatagaaacccagaaaacaaaacaaaataaaacaaaaccatcagaactgtgagtggaaactaaggtgatgatctgggagcaatacactaaaatcttgtgtcgagacctatatgaaggctggcagtggagctaaacctggacatgctgaagacaagggagctgaaccagggctcctacatgaagcagggataactgatggcagtaaatgtggtctcaaattgcagatggcctggaggaaaatttcccaaatttagagcctcaggattcccaaagatcctccaaatatgagctcacaatcaaagatcagagacgttgaagaataaaaaacaccttaagtggcagcatanaaaacagctaatttatgaccccaag

SEQ ID NO: 10079 - DNA, 384 bp, Homo sapiens
ggcacgagaagaaaatagaaacccagaaaacaaaacaaaatacaacaaaaccatcagaactgtgagtggaaactaaggtgatgatctgggagcaatacactaaaatcttgtgtcgagacctatatgaaggctggcagtggagctaaacctggacatgctgaagacaagggagctgaaccagggctcctacatgaagcagggataactgatggcagtaaatgtggtctcaaattgcagatggtctggaggaaaatttaccaaatttagagcctcaggattcccaaagatcctccaaatatgagctcacaatcaaagatcagagacgttgaaaaataaaaaacaccttaagtgggcagcataaaaaacagctaatttagaacccca

SEQ ID NO: 10080 - DNA, 394 bp, Homo sapiens
cgttgctgtcgggctgcccacaggtctgcaggcactcggtacgccgctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggcaagaacttacaggaaaaatctgttccaaaagcagctcaggatttgatgacaaatggttatgtctcccttcaagagaaagacatctttgtgtctggagtgaagattttttatg

SEQ ID NO: 10081 - DNA, 393 bp, Homo sapiens
  misc_feature 393: n = A,T,C or G
ttcgaattcggcacgaggagcctgtggctccccctgcgggctgctcagcggcgtgcacagcccaaccacacacctgcaggcccgcctggcccttccagcaaccctgttagtaacggcaaagaaacccggaggagcagcaagagatagcagtattttagccactgaacttcagtggagggtggtgagcagtgtccttatccaccctaatctcatactccctcattgtccagctgaactacctgtcccctgggagtcaggaccctctggctgctctctttcctctttagaaatggcaagtacttgcttggcgcagtggctcacgcttgaatcccagcactttgggaagccgaaggggcggatcacctgaggcggaagtcaggaccgctcgacaan

SEQ ID NO: 10082 - DNA, 398 bp, Homo sapiens
ggcacgaggaaagaaggaccagccccttgaccgttctggctggggaattgtccacgaggaagcctctgcacttccacacatggcacagttctgcctgtgacctgccgcctaagctttactggaattcaggttttgagactgagatgcgtgttcgtatttttccacttatctgtcttgtcagctggccgacttctctgtgattggttttttaagtgccgggtgaattttggacctctggatgtgcagcaagtttttatgcaataagccttcctttcaggtctctaaaagctcctgctctgatctgtggtttaacactgtgcagggctgtggagctctgagagacctgaacccctacccatcccctgcacctccctactctccctgccgaggcgtccatt

SEQ ID NO: 10083 - DNA, 388 bp, Homo sapiens
ggcacgaggtgaagacaagaaaggggcactattttaacacaaccttttcccgtgatcaccaccgaaaattactgacgagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattga

SEQ ID NO: 10084 - DNA, 386 bp, Homo sapiens
gattcgaattcggcacgaggaagcacctggaaaagagtaagaaaaattagaacgcaagtttttcatgctctctgatttccttaaggcagtagtaaccaaacttcaagggagacacctaaatagcaaaagtccccaaatgctgagtgttctagagctcaaacaagccatgagacaccagccagcagttattcgtgtacactactcctggccacagcctgcaagcacactagcactgtgaaggtcggtggtcactcagcacagtgtttccagaacagcaactctgctgtgcaacttgggctacgtcatctcaggctacaattgccatcctgaggcgaggcctgacgatcacacagaactcaaggcagcaatgatcattcattctctta

SEQ ID NO: 10085 - DNA, 394 bp, Homo sapiens
  misc_feature 394: n = A,T,C or G
attcgaattcggcacgaggccaccccgtgggcggcgggggcacagacactacacccgtcaggcctgttaaatttccaagcctccccagaagcccagcctcttctgccaattctggaaacttcaaccactcgcctcattcatcgggcggctccagtgggataggtgtgagccggcacggtggggagctgcttaaccgctcaggtggcagcatagacaatgtcttgtcccaaatcgctgcccagaggaaaaaagcagccggattattggagcagaaacccagccatcggtcaagccctggtgggccagcaccggggtccagcccgtctgagcttccagccctccctgcaggtgcagcgctcctgttggcaagaaattgagaccagcaaaagcctcn

SEQ ID NO: 10086 - DNA, 395 bp, Homo sapiens
ttcgaattcggcacgagattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaaaggccgggagcagatg

SEQ ID NO: 10087 - DNA, 386 bp, Homo sapiens
cgttgctgtcgggagcggccacgagggctccagagagagccatgtggagggacctaggccagcagctgacccagggctggtgactccaagatcatgactgccccagagaggatgtcagaggcaggagggccgatggcagttccacagatggcctcagagcacctgctctgggccagggccccccactgggtgctgagcagagagtggtgaacaggcccgggcagcaagctcaactctgcctgcacgtggggctctatcagctgctgacctcaggcctaccccacaccagctacatcaaaatctttgtaggtggaacctagccttgaaaacctttgtctatttttattttgtttgagacggagtctcgccctgtcatccaggctgga

SEQ ID NO: 10088 - DNA, 383 bp, Homo sapiens
ggcacgagggcgaaagatgccgaagggtggtgcagagaagtcacctggaatgtggctcagagaaccacgcaatgccctggggtctccctaccccgtgcaggtcagtgagggcacccgcccatgcaaccccaggggccagccacgtcgggccacatgtgctggggctgtgtgtgccagagaacgggctgtgagtccctgtctcagctggctcttgtgtgggactcctgagccaggaagcctccggctaaggaagccccgccttagcctggagacgaccctcacgtccgtccctcacgtctgtccctcggcaagtgctcctcactgtggagagggcagctgctgacctgcagcaagccaggcggcggatcaagatttgtgccaag

SEQ ID NO: 10089 - DNA, 396 bp, Homo sapiens
attcggcacgagtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactcctgcagatagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctg

SEQ ID NO: 10090 - DNA, 390 bp, Homo sapiens
ggcacgaggagagagagagagagagagagagagagagagagagagagagagagagagagagagagagagagagagagagagagagagagagagagagagagagcgcgcctctggcacactctctctctctacacactctgtctgtgcgcgctccacactctatataccgcacacacgctcagagtgtctccgcgcgcgcgcgcgccaagacactctagtgcgcgcgtatttgtgcgctctctctctccccccccacgcgcgcgccacaaaactctctttttggcgctctctggcacacacactctcttctctatgcgcactctctctctgagtctctctctcttatatatacccgcgcgatacatatctgtgtgcgagactctgtgtgcg

SEQ ID NO: 10091 - DNA, 399 bp, Homo sapiens
ggcacgagctaccctccacgggagacgaagaggtgtttgtttccggctccaccccacctcccagctgtgccgtgcggagctgcctctctgccagtgccctccaggctctgacccagtctccgctgctgttccaggggaaaacaccttcctctcagagcaaagaccccagagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatgg

SEQ ID NO: 10092 - DNA, 396 bp, Homo sapiens
gaattcggcacgagcccagtggtgccagggcagagtccccctccctgacctgacttgtgcacctcgtcacccaccgccagcagtgtccccccacaacaggcttgctcagtacagcacccaacccaagtccccagcacccacaccccagtgagtttcctgtgccctataggctcagctgcttctcgtcctccccccacttgggatccttggaacagggagtggttcttatttaggtccctgaggtaccaagcacaggctttgctcttagcagccgccactccagtgatgaagccgttagcagactggcctctgcagagctctgcggggaggtgcctggcttctccggcctccaccctggcccagagctgcctcctgagcagcggatcccaacctgcg

SEQ ID NO: 10093 - DNA, 383 bp, Homo sapiens
ggcacgagcccaggtctctcatgagaaacttgtttaccctcttagatacccttgagtctcttgtctgtgtctggtgtatttatttatttagcctaccaagatagccactcttcaggagagttctgaatttggaaagaagttaggatcaggtgtgttggtcaagtgagacacagaggaggccactcaacaaaacccatgaaataccagaagcagtgagttcctcgcaggtccagagagaagagggcagcacgctggactgggggagccgtcaggacccttgtgctcgccagcaggtggggagcaagagagatggagtgtgggccctgagagctgaagcctttatggggtccaggccatcaccccagcaggttcccaagaagttg

SEQ ID NO: 10094 - DNA, 386 bp, Homo sapiens
ggcacgagggcaagagattctccactgctatgggcctcacaagagccggatgggggttgccgaaaggcagcagaagctgaggtctcagtatttctttgactgcgcctgtccagcttgtcaaactgaggcacacaggatggctgcagggcccaggtgggaagcattctgttgcaacagttgcggagcgcccatgcagggagatgacgtgctgcgctgtggcagcagatcttgtgcagaatccgccgtcagcagggaccacctggtctctcggttacaggacctacagcagcaggtcagagtggcccagaagcttctcagagatggtgaactaaagcgagctgttcagcggctgtcggggtgccagcgtgacgccgagagcttcctgt

SEQ ID NO: 10095 - DNA, 383 bp, Homo sapiens
catcgattcgaattcggcacgagtgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctcccgaatcccgtcgcttctcgac

SEQ ID NO: 10096 - DNA, 393 bp, Homo sapiens
  misc_feature 355: n = A,T,C or G
cgattcgaattcggcacgagctggagaagaccagtaagatctcggaccttatcagcagcatcacgcaggactaccacctggatgagcaggatgctgagggccgcctggtacgcggcatcattcgcattagtacccgaaagagccgtgctcgcccacagacctcggagggtcgttcaactcgggctgctgccccaaccgctgctgcccctgacagtggccatgagaccatggtgggctcaggtctcagccaggatgagctgacagtgcagatctcccaggagacgactgcagatgccatcgcccggaagctgaggccttatggagctccagggtacccagcaagccatgactcatnctttcaggggcaccgacacagactcgtcggggcaccct

SEQ ID NO: 10097 - DNA, 386 bp, Homo sapiens
  misc_feature 386: n = A,T,C or G
ggcacgaggggaaagcaagaacagcactgctgggctggagacggcgggagccgctgctctccggctgagggaatcagagacagctccgtccctagtggagcgcaggggaggcagaagtcatgacaggcgaggtggattctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataan

SEQ ID NO: 10098 - DNA, 387 bp, Homo sapiens
  misc_feature 387: n = A,T,C or G
cgttgctgtcggacggaagctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcn

SEQ ID NO: 10099 - DNA, 398 bp, Homo sapiens
  misc_feature 380: n = A,T,C or G
ggcacgagagagccaagatggcaccactgtactccagcctgggcaacgagtgaaatgtcgtctcaaaaaaaagaaaggtaccggttactgagggagacatcaccgtggagacctgaaggccgatgacagaacttgaccacagggcgccgggcagagggcacagtttggactcgatacaccccagggacacagccccggagaatggatcccaccagctccagcattgctgccccctctgctttctccttcttttggggctctgctagtcccgagccttcccaggtcccctctttcctgtctctaacaagtgtgaagctgagccaggacctgggagaggcaggtcctcgagcccaagcagagcccgaggttgggcgcaaggnagaagaaggggttcaaag

SEQ ID NO: 10100 - DNA, 384 bp, Homo sapiens
ggcacgagagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggaatggcagttcggaaaaccctcattcct

SEQ ID NO: 10101 - DNA, 390 bp, Homo sapiens
ggcacgaggctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatag

SEQ ID NO: 10102 - DNA, 397 bp, Homo sapiens
  misc_feature 397: n = A,T,C or G
tcgattcgaattcggcacgagaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctcn

SEQ ID NO: 10103 - DNA, 398 bp, Homo sapiens
ggcacgagccttactgtacccggtctaggtagactcctacgggaaatgcctgcagaatcgggagctgcctaccgcgcggctacaggacacagccacggccaccaccgaggatccagagctcttggctttcttgtcccgctataagttccacttggccctggaaaatgccatctgtaacgactacatgacagaaaaactgtggcgtcccatgcacctgggcgctgtgcccgtgtaccgcggttctccctctgtgagggactggatgccgaacaatcactccgtcatcctgattgatgattttgagtctcctcagaagctggcagagtttattgactttcctgacaagaatgatgaggagtatatgaaatacctggcatacaagcaacctgggggcatcg

SEQ ID NO: 10104 - DNA, 385 bp, Homo sapiens
cgttgctgtcgcggccggaattcttcccgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagagggtgttgatgaagaaattgtttatgccaaatcaactgccttacagacatggctctttggttatgaactaactgatactatcatggtcttttgtgatgacacaatcatctttatggccagcacgaaaaaaggggggttcttgaaacagaatgccacactaag

SEQ ID NO: 10105 - DNA, 398 bp, Homo sapiens
cgagcccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctgggtccatggaattctcacactcaagaaagcaaatgaacttcttctgagcacaggcatgcccggcagttttctcatccgagtcagtgaaaagatcaaaggctatgccctgtcctatctgtcggaggacggctgaaacattttctcatcgatgcctctgcagacgcctacagctccctgggcgtggaccagctacagcatgccaccttggcggatttggtgga

SEQ ID NO: 10106 - DNA, 386 bp, Homo sapiens
  misc_feature 386: n = A,T,C or G
ggcacgaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcn

SEQ ID NO: 10107 - DNA, 385 bp, Homo sapiens
ggcacgagggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggcca

SEQ ID NO: 10108 - DNA, 402 bp, Homo sapiens
ggcacgagctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactccgggctgctgtgtgtggcatgtggttcataccgacggggaaaggcgacctgtggtgatgtcgacgtgctcatcactcacccagatggctggtcccaccg

SEQ ID NO: 10109 - DNA, 383 bp, Homo sapiens
  misc_feature 383: n = A,T,C or G
ggcacgagcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagn

SEQ ID NO: 10110 - DNA, 393 bp, Homo sapiens
  misc_feature 313: n = A,T,C or G
cggcacgaggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggngctgtgccgcccccatccggaagctctatgctgtgggtgataaccctatgtctgacgtatacggcgccaacctgttccac

SEQ ID NO: 10111 - DNA, 380 bp, Homo sapiens
ggcacgaggtttatagactacctccttcctggaaaagtctcagcttcatattctgttgaatatatgcagaattcttagtgtgaaaggtgatgtaccacttcagatcagttttcactggagagacttgtaattggtagctgtagctcgtatccatccctagtcactttgccaggatgaatgctgttgggcagcagtagcctaagttacggaaggggagcagattgaatggggttttgagacatcttctctgataccttagctttccttctgctctggtcgctatccactcagtcgtgtgctagaaatgtttaacaaccaggatctctggggtgggggtgggggggagcgctgaatttgtagcatttgctgcaaatataaat

SEQ ID NO: 10112 - DNA, 371 bp, Homo sapiens
ggcacgagggctcaagaccgatgtccttcacgctgggccgctcgtgggcgggtcttacccggcataccgcggaaacggcgcgtcccgccagctgcggctccagcctgggagggagcgcagcgcggggagcctgcttcgtttggagagtgaggaaaagggacattccttggaaatggacagagccgagttccttaaagggatcgcagatgaaagagacccttttctaaatcagcaacgacctggcagccttagttcctcaacaggagatggttcgaagatgaaatgtttgaaactccgccgccgtttcacctttgcacacacgcgcacggcaggcccagaatcgcacagagacgcttacactctcccgctcg

SEQ ID NO: 10113 - DNA, 381 bp, Homo sapiens
tacggctgcgagaagacgacagaaggggtgacttaaaacaacaaacatttattacctcaccttttctctgggtcaggaatcaagttgtggcttagctgggtcctctgactttgggtctctgacaaggctgcagctcattcaaagctcgactggaaaagatccactccctagctcaaatactaatggttgctggcaggattgacttcctgcctctgtttctcataaattcttccaccttcaattccttgccacatacacttctccatagagcatctcacaacatggcagctttcttagcaagtgagggggcaagagaaggttccagcaagagagaggatgctcataagaccaaagttaagagtctttagtaacctaatcata

SEQ ID NO: 10114 - DNA, 380 bp, Homo sapiens
cgttgctgtcggttcccctccacagactgttcccttgccagaagcacctggtaagcctctgcaagtcctcagaactagaaagattagaaagagagagagagaacacatgtggatgataccacagtcagtgagaagggactccaagctcatgcctctgggggatggcctcattgccatctctggatccagagggcaaattattagcagttctattcagaaaaagggctagagagcaggggcaagaaatcatgcttgcagttgctcttgagggcagatgtattagtttgctagggctgtcataagagagtactgcagattgggtgacttaagcgacagaaatttcttttcttacaattctggaggctagaagtccaagctca

SEQ ID NO: 10115 - DNA, 370 bp, Homo sapiens
  misc_feature 25, 26, 27: n = A,T,C or G
tacggctgcgagaagacgacagaannngtgacttaaaacaacaaacatttattacctcaccttttctctgggtcaggaatcaagttgtggcttagctgggtcctctgactttgggtctctgacaaggctgcagctcattcaaagctcgactggaaaagatccactccctagctcaaatactagtggttgctggcaggattgacttcctgcctctgtttctcataaattcttccaccttcaattccttgccacatacacttctccatagagcatctcacaacatggcagctttcttagcaagtgagggggcaagagaaggttccagcaagagagaggatgctaataagaccaaagttaagagtctttagta

SEQ ID NO: 10116 - DNA, 381 bp, Homo sapiens
  misc_feature 294: n = A,T,C or G
cgattcgaattcggcacgaggttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacgttgtatcanggtaaccaactcgatttgggatgaatcttatggcaccaaagactaagacagtatcttttagaatgcttagggaaaagggcctatgtg

SEQ ID NO: 10117 - DNA, 373 bp, Homo sapiens
  misc_feature 175: n = A,T,C or G
tctacggttgcgagaagacgacagaagggcgggcatggtggcacatgcctgtaatcccaggcactcgggaggctgaggcaggagaatggcgtgaacccaggaggtggagcttgcagtgagctgaaatcgcgccactgcactctagcctgggctacagagcgagactccgtctcanaaaaaaaaaaaaaggaaaaggaaaaatgggggggcccggcccgggggcttattctttgaattccaaccctttgggggggcgggggggggggaaaaaaagggtaggggttttaaaaccacggggcccagctggggaaacctttttcttttttaaaaaaaggagaggaaggagaaaacctctcttgggggcctttcatag

SEQ ID NO: 10118 - DNA, 376 bp, Homo sapiens
agtgagtttcttaacaacccatcagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctc

SEQ ID NO: 10119 - DNA, 377 bp, Homo sapiens
gtgacgagactttccactgtaatccaaccacctaagtttatcaggtgcttcactgaggaagcctagttttttaagcacaatagcaaaaccatcagctgtgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtgggggctttaatgaatataatggtaaactttacaggacgctaaagcctcctt

SEQ ID NO: 10120 - DNA, 364 bp, Homo sapiens
ggcacgaggaaatatttatccatgagtacatataacatagatgtccagtttttcaagttacaaaaagcagacagccctccctttttttttttttttggaaaagggggtccgcctgggcccccagggggggcaccagggggggaaattgaactaaagggaccccgccccccggggggaaaggaaatttttgggcccccccccccccggacgcgggggcgggaaaacccaagaagcccgggccgggcccctggcccaccagcaggggggaacagggggacatctggtctaaaaaaaaagaatccagggtggtaagaccaaaaaaaaaaaaattggaccggtcaaaacagggcataataacgcgggc

SEQ ID NO: 10121 - DNA, 379 bp, Homo sapiens
ggcacgagggtctgtggtcttacatgatgagtgccacccttgccaatttgccttcttcatcctcctcaccccctaagacttcttgattgcccttggggtctcaggacattctcttttccacctcaccgtgaatgccctggctcaggaccgacactttcctttccaaagtctgctttcagctaactcttggaaggaaatctctcccatgtttcactcaaaggtataaatgcctgatgaggcattacagcaacttatgctgaagttagttttaggtgttgggcatggagatcctgtcacaccttacagggtagctggctgtctcttcccatctctcggtccagtgaacccttagaaaacaatgccaagagtctcctagttt

SEQ ID NO: 10122 - DNA, 379 bp, Homo sapiens
aattcggcacgaggtagaattgtccctgggtcttaacaactcatttgtaactgatccaggtctcctccctctgcttcctcaaacccaggcttcgctgcctctgcggagttcttacctgtctctcctttccacccgggttccctggaggaagctaaactcagaccaaggccctgggctccccaggagttaaaagggaatacgctgtcccaagattctagaatgaagagtcaacgtagcccgagtggcttaaacctcctgtccttaaatgcaagaaatgttttctatcgagccctggacaggtgtctctgctggcctggggttttcaacaggtcatgcctgcctcagaccccagggacaaatgttcttccagctctaactc

SEQ ID NO: 10123 - DNA, 373 bp, Homo sapiens
  misc_feature 365: n = A,T,C or G
ggcacgagagagagccaggtccagagacaccaagctggcaacccaggcaggtgaaggcaattcctctccctacttaaaaagagaattcctgggggagaggggaggcaccttttgagagggaggggggcggctagactgtgttcaggctgttctgtctcttggtccaggaatagaaagagttaaccctcccccagaaatttgtcagcccccacacagcagggaaacattgttggaccctctgacatgctaacagtgtgacaccggctgactggagctagcagattctagaccctggactcccccttcaaagcccaacaggactcggctgggtggtgcctttgttcaggaccttgtgtgaggcaganatgagagc

SEQ ID NO: 10124 - DNA, 365 bp, Homo sapiens
ggcacgagggccgtttcaaccttgactggccaaaaataactaataaacttttttgttttaagtcaggcaagtgattttctacatttagcagtttgaaagtccagtgttaatgcaatatttctagtgagaaatgcttgttattaaaagcatgggagtgatagtgtgaaatggtggtgagtgcttctatcatattactgtaggtacttggactggtgcaaacttgaatcctttttcatccccttggtaggagctatttaaataatactggtaaaaatcaaacatttctttgtccatgtaataggaaatagccaaatcacttagagttttcactattatgagagtatctgctttatgaagcactaaat

SEQ ID NO: 10125 - DNA, 375 bp, Homo sapiens
ggcacgagatcaagggtccaccatgtgccagccactgaagtagatataaatacaaggatgtgtaaggtatggatgatggtatacgaactgtcatcttactggatttgtccgctctgttaaagatacggttccgaaaactttttaaagccctagagagggctttaaggcaatgtagcatcatatatagaggcatcaacctgttcatatctttctatttaacagaactgtgcacctgggcacaagggggtgcacaacaggatgtgtacaggagcactgttaaagtggagcacatccatactacaagatcttatgccactgttggaaagaatgaagcgaagctgcacctgggtcatgccatgatctctaagacatatt

SEQ ID NO: 10126 - DNA, 369 bp, Homo sapiens
  misc_feature 21, 22, 23, 24, 25, 26: n = A,T,C or G
tacggctgcgataagactacnnnnnncgatccccaggctaagccattgtttattctttgtgaggtgtttgtcttgggagatatatgcatacaatgtggtgttgctataatgagtgctgagatttcaaccctataagagccatgggctctggagaactgtgaactgggacatttctaatgtgatgaggattgacaggttgtgtctgataccatgtgctaacagcctgaagatattgagaaaaaggactacacaaaatgaatgaccaatggacagtggatttgatacacggtcccttgatagtgacttttgaggtgaaagtcacacagttcagctatctgaggattctggcaggcatcactataatcacct

SEQ ID NO: 10127 - DNA, 380 bp, Homo sapiens
ggcacgaggtgaggagtttgaggggtctgaagactgaaagagtcgaatggtttgttggcaggacctacaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccag

SEQ ID NO: 10128 - DNA, 368 bp, Homo sapiens
ggcacgaggctgagggcttcagccaggacctgggctgtgaccacatcctggtgatagactccgggggcttgataggtggggccttgacgtcagctggggacagatttgagctggaggcttccttggccactctgctcatgggactgagcaatgtcaccgtgatcagtctagctgaaaccaaggacattccagcagctattctgcatgcatttctgaggttagaaaaaacggggcacatgcccaactaccagtttgtataccagaaccttcatgatgtatctgttcccggccctaggcccagagacaagagacagctcctggatccacctggtgacctgagcagggctgcagcccagatggagaaacag

SEQ ID NO: 10129 - DNA, 374 bp, Homo sapiens
tacggctgcgagaagacgacagaagggatacttttaaataatctgtctcacttactgaaagaaaccacaaaacgcacaaaatatgaaagctaacacctgccctccatatatcatcttcctatgtctcccaccacaaccacaaaactacttccagagaactaaatttttattgacaatggaaatcaaggtaaaccctggaatttttcctattccattctaactttaatggtttagatgactacagacatgttctcacagaccccacatatctttggatcctcctactaaaggtagggttagtaaatgtcccatccttgggacataatttactcagttgattaaaatactggtcttcgccagagttggtttggcag

SEQ ID NO: 10130 - DNA, 377 bp, Homo sapiens
  misc_feature 289: n = A,T,C or G
aattcggcacgagggcgaaagatgccgaagggtggtgcagagaagtcacctggaatgtggctcagagaaccacgcaatgccctggggtctccctaccccgtgcaggtcagtgagggcacccgcccatgcaaccccaggggccagccacgtcgggccacatgtgctggggctgtgtgtgccagagaacgggctgtgagtccctgtctcagctggctcttgtgtgggactcctgagccaggaagcctccggctaaggaagccccgccttagcctggagagaccctcacgtncgtcctcacgtctgtcctcggaagtgctctcactgtgagaaggcagttgtgacctgcacaagcaggcggcgatcaagattgtgccagt

SEQ ID NO: 10131 - DNA, 372 bp, Homo sapiens
  misc_feature 257, 308: n = A,T,C or G
cgggactcagccctgtgctgagccccgggcagtgtgatcatcctggcccttctcgtgcacgtcccctggctggatgctccttgctgccctcacggggtgtgtgtgtggcatacaggacagggaccggccagttggccctgctcattaaccacttgtccccacagggcagtggcggcctcacctctgcaattctctgaggctggatctaggccaccgccccgtttaaaactagggcatcggctcccagggagggcggngagctgcacagttggacttgtgggggcaggcatggatccacacagcccggngccctccgcacccttgccctccagggagcccagaaggcggcgtggctgcagcctggctctgggg

SEQ ID NO: 10132 - DNA, 376 bp, Homo sapiens
ttctacggatgcgacaacactacagagaggcaacaattcctgccaacacaggaacccacacagcgatgtggaaaaaatcttccaaacactccacggtagccacacttaccacatcccgatataaggtccaccatatgcacacacaattgcagaaatctgtcctcgtttctgcactataaataaaaatcctgaaggaaatccagcccacccagacattatatgggaatcacaacaaccaaagcccctggtaaaaagtcacttcaaagctgaatccactgcatacgcagcagccttgtgacacagttataaactcttccctactacaagctcatagggcgtcccattaccctgtggacccattatcctggggacccag

SEQ ID NO: 10133 - DNA, 376 bp, Homo sapiens
  misc_feature 376: n = A,T,C or G
ggcacgaggttccgtagccgcgatgctgcgctatttccaggctgcgagcggggacttcactgctctgctgtctcctgcaagaactggctcaagaaatttgcctcgaaaaccaaaaaaaaggtttggtatgaaagtccttccttgggttctcactcgacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaccgtgagcctctcaaggtgtcctgactcagactctcagcctgccgagcgactgaaagacn

SEQ ID NO: 10134 - DNA, 381 bp, Homo sapiens
tgcacgaggggaaagcaagaacagcactgttgggctggaaacggcgggagccgctgctctccggctgtgggaatcacagacagctccgtccctaatggagcgcaccggaggcataattcatgactggcgaggtggattctgaggttcacctagaactcaatgacccacacgtcatttcacaagaggaagcggatagtccttcagatagtggacagggcagctatgaaacaattggacccttgagtgaaggagattcagatgaagagatatttgtaagtaagaagttgaaaaacaggaaggttctacaagacagtgattccgaaacagaggacacatatgcctctccagagaaaactacctatgacagtgccgaggaggaag

SEQ ID NO: 10135 - DNA, 374 bp, Homo sapiens
ggcacgagccccctgttcctgtgcctgctgcaggccgctccagggaggccccgtctggcccctccccagaatgtgacgctgctctcccagaacttcagcgggtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggataacttttttgagttgagccggccccaccctgtcct

SEQ ID NO: 10136 - DNA, 379 bp, Homo sapiens
ggcacgagggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacc

SEQ ID NO: 10137 - DNA, 374 bp, Homo sapiens
ggcacgagctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcgtcctcttcctgcccctgctcctgctgctcggggagcttcaggccctgcgtgactttgcccagctgggcagtgcccacttctgggggatgatgacgctgggcggcctgtttggctttgccatcggctacgtg

SEQ ID NO: 10138 - DNA, 358 bp, Homo sapiens
ggcacgaggcccctcttccagcccccagcagttgctgggcaaagtggagaatctgtgtggttgggggagagagaacacagtgatagtagaactttgcatcagaacttagtgctgtcaacattggatggaactcaactgatgccaatagagggagtatttcaataagccctagtcagaaggaaatttcccatccagaggtctgaacttgagttttggcaagccttgccactgtgaactaatatgatacagagtcctaaataaacttgaaagacagtctaggccacaaactgcaattcctaagctagtcctagtactgttctgggctcagagccagtgaagttgggggcatatgatcaag

SEQ ID NO: 10139 - DNA, 361 bp, Homo sapiens
tacggctgcgagtgacgacagaagggacccttaaggagttttgctaccacccatacggcaactgtctctcccgttagacctgggggcctcaaccttgacccccatatgtagttggtgggggaggcagaggtggtctctgggcagggatacaggacaaaaaactgtgttttcacaaagtataaggagttttactttctagagtgccccccatcctacttttgactctgattaaaaattacctatgagactttgtgccttaaaaaataatttataggccgggcacagtggctcacgcctgtaatcccagcactttgggggaccaaggtgggtggatcataggtcatgagatcgagaccagcct

SEQ ID NO: 10140 - DNA, 351 bp, Homo sapiens
cgttgctgtcgcggggacttggacgtttctcatagacaaggaactaatttctgtgattactactcctgggattccctaactcagaacacacattcaggtgcatctgccacagggtcattctaagggtgtgcttaagttactgctatcagggcacttgccctacagtagtgtcaggcattttgcctgtatttgcatccactgtgtctcagctaactgcgtgtgtttggccaagttatttagtaataccttgtagggttaccaggagcagctaatgagactgtgtgtaaaacgagccacctctgtggcctggaataaagtggagcttcattggtgtcagttcttttcttttct

SEQ ID NO: 10141 - DNA, 352 bp, Homo sapiens
  misc_feature 1, 2: n = A,T,C or G
nntttttgtgcttgaagacgacagaaggggactccattgaggactagttgctctcctgcacgtgatgacaggagtaaaatataattgacttgtcagaaggtatccggttggccccagaaggtatagtatcatctcaggagatcaaggaaggtatccttctgcagtttgggggatctgaagaaaagctgagcagatcagaaatgaactcagcagaattaacatttgaaagagagaaacaaggacaccaagaagcaatttcacccaggaaagcattccgttatgaaatccaagctctctttacatgaagactcagcctgcagacagctccctacacatgcaccccacagggaag

SEQ ID NO: 10142 - DNA, 349 bp, Homo sapiens
ggcacgaggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcatagcaaatgaacaagtgccattcaagggttagaaactgctcagccacagggtcccagtgtctgagtctggaagagtctttacagatttgttcactctctgagggatcctcctggctctggttacatactttcagggacgg

SEQ ID NO: 10143 - DNA, 355 bp, Homo sapiens
ggcacgaggtgagagtttttccttaaaacaaaggggcagcaggaaactccaggagttcccaaaaaaagaaacgcagtcggcctccaggcataccaagcactcttgcttcgatgaccgtgaaagaaacgccagtttacctgcgacaccagcatccacacctcaggccgaggagcaggagctgtggagggcacgcggggcaggggaggtctctccacactgcccatggggcgtgtgatctggcaatgccaccaaatctacaagtggacacaccttcccacgaacccacccctgggctctacgccaccctcacgcaccccagtcctctgccccagcattttccacatggctttgctgg

SEQ ID NO: 10144 - DNA, 355 bp, Homo sapiens
  misc_feature 355: n = A,T,C or G
ggcacgagcctaggggtggcaggatccgctcccccagcccagctgctggcctatgagagtagggagtttgatgacatcctccagtgggacttcactgaggacttcttcaacctgacgctcaaggagctgcacctgcagcgctgggtggtggctgcctgcccccaggcccatttcatgctaaagggagatgacgatgtctttgtccacgtccccaacgtgttagagttcctggatggctgggacccagcccaggacctcctggtgggagatgtcatccgccaagcccttgccaacaggaacactaaaggtcaaaaccttcatcccaccctcaatgtacagggccacccactacccn

SEQ ID NO: 10145 - DNA, 352 bp, Homo sapiens
  misc_feature 352: n = A,T,C or G
ggcacgaggcagggccctgacagtgagtgtggctgaggtcctctcctgcccgcacacacacgagtactccccggcatccaccacagccaggccacggatctgcagctcacacctggacccatcctgcctcaggctgtgtctgtccccatctctgagggtctcatgccccttcctccactccaccggtgccgccttgctcagctcacaccacagcgtggccgtgtccccttctgtggcctcttcattcctcagaccctctatgaacttggaaggcatggccctgacggtgagcatggctgaggtcctctccttcccgcacatgcacaggtactccccagcgtcctctgccacn

SEQ ID NO: 10146 - DNA, 318 bp, Homo sapiens
tacggctgctagtgacgacagaagggacccttaaggaggtttgctaccacccatacggcaactgtctctcccgttagacctgggggcctcaaccttgacccccatatgtagttggtgggggaggcagaggtggtctctgggcagggatacaggacaaaaaactgtggtttcacaaagtataaggagttttactttctagagtgcccccatcctactttgactctgattaaaaatacctatgagactttgtgccttaaaaaataattattagccgccacagtgctcacgcctgaattcccagactttgcggaccatgtg

SEQ ID NO: 10147 - DNA, 132 bp, Homo sapiens
  misc_feature 4: n = A,T,C or G
accnaattccctgagctggcacctaaccaaaatcaaaatcatttgaaggactggttcttggagaacaagagtgaagtacctgaatgtagaaacaatgaggatggacctgggttaataatggaagaacagccc

SEQ ID NO: 10148 - DNA, 708 bp, Homo sapiens
  misc_feature 483, 506, 526, 673, 708: n = A,T,C or G
attcgaattcggcacgagagctggggctagaaaaatgaataagattgggttcctgaccccagcccaggctcacactgtagtaaagggaaacagacatgaacactaggtgacatggagtgttaggggcgctatggtagaagtctgcagagagtgcaatgggcgtccaaatgaggaagtgatcacttgcacaagagtgggaggcttggctggaaaggcttctctgaataggatgacatttgatctgtgttttgaagggcatcgttggcaaggtaagtaatccaattaaaggaggttgcctcagctaaagcacagtatgctcaaaggtgcggatcatttgaaaatttgagttcaggtgcagtaggggtaaggtaagtatccaacagaattttctacaatgatggaaatgttctatattgtcactgtccaatacgggagcctctagccacatttggccagtacaactgaagaattgaatattaactntcatttaattctagctaatttanaattaaataggttcatcagntagtggctaacatatttaacaagtgcacgttagagaataaaagaaggcaagtgcgagaaggttttggtatcatattgggaggactgaattttcttctgcagcccttttgtgttttgacaaaggcttgacaacagcgtaatatatcanttttcctgtggagtgcccaagctgcagcagataan

SEQ ID NO: 10149 - DNA, 698 bp, Homo sapiens
attcgaattcggcacgagggaggacgttgcgtggagtggtgggaggaggcgggagccgtgtgcgagagcaggtggaaagccttgaggggcaggaccaggatgcagctggcttgtataagagctcaggagtgagcctggcactccagagggcgcggcgggtggggaggcagcaggcaccagtccaggagagcttcgtggacgtggctcctgcgcgcacacccccaggagcacagccacgggctgcaggtgtggctggcctcagcactcagtcctcacccggagcctttgcctgctcctccttccaagagcactgaggcaccagtgggcttggcactccaccttgggcttccttttcctggagagccgccttgagggtccctcctgtgactggggtctctgcagcgagagccgcgggggttgcggagcccctgcctgggggagctggcggaatgcgagccgccggccgggggcctgcacataagacctgcaggtggtgcctggggccctggctcttttcgggtgcccttggcactcagaaaagaccccaccagcttagaagcccagcggttgctcaccacctggaaggccaagagaaaaacaccccgggcttgcaattgttttgggtctacttgtaaagatgaggggaagttgaggcccgcctgcacactggtccctacaaacaaagcctgtgtgtccag

SEQ ID NO: 10150 - DNA, 662 bp, Homo sapiens
  misc_feature 662: n = A,T,C or G
acaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtatgcctgggtgatgccgcccagccccgaaacctcaccaagcggcactggccaggggcccctgaagaccaaaaagacaaagatggtggtgacttcagtggcactggaggccttcccgactactaggcggcaccccattaagtgaacattaggcttcttctaaagacaaacagtccatgggactggacttgtcaagtcctgaggcctgaagacacaacttccaatgacccgaattggaacctgcgaacaaatataaactgagggagccgaggtccctgagaaaacggn

SEQ ID NO: 10151 - DNA, 629 bp, Homo sapiens
  misc_feature 590, 605, 611: n = A,T,C or G
tacttttgcgagaagacgacagaagggttgagagacctggtcttactggatgaggctttggaaaccaacgtgaggcaggcgctagcacatcctgagaggggtgtgacctggcacacaggcccagcctgggcttcatgtctcagctggcaagactgcctgctcattgccattccaggccgggcagggccaaggggcttcagggacccatgccctcatggggctcattgagctcgtctcccagcagccaaggccctggcatctccaaatgaagccagctgtgggggaaggtccttctcatgagccagtctgtcctggctgggggtggcatcccagagccccatctaggatgcccagggatgtataggtctgttgtgaggataagccagcactgagccctcaccctggactgggagggcagtgggcctgctctgagccctcaccctggactgggagggcagcggctctgctctgaaccctcaccctgggactcggggcagcccgcctgctctgagccctcacccttgacttgtctcctctgttcacgtcatgccgtggaggaagtggtgaaagaggtggtgggacatgccaangagactggagagaangacagnccgctgaggtcggcaggg

SEQ ID NO: 10152 - DNA, 233 bp, Homo sapiens
  misc_feature 20, 31, 32, 33, 34: n = A,T,C or G
ctcggcacgaggagagcagntttttttttcnnnntaccttggtgggtttttttctttttggggggtttttcttttttattttttctttttttttgcccccccccggggggggaaaaaaaaaacggggggctctcaaaaccccccccggggggggggggggggggggggggggacccccccccctggggggggccaaaaaaaaaaaaaaaccggggggggggcccccccccccc

SEQ ID NO: 10153 - DNA, 614 bp, Homo sapiens
  misc_feature 588, 591: n = A,T,C or G
tcgattcgaattcggcacgaggcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcaaggcatggccaaaatggatgtgaagctccgctcactgatctgcgtggggctcaatgagcaggtgctgcacctgtggctggagtgctctgctcagcctgccaccgtgagaaggtaccagccctggtcttctggcagncgngctggtcagatcagggagctcaa

SEQ ID NO: 10154 - DNA, 599 bp, Homo sapiens
  misc_feature 549: n = A,T,C or G
tacgtctgcgagaagactacagaagggctgccaccacgcccagctaattttttgtatttttagtagagacggggtttccccgtgttagccaggatggtcccgatctcctgacctcgtgatctgcccgcctcagcatcccaaaggcttgggattacaggcgtgagccactgcgcccaggctttatttatttatttatttatttagagacacagtgtcactctgttgcccaggctggagtgcaatggtgtgacatagctcactgtagactcgaactccttggctcaagccagcctcccactttggcctcccaaagtgctgcgactgcagatgtaagccaccataacccacctctgttgttgttgtaaaggtaaaatttcagatctggcatggtggcttatatctgtaatcccagcactttgggagccaggtaggaggattgctgagcccggagtcaagaccagctggcaaatgcaagatcttgttacaaagcaaacaacaaaaaatttccaagccagcatgtggtccgcctgtatctacactttggagtanggggcagaaacctagtcagatttagatcgctaaccaatgtggaactgctt

SEQ ID NO: 10155 - DNA, 227 bp, Homo sapiens
ggcacgagcttcaatggtggttatattttcacctgtcgacatgttgtacatcttatggtgggtaaaaacacacatccaagtttgtggccagatataattagcaaatgtgcgaaggtaaccttcacttatacagagttctgccctactcctgacaattggttttccattgagccatggcttaaagtgtccaatgaaaatctagattatgccattttaaaactaaaaga

SEQ ID NO: 10156 - DNA, 218 bp, Homo sapiens
ggcacgagtccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttac

SEQ ID NO: 10157 - DNA, 210 bp, Homo sapiens
ggcacgagccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccactgaggcggctcccagctgcgttggcgacatggccgaca

SEQ ID NO: 10158 - DNA, 466 bp, Homo sapiens
  misc_feature 372: n = A,T,C or G
ggctcgaggagagagagagagagagagagagagagagagagagagagagagagagagagagagagagagagagagagagagagagagagagagagagagagagagagagagagagagagagagagagagagagagagagagagagagagagagagagcgcgcgggcgcctctctctctttttctgtctctctcgcgcgagatatttgtgttctctctctctcaccctcttgtgggcgcgcgcccccccccccctctctctctatttctctctgtgtggcggcacacagagtatacactctctccccatcatccttctctcttacagaggggcttctttttctttactcacactctctcacgggaaatttttnttttttgtttttttgcccccggggctccctatttttatattatacccccccccctcctttgtgttttttttttccccgcccgaaattttttttt

SEQ ID NO: 10159 - DNA, 467 bp, Homo sapiens
  misc_feature 421, 452, 467: n = A,T,C or G
ggcacgaggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatntagtttcctgttgaaaggtgctttttctggngtgactaaacctatn

SEQ ID NO: 10160 - DNA, 444 bp, Homo sapiens
  misc_feature 310: n = A,T,C or G
ggcacgaggtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgccaaatgattgagaggcttttggggcaggcagaccgtaacctcctgacttctttgttacctctggattactttagcaggaattggaggtcttttaagagaagtaagcttcagttntatcacaacaaaacaatattcctgcttatctgaagaatgcagcgtggggcaaaaaaggctggctataataatgcctcatattgaggggctggaaacggtggcacttcaggcctgagttgtgagagctctggaag

SEQ ID NO: 10161 - DNA, 437 bp, Homo sapiens
tctcaagccactcgttcttttttttgatccctcccttcgaattcggctcgaggagagagagagagagagagagttttttagagagagagagagagagagagagagagagagagagagagagagagagagagagacagagacagacagagactgagagagagagagagagagagagagagagagagagagagagagagcgccctctttttttttttctctctctccccccgctcactctttttttctctcgcgcgccctctcttttttctatacattctctgtgtatatagagacagtgtctatcctttttctctctctctgtatatgcgttctgtgtgtgtgttatctctctctcacgcacacacagaacacaccccccctctctgtctgtgtgtctcttttttctttttgccctctctctctgtctctgcttaacg

SEQ ID NO: 10162 - DNA, 440 bp, Homo sapiens
ggcacgagaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctcccta

SEQ ID NO: 10163 - DNA, 437 bp, Homo sapiens
gattcgaattcggcacgagcaagctgaagcacaagcatggccttgtggagcgggcgatggatgactacagtgtgatcggccgctccctgttcaaaaaggaaaccaacatccagctcttcgtggggctcaaggtgcacttgtccactggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaaagcgcatgggtcagtctccctgagtgtcccggtgacctcccccaggcctcctttgccc

SEQ ID NO: 10164 - DNA, 438 bp, Homo sapiens
  misc_feature 406, 438: n = A,T,C or G
atcgattcgaattcggcacgagccagcaccggaccacctgctccaagaccagcctcctggggggaccacgcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactctttaccgctagacagcatncaggccatgaatgtggggctcaacacatgttn

SEQ ID NO: 10165 - DNA, 431 bp, Homo sapiens
  misc_feature 114: n = A,T,C or G
aacgttaatagagcctctggaggattccatcgattccaattcggcccgagagagaaacaagggagacaaggttgcccatacaggtgcggggctcagccaggaggcagaaaacgnggacgtgtcccgggccaggagggtcacagatgcaccacaaggcactctgtgtggcactgggaacaggaattctgggagtcagtctgcaagggcggtgggcgttgctcacctgggagaagcctttagagtgggcgttgagcaggccattagctcgtgccctgaggaggtgcatgggcggcatgggctctccatggaaattatgtgggcgcaaatggatgtggctctgcgctcacctgggcgaggacttctggccggtgccggggcactctgcatgaccctggcagaatcgagctgccctgactatgaaaggggaagaa

SEQ ID NO: 10166 - DNA, 428 bp, Homo sapiens
  misc_feature 318: n = A,T,C or G
ttcggcacgagattagacgggagatagataccaatgatttagatggcacaggaagagcaagttctggatataataaatgagggtactttccgtcaaagcttttctatgtctatatttatcactgaatagtcccagtatggttttaaagcaagttttatgaatctcatttgcctaacaggaatctgaaatataacttgccaaaaacacacagttggtgtggaatggtcattagaacctggggctcctcttcacggactccctgctcattaagggattcagtggtccagagtctaagatcctattaagtgtttgattcanacctctacccgaggaagggctagtaccttactcctagtcctgtttcaagctcattcctgaaattccaggctggttctctagcacctatgtgtgttacaagaaggcacgtg

SEQ ID NO: 10167 - DNA, 427 bp, Homo sapiens
  misc_feature 249: n = A,T,C or G
ggcacgaggctgtgcggcagggcgcacgggacctgtgctgcagcggctctctcacgccgtgggtcgtcgctgcagctgccgggaaagaaggaaacgacgactccgggggcgaacttggcacacagggaggaagggaaagggtgtgtgaggagggctgtgggtatatttggcatcagggagaaggacctcaaaacttgtttttcatatagtactagctgatcgtcgggtttttttttgttttggcttggntttttttttttggaaggacaaattttggaaaccccgggaatccccgttttggagtttctccccgttttttgtcattaatccaaaggcctgaagggacgggccaggggggctgggattttgattttaggagtgaaaaccccttgggaaaaccccccaaagggaaaaaagggacggtggg

SEQ ID NO: 10168 - DNA, 428 bp, Homo sapiens
ggcacgaggagagagagagagagagagagagagagagagagagagagagagagagagagagagagagagagagagagagagagagagagagagagagagagagagagagagagagagagagagagagagagagagggtgtgtgtgcactctctctctcgctctctctctctctctctctctctctctcacactcacatatcacgcgcgctctctctctctctctcctatatagggggagcgccgcgctctctccccccccccctcaaaaactttttttttttctctctatatatatagagagattttttttttactctctctcttgtcgcgagagatcttttttttttatatatatatactcgggggtgtgtgtgtgtgtgtgtgtatatgtgtttttttttttaccccccctttttctctctctttt

SEQ ID NO: 10169 - DNA, 428 bp, Homo sapiens
  misc_feature 335: n = A,T,C or G
gaaattttgcctttcttggaggtttttgttctgatgtaatggtgaaaggtaattctatcatctctgcatgacacagctatttttgttgcttcagcaagatttatcaaagcaagtggtttttgaccattctttgtctccaagggagagacaattgtggcagcatcccatcctctgagctggtttttgtttttgttttttggagaataagtggttttgattacaggtgtgaacttgtggtattcacagatgttggtggcctgtcaggactattttaggagacctcatttatcctttgaccaagaaatatcctgactggggcctgacttgaatatatnagctccttgtggggtgatgccaaggctcccttttcagtataactgctcaaggaaacaaagagttcccagagtctgtggtccagacctacactt

SEQ ID NO: 10170 - DNA, 429 bp, Homo sapiens
  misc_feature 401: n = A,T,C or G
ggcacgagccattttcttccatcagctaaactttacagataatagtgtttccacctcatatccttttctttgccccttctcaaatgagtcagaatagtcatgttccccttgagggatgtctgacttgaatgtagaattgttctttcctctcttgaatcagctcactagctccctgatggtctgggttcaaggaaatggttaatgaggtagaggccacttatacaagtccttgggattgtaccattgctgtccacaaacttagtatcaacaacacatgctgtgccctgtgaacactctcctctcacctatttccagggttgggcttcctgagaaggggatggatgaggtaacacacagtttgggatacgtatctgttgaatgaatgaataagtgaaaggatnatagtcctctgaggtacacatggcttgg

SEQ ID NO: 10171 - DNA, 427 bp, Homo sapiens
ggcacgagagagagagagagagagagatagagagagagagagagagagagagagagagagagagagagagagagagagagagagagagagagagagagagagagagagagagagagagagagagagagagagagcgctctctttctgtgtgtgagagaaactcccccccccctctctctctttttttttgtccccctgggagcgccccccccacacatatttgtgctcacgcgccccccgagctctctctctctctctccggtgggagaaaaatttttttatctactcgcccccgcccgtctctcttatagatatttttatatctcagatagcgcgcgctctttttacactctctctcttcttttagaggggggggagagcgcgcgcgctctctttctccccccctctctggtgtgcgcgcgacacg

SEQ ID NO: 10172 - DNA, 428 bp, Homo sapiens
tgcacgaggggcattagttcaggcattaatatgaacaactgacccaaagctctgcattactagggtggaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttggttcatatgcccttggatgaatgtgagg

SEQ ID NO: 10173 - DNA, 422 bp, Homo sapiens
  misc_feature 422: n = A,T,C or G
ggcacgagcagaactggcggtttttcccagctccttgcccagaccaatacttccatgctgtcttcaagccctgcttcctgcacatctcccagcccagatggggagaacccatgtaagaaggtccactgggcttctgggaggagaaggacatcatccacagactcagagtccaagtcccacccggactcctccaagatacccaggtcccggagacccagccgcctgacagtgaagtatgaccggggccagctccagcgctggctggagatggagcaatgggtggatgctcaagttcaggagctcttccaggatcaagcaaccccttctgagcctgagattgacctggaagctctcatggatctatccacagaggagcagaagactcagctggaggccattcttgggaactgcccccgccccan

SEQ ID NO: 10174 - DNA, 419 bp, Homo sapiens
  misc_feature 201, 233: n = A,T,C or G
ctgagacacatatagtagcaacttactagacctgcttgcaggatcccatcgatgacgaattccgttgctgtcggtgatggtaactacatcactaggtaggctggggctggaggatttcttgaccccagtagttctaagctgcagcaagctatgatcatgccactgccctccagcctgggtaacagagcaagaccctagctnataaaaaaaaaagaaaaagaaaaaaaaaaaanttttgggggggccttttttttctgtaaccacaattgaaaaaattgcttggggtgtgtggcaacccccccaaaaaaagggggggaaaaaaaggttttttttggaaaattggggggcgtttggtttttttggaaaccatttaagcgggggaaaaacaggttaacaacaccggtgtctttttttttttt

SEQ ID NO: 10175 - DNA, 422 bp, Homo sapiens
ggcacgaggagagagagagagagagagagagagagagagagagagagagagagagagagagagagagagagagagagagagagagagagagagagagagagagagagagattttttttttttctctctctataaaaacccgcccacgtgcgtgtgtgtggggggagacacacaaaaaacacactacactctctttctctctgggcgcgcgagagagagaaaacacgggggggggctgtgagaacacactcttctcccccctgtgctttttttttttttcttagtaggcccacacaagatatatacacactctctctctttcccccctctcgtgtgagaaaaagcgcacagacacctctgtgctctctatagaaaaccacgctctctcacccccccccccccccccctctggtgtctgtgctt

SEQ ID NO: 10176 - DNA, 418 bp, Homo sapiens
cgttgctgtcggtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaatttgtgaaggccccaactgtgccttctgccacaggacaaccagcaagatctatgctgagccttagccctccagggtataagctccctgcaggtcctcctctccagaggcaggatggagagcacttggctggtccaaacaggcttggaggtcccacctacaggtgctcctctggaatcttggctaaaactcattaaa

SEQ ID NO: 10177 - DNA, 420 bp, Homo sapiens
  misc_feature 420: n = A,T,C or G
gattcgaattcggcacgagcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactggggagcccagtggaggcgccctcccgaagcgccactgcccatgctgaccacccagccctccggctgctgatgtcatgagtaacaccactgtgcccaatgccccccaggccaacagcgactccatggtgggctatgtgttggggn

SEQ ID NO: 10178 - DNA, 421 bp, Homo sapiens
  misc_feature 381: n = A,T,C or G
cgattcgaattcggcacgaggggacacaggcagggacgcgggagctgatgcggctggaccggccggggaaacagtattttctggaagggggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggggaccacgctgctgtgaaaggcctcagcgctctggccgctgctgcctggtgcngggacttcccagctgccgctgacctaggtgcccgcacgcc

SEQ ID NO: 10179 - DNA, 421 bp, Homo sapiens
  misc_feature 421: n = A,T,C or G
attcgaattcggcacgaggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcan

SEQ ID NO: 10180 - DNA, 411 bp, Homo sapiens
cgttgctgtcgggcaagtcctgaacctaagccgagacactagtccatcatctccagcaatgaatgtcatccccccagacttcagcatcctgagttaattaaaaggtgcagatgaagttaatcaagtttggaactctaattttgtgcagtgttttgatacgatttgatgagtcatcttttggtagagcacctctctatccctgacagtgtttgatcttaacggaacagttttataatgtgtaaactggtgggaggtgctcttcagaaatgcagtcaacagtggtatgtgtgcgtgtttggctcttggggcggggcggaaagcagaacaaaggagaatttaataagcgagaacttgtcaggggctagggtcagttctgaggctgctgcctgtcaagaacatggctttcttcct

SEQ ID NO: 10181 - DNA, 414 bp, Homo sapiens
  misc_feature 393, 403, 414: n = A,T,C or G
ggcacgagtgagataggaccatgtgctttgagagtgtttagtatcttaaaactcctgtacaaatgcatagcaccaggcagacagtaggagctcagtttacagcatgaatggtgggtgctcttatactcagaattccatctgctcctcccagtgccagactccttcctcgaacccagagccttctcccatagtatctctttagcctcttgggaactctggactgctccccactgaatgtgccaacgcccccactcaccactgcctggctttcactcccagtgtcatggacttggttccaaagggctttgagaacctcacaaaaaaacccactccaaatctttgagggtctaaagggaagaattctgccccttcccagagacccatctactgtanggacaggganaagaagactgn

SEQ ID NO: 10182 - DNA, 413 bp, Homo sapiens
  misc_feature 194, 359, 413: n = A,T,C or G
attcggcacgagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggntatcagctgtgttctggtgctggctggcatccttaacatgatgctcttctacaaactctggatgttggaatacaccacgcagaccctcactgcctggcagggtctaaggctccaagagagttaccccagtctcagacagaatggcccagctctagagtcccacanaagaccacgatactgagctcaaaatggagggaatcatcaaatctcagtgtgctn

SEQ ID NO: 10183 - DNA, 411 bp, Homo sapiens
cccatcgattcgaattcggcacgaggggggacatcacgctgctattccgggccagcgtgaagaccgtgaagacgcggaacaaggcgctgtgagtggcggagggcggcggggtcgatggcaatcgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatggggggatgacagacacagaacgagaccagatagaccaggatgcccagatattcatgaggacctgttcagaagcaattcagcaactacgaacagaagctcacaaggagatacattcccagcaagtgaaggagcaca

SEQ ID NO: 10184 - DNA, 414 bp, Homo sapiens
  misc_feature 366: n = A,T,C or G
tacggctgcgagaagacgacagaagggatacttttaaataatctgtctcacttactgaaagaaacacaaaacgcacaaaatatgaaagctaacacctgccctccatatatcatcttcctatgtctcccaccacaaccacaaaactacttccagagaactaaatttttattgacaatggaaatcaaggtaaaccctggaatttttcctattccattctaactttaatggtttagatgactacagacatgttctcacagaccccacatatctttggatcctcctactaaaggtagggttagtaaatgtcccatccttgggacataatttactcagttgattaaaatactgggcttcgccagagttggnttggcagatctagctaaactgataggtttccttttctttctttcccat

SEQ ID NO: 10185 - DNA, 411 bp, Homo sapiens
ggcacgagatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctg

SEQ ID NO: 10186 - DNA, 405 bp, Homo sapiens
ccatcgattcgaattcggcacgagccctccagccactgctttatactctccttctctggttgaaatttttgaagtaaataggtcactctgcccatcgttcatcttccagtcactctgtgtgtttatcttccagggaagtgaggctctatgctaccaagccactgaaataatttttttttttttcaaaactccatctcaaaaaaaggagtatgtatttacaaaaattacccaggggggggggcacacacctgtagtcccacctacttggaaacctgaggcggaaggatggcctgaccctgggaggtcaaggctgcagtgacccaaaatggcacccactgcactccaaactgggtgacagagcaagaccctgtctcaaaaaaaaaaaaagtttgtttaatttttcaa

SEQ ID NO: 10187 - DNA, 410 bp, Homo sapiens
ctcaattccgttgctgtcgctgaaaggttctggggaaaaaaatttttcttaaagcgacaagactcttagatctaaaaggaaactgacttgccaccttgccacaggaattcttgaaatgtttctgcagccacttggccttgaaaataaagggtgcaactctcaagtcttgttctaacccggctggaggaaccacaagacccaatgaaatagcattttctctccttttcccagcactagtatataacctatgaggaacccttgtctctgaatctgctcagcttgaaattttgtctctgaaggaagagaatgaactcagccctagtctgacagtcctagatttctgtgaaataagagtattctctaacttagtgctcacactcacataccatgagggttctctgcaggggttt

SEQ ID NO: 10188 - DNA, 405 bp, Homo sapiens
ggcacgaggaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggcgttttgaagagaatggagtggctcttggaactgatgggttatattagaaatgttgcttaccagtcaacatcctttcacaatacggctcttgacgaggctttggacttcttcttgctgatatttgcaaccgcagtggttgcatgggctgaccacactgcccctctcctcctcggcctcagtgccagttggttgccatggcatcaggagaatggcccggctgggccag

SEQ ID NO: 10189 - DNA, 406 bp, Homo sapiens
cgttgctgtcgctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctccc

SEQ ID NO: 10190 - DNA, 405 bp, Homo sapiens
ggcacgaggagagagagagagagagagagagagagagagagagagagagagagagagagagagagagagagagagagagagagagagagagagagagagagagagagagagagagagacagagagagagagagagagagagagagagagagagagagagagagagcgctctctcttttcccctggtgtgtgtgtgttttttgtgaggcgggcgccccgctcccattcgggcactcactccccgaggtgtgtattgattgctcacactcacggggtctctcacactcgcgcacagatttatttattctgcgcacggggcgcgcttgccatagtgggagtccttgatttttatttcttctcttttgccatttcccctcagggggggggggagggactgcccccccct

SEQ ID NO: 10191 - DNA, 408 bp, Homo sapiens
  misc_feature 385: n = A,T,C or G
gaattcggcacgagagggaccctgccttgtacccacatcactgggctctgtgctgaccaccagacaggaggaggtcctagtggtgagcaggggcaggacatgcatcttctgggggctgcagggaggcaggggtagagcttgatgccatggtggagtgtaggagaggctcagagacaaggagactcatgagaccaggctcctggcgtggccatgggcatcagcaactgccccggtgacacagtcctcttcctcagctccactctgactctgaagcactgactacaagcacctcttgggggtcacggctgtttcgcacacacaaatccaccaaaggagagattgcagggccagcatcctgagccccacctgcaggccctgggcgctntcctcctggcagctgtgccccca

SEQ ID NO: 10192 - DNA, 405 bp, Homo sapiens
ggcacgagattttattgcatcaaaaattgagcattgggaacaaagttggggtcaagaggaaagaatgcgtgctggttttgttaggcgttagtataccggttttttgtggcctctccctcccacactggtaattagagaaagataacagtaacttcggtttagtttttgtgaaacataaaagtcaattctaatagggcagtcgccagaagtagacctgtctaggcactaagggagtttggggaaagccaaagaagacctaggccatagagcacagtggaacgcaggtgagaacgcagggaaagagaagtaaagagtaaagccagaggccattacctgaaatttccagattgttctatgagacaggtatgtcagaggaccgtgtctcaaagaagtggcattcttctg

SEQ ID NO: 10193 - DNA, 407 bp, Homo sapiens
ggcacgaggagacgtgctggtcagcatgtacagttcagaggaagggacgctggcgccccaggaacagctctttggagggggtggggagcagggccggaaccttgctggcgcttgagccgattcagatctgattgagtcatgttggcaagagctgggtctaggaccctcgggtggggactggagtgttgagcaggtcggggcctcagcctcccttccggtccccagggaggctgttccatccgctcctgttcacggctgggcgctgctgagccttttctgtcaacatctggctgggcttctgaacctggctttcctttgagaatgaacctaagagagctgactctaaggaagaccagagccggccgctccagggcagaagctgagacttcaagcgagctgttaactca

SEQ ID NO: 10194 - DNA, 407 bp, Homo sapiens
ggcacgagggttggctctttagggcttcaccccgaagctccaccttcgctcccgtctttctggaaacaccgctttgatctcggcggtgcgggacagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgat

SEQ ID NO: 10195 - DNA, 407 bp, Homo sapiens
  misc_feature 391: n = A,T,C or G
gagggcttattactgtcgtttatacgctatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcangcaggcccttggtggt

SEQ ID NO: 10196 - DNA, 403 bp, Homo sapiens
cgttgctgtcgcttcattacaccatctatttcataggatagttgtgagaagtagataatatgttgtaaagtgcctggtatgcgataatcactcaataaatgttggttctcactaccattaacagaaattctcagaaaaggtagttattttaaggacaagacaataggttgttttcaggcttcaaggtgatgaaatacctccaagtaggtattttcatcaggcaattggagagtgactcattcattcaagaagtttttaactgtactttgtgtcaagtatgtgacaccagagctcacgggagattcagaaatcattgtcaataattaaagttgtgaaaaacgggaagagcagaaggccaaagaaaatgacttataaatgaaaacaggagaatcaacaatggaag

SEQ ID NO: 10197 - DNA, 398 bp, Homo sapiens
attcgaattcggcacgaggctaggaccttaagaaggagctcatgtgagtcaggaccctgaatgttaggcctcgttagctctatggttcatatgcttcttgaaccaagtcacagggcacttcccagccacattgccaggcaacaggactaaactacctccaaagcaagcagtcttttcagttttgactgagtgatgtgagaaacttcttttcttttcttttcttttttttttttggaaacagcccccttatgccccccaggtgggggggaagaacccaaatttgggttaatggaaccccccccctccgggtttaaggaaataatcctgcctaacttattgggaaggttggggcagaaaaatggtttaaccccggaaggggggggttgcagaaccccaag

SEQ ID NO: 10198 - DNA, 400 bp, Homo sapiens
  misc_feature 23: n = A,T,C or G
ttttctggtccacaccggcccgnataatcctaactactatacacagcttcttttcagcttaatgaaaagatcattgttctgcactacacataaattacctattttatagaaaagtctgtgattacaatagctattttcccagcctccttcatcacctccttgatccccttatcctcccctcggccctgcacctcctctctttcctgactcccacaccagagctaggcctgccctgggcacttttgcctccaggaatgaatgaggctcacagcccgaaggtgctccaagtcttggctaccttccctcagtggctgccctggcaaaggtcctgccgcagggaatcacacaaagtccagcaaagcaactggtctttcctgtccattctcacccttcccaagac

SEQ ID NO: 10199 - DNA, 399 bp, Homo sapiens
ggcacgagatgcactcagcggccctgactgggagagtgactggattgatacaaccatcagttctattcagattatggaaatccagcaaataatagatcatcagtattgcattcaaagcctccagtgcggatctggaaattataattacaatattcctgttaataaacacacacccaccaatgtcaagttctctctggaaataaacacaacagagccattgatagtcttccagtgcaaattcacccttggaaatatatgtttccatagtaaaaggggaaccaaagggctggaaagccacagagaaatctcccaggagatgacacagggatatcagcacatttggagcctccctgtagccccattttctgacagcatgttccatttccgtgtagctgcacc

SEQ ID NO: 10200 - DNA, 402 bp, Homo sapiens
atcgattcgaattcggcacgaggcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagattacgtttcttcaacagctttgcagctcttcatctgcctgcttttcagtctattgtaggggcagagggcttgtcccttgcattccggc

SEQ ID NO: 10201 - DNA, 398 bp, Homo sapiens
caaaggagatattctttcactgtggggcccaaattgttggaatgcgcctgaaaaataagggctctcactgcttgagcaaacccttgggtgcatttggcctcagggcctggaagacgacagttcaagaaaccacaggactccagcaatgagctgctccccttgctgtgtgtgtgtgtgtgtgtgtgtgtgtgtgtgtgtgtgtgtgtgtagggagagggatggcaagtaagaaaagaatcccaagaaaaataatgcgcatgtgcaaacgccctgtcgcaagaagagccttgtctcctggaggaaacataaaaaagctgaggtgtcgggtgcgcacaggggcttatgcctgtaatcccaacattttggggggctgacaccgataaatcaagagttcgtcg

SEQ ID NO: 10202 - DNA, 404 bp, Homo sapiens
  misc_feature 404: n = A,T,C or G
ggcacgaggcccagcgaaaagcaacaaccccaagactgtgaaagactaacatccattctgaaataggagataacaaggctgccatggatctgaacaccaccttccttgagaacagccaggagcccacttggattcaagagtgactttgaacttgttttcacacctccaacagactctcattaagattcagttatttccgctccccagccccacactcctttcagattatcgttcatgggcgtaagtctcttctcagagttaacaagtctttggtagtcatcctctgtccaaatattgtatattattaaaaggcatttttaataattaccagaattagctcaaacctttagggatctttcagccatgattattaaggatatgtatgtgaatttttgggaaacctn

SEQ ID NO: 10203 - DNA, 404 bp, Homo sapiens
cgttgctgtcggaataatggaacaataatgagaggaaagcttaatcattggaaatgtacattattcctgctttgtggattatttgcatcagagttttaaattatgggttgatgatttttttttttttggctatcttaaccctcccattttttccttcttttcccttcctccgagtggaggaacccttaaggatccaaccggtttttaattgaagccccccttcccaccgaaattggcccagggggctattctggtttttccgatttttggggggattggctattttgaaaggctttggctacctttgggaccctatcccaaaatccataccctttagttctaaggtggaccatttaaaggggccacaaattattcattccaggataggggaccctatacaatag

SEQ ID NO: 10204 - DNA, 402 bp, Homo sapiens
cgaattcggcacgagcctgagaaaagcaagaaggaactgaaaagggaagcccggaatttgctcaaatctcatcttaaccttgatgacaggcgttgggcgatgcagaatttttctcctcagtgttccattgtgttgctagaacatctgaaaactgccactgtaaacttcataaccagctatccgggttcatcctacatttttgtgcaagagagtccaactccccagattaaacctgaatatttagccttgaggtctgttggcatcacaagagagaaaaaaaggaaaggccttcacttaactgagagtaccctttcagccctggaagagttagtcaatgtttcctgtgaagaagtaaatggctgccctgtcattctagtttgtggatcccaggatgttggaaag

SEQ ID NO: 10205 - DNA, 400 bp, Homo sapiens
  misc_feature 400: n = A,T,C or G
ggcacgaggtttgcagctgcggcggggtcgggtccacccgcggtccccggaatgccggacggctgatcccgggtgctggtcactcgccgattcggggctgggaaggtttgccagaagcgggaaagatgggagatctgagcgctctcttggcatcgccacacccaggacttgctcgtgccgcaattccccacggaaacaaccgagttgaaacgagaagcttgctctctgggtgcagtagctagaaggcttcaggtaactccaaagccaacactgggtgaggcaacacacgccgcctcaggactcagcatttctttcaggctgcgttttcgtggcagacctacccagattgatggagaaagtttggctggcggataagaagtaacgcggaagatgtgtacgn

SEQ ID NO: 10206 - DNA, 401 bp, Homo sapiens
ggcacgagggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacct

SEQ ID NO: 10207 - DNA, 403 bp, Homo sapiens
  misc_feature 403: n = A,T,C or G
ggcacgaggagtggcatgcagggcccctgccatgggtgcgctcctcaccggagcaaagcagcatgataaggactgcagcgggggagctctggggagcagcttgtgtagacaagcgcgtgctcgctgagccctgcaaggcagaaatgacagtgcaaggaggaaatgcagggaaactcccgaggtccagagccccacctcctaacaccatggattcaaagtgctcagggaatttgcctctccttgccccattcctggccagtttcacaatctagctcgacagagcatgaggcccctgcctcttctgtcattgttcaaaggtgggaagagagcctggaaaagaaccaggcctggaaaagaaccagaaggaggctgggcagaaccagaacaacctgcacttctgccn

SEQ ID NO: 10208 - DNA, 400 bp, Homo sapiens
ttcgaattcggcacgagaaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagaggcctactcaccattatccctgcagcgtgacaccttttgattgtcactgaccactcagaaggggccacggcctcctggctgtgttcctgagcccccgtcgtgcctctcccagacagcagctgtctggcccttgctgggtgagggcacaccactgccaggggtcaagctcgcacccaggccaggcagaagctgtgctctgaaactaggacagctggctgagaagtgggtt

SEQ ID NO: 10209 - DNA, 399 bp, Homo sapiens
ggcacgaggcaacactgagtgctatgaacaaagataaagtgggcaatggaatggcatgttgggtgttgactccgagaaggtgttcagaaaacctctctgaaggggcagcatttgggcagaggtccagactgtgtccaatggcagaaaagagaatgcttgtggtcccagaagtggagcaagctttgtgagtttagagagcagcaagaagccagtatccctgggaccggggagctgatgtgggatttgtgtacccacaaacacgttctaggtgctaaccagaaaccctccatgtgagagcagagaccttggagatcctgagggtttctgctgagccctggaatctagtcacgctattttgatagcagaatggatgagagaatttaaggcccagggccagat

SEQ ID NO: 10210 - DNA, 402 bp, Homo sapiens
ggcacgaggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtcttt

SEQ ID NO: 10211 - DNA, 402 bp, Homo sapiens
ggcacgagggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaaggga

SEQ ID NO: 10212 - DNA, 400 bp, Homo sapiens
  misc_feature 400: n = A,T,C or G
cgttgctgtcggcaaatgtcagcgccagcccagtcaaaagagcttgaaacctaccaagccggaggactgtgctgtgcctctctcgcccacattttccccaagcactctcaggaacctggcaacagtgtccccttgtggccaagcctggaacatcacatctgtacgttgcaatctgtggatcagctacgagaaaagtatagtaagaagaaactgaatttgaagtggattcttacaaaggaaaaagaaaatcactattgtaactataccaaattactatattatgtgatgcaacaaaattcaaatatgaaaaccatcttggaggccgggcgcggtggctcatgcctttaatcccagcactttgggaggccgaggcacggtgcctcacacctgtaatcccagn

SEQ ID NO: 10213 - DNA, 399 bp, Homo sapiens
  misc_feature 397: n = A,T,C or G
cgttgctgtcggtgattcttctgcctcagcctcctgagtagctggaattacaggagtgtgtcaccatgcccggctaatttttgtatttttagtagacacggggtttcaccatgtcggccaggctggtctcaaactcctgaccttgtgatacacccacctcataattttaaactgaatctttcttgtatcttcagtcccaggcaggtgctggagcaggagataggctcctacaagcttagcaacttctcatttctatgtaaactcaagtttggtcaggtctatattttcccacaaggactgctctgtggtctatcagaagccacctctcctcattgcttagctggactctggttttgcccagtaaaggctgtgctacaaaggagctaggtcagcctangc

SEQ ID NO: 10214 - DNA, 399 bp, Homo sapiens
  misc_feature 163: n = A,T,C or G
ggcacgaggtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactanatacagatcataacattcagctgttttaaagtgattaacgcatttttggaaatttacagacttggtcaaccacaaccacagctgatttaaaacaatttcatcaacttcaaaaacccttgtggcatttggaaggctcaaaccatctccaaccaatctggttctattgactggcttttcttgccatttcatataatagggaacatatgacactggggttcctcattctcgaacttttc

SEQ ID NO: 10215 - DNA, 398 bp, Homo sapiens
cgttgctgtcgctgcctcttaggggcttgagattaggtgatggggcagttgttttcaattcaggagctactgccaaaagaggggtaaaatagatactgatcaatagtcttgggtcattgattttcttatctgaatttagtgtcaaaggagaagcctttcagcatgtggtattttaaactgagtgccaaattgtggtcactttggaaaccacatttaaaagatgcatcctaaccagtatttccatgttttttaaatacctgatattagatttgtaccatttgtagaatctatgttattaaggcagatttaatcttgaaataaattaatcttcatgtgcttctgagacttttttttttttttgttaccattaaggagttttcatttcttttgtaaaccag

SEQ ID NO: 10216 - DNA, 399 bp, Homo sapiens
  misc_feature 67, 68, 69, 399: n = A,T,C or G
ggcacgaggagagaactgctctcgagactagttctctcagagagagagaactagtctcgagagcagnnntttttttttttttttttttttttgaaaaaggaattccctttttgccccccacccgggggggaggggcaaaaatttgggttcctaaattcttccccccccgggtttaaggggagaaccccccctccccccccaaaagggggggaataataaccggggcccaggaccccggccctaaactttccctttttaaaggggcccatcccaggggttttaaatattccaattggggggggcaccccaccccgtggtataatccaagaactttttggcccccccaaaaaaaacccccggccttttaaccacccccccccagtttttcctttcttggcn

SEQ ID NO: 10217 - DNA, 398 bp, Homo sapiens
  misc_feature 398: n = A,T,C or G
ggcacgaggtcacaggatctcaaggcctgcctgttggtggccctggttccttgaagctgagggtcagaacctctgtctctggctgctgcctcagggcaggggcctgggacagcccattgcaggccaggtggtcctcccaggagactttgtggggccgaggagaaggcaaagctgccttgcatttgcctggtgcctgctaagccccaagtccatccctcccctgaacaggacgctcgcagggccctgcccgtcagaatgcacgtggagtcctctgaggttcgggggtgtgggttgcacttgagggaccatcttcctggagatcccgtagggagttccctacaggcaggacctgaggcccagccccaggacaccaccccaccttcccggggcttgggaan

SEQ ID NO: 10218 - DNA, 404 bp, Homo sapiens
ggcacgagattaataagacagtcacactctgtcgcccaggctcaaaaaaaaaaaaaaaaaaaaataattttgaaaaattgggcccccttgggggaaaagaaatttttaggattaagtttggaaaaacccccaatttttgccaattttaaaccccccaaggggggggggaacatggaaaaaacctgggaaccaggttaaaaacaagggggggatcccggtaaagggtttcttttaaaaaccccattttttaaacttgggttggccccccccacttttgaattaaccccccaaaaaaaaatttggggaggatttttgccgggacctaaaacccgggggggaaaaccaaaccccccaaaattttattgggaaaaccctgggccccatttggagggccccaaaccccc

SEQ ID NO: 10219 - DNA, 404 bp, Homo sapiens
  misc_feature 93: n = A,T,C or G
ctagggacgagccgcgaccaggaccggaccgtctaggtgcagagcaaggtccgagggggaccgccgcccgcggcacgtcagctgccaccgcancagacccagaggtaccgagcgccaacgtgtgcagagcccagcggcggagacatttacttgcgccggaaggagtactcccataacctcacctcagagcccaccctcctgcagcacagggtggagggggccgaggacacgtcttcttcctcttctgcttttctctacccagcacgcctgtggtccacctctctgagctttctcccagtcctaggactccccctctccctgcagcacttgatgacatgcaagcaggggagtcagagagtccaggggcccgaggatgccttgcaaaagctgttcgagatggatgg

SEQ ID NO: 10220 - DNA, 401 bp, Homo sapiens
cgaattcggcacgaggaaactgcttctgaaggaactctggctctgtgtaaacacaacacacagactacctggtgaaggcagcaggtgtgtcccaaaaaaacctgccaaagcaatcaccagctccagagtgcctggggaagatggtacgctacctccaacacagggcagccctctcaggacctcaaatgtgcagacatgcctcacaaaactgtccatggagataaaggaggactttttatgtcaaaatgtggaaaaacagagctccagtggaacaaattgtagttctgaccatgtttttaatgagaatggaaatcttgaggttttagtacaaagtcatcgtgacggtggtagtactgaatttgttgatcatgatcatttttttgatgaagatcttcaagctg

SEQ ID NO: 10221 - DNA, 400 bp, Homo sapiens
attcgaattcggcacgaggctttccccagggagggccacagggggcactatgtgctagagggaaagtcttgtctgaggagggtggagggggcacagggagggtgcatatgggaggcagtggagatactgagggctgttttctgtggtgggtagttcagaggtgtatagggcaggtttgagaatgtcaatcacaagagaacacaggaaatgtgagggctggtggcaggaacgcctgttgcaaggggtaatggtgggtggtagagcagaagcgtggaaataattggtctcaagtctctgacagagctttggtttaggtgatttctgccctaagaatgttgagatcacaactgtctgtgcatgggggttgggggattatatgtactgacgggtgtatacatat

SEQ ID NO: 10222 - DNA, 403 bp, Homo sapiens
cgttgctgtcggggtcctctgcatcctcactctcccccctagcccaggtgcagccccgggaggggtgccctgaccccgccttaaacaaccaactttcccaccgaatcccatctggcggggggggggtttgggtgccaagtgccctggaaacctattgtcttttggctcagccaaaagaaacattccctccttcctttccttccgggcttgggggaaccttcgtaaaaatcatagttagggttaagtccaagcagtgaggcctgacctgggctctgctctccttgttgagacactaacaggcagttgggaggaaaatctgcatttgactccaccctctttggggcaaaggagaagcaggtgacccgagggggggcaggccagaggagggcgactcgtgcacagg

SEQ ID NO: 10223 - DNA, 401 bp, Homo sapiens
cgttgctgtcggcagaacgaggccagtatgatcaatgggctgggggcagcagaggcattcccctctggttgtacagcgacagctgggagagaaggcagcagccctgaaggcagtaccaggaggacgatcgaggggcagtctccggagccggtgttcggagatgctgatgtggatgtgtctgcagttcaggcgaagttgggagccctggaactgaaccagagggatgctgcagctgaaactgagctcagggtgcacccaccctgccagcggcactgcccagagccgccgagtgcacccgaagaaaacaaagccaccagcaaagctccccaaggcagcaactcaaaaacccccatctttagcccttttcccagcgtcaagccccttgcggaatctgctactgg

SEQ ID NO: 10224 - DNA, 400 bp, Homo sapiens
attcgaattcggcacgagacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcg

SEQ ID NO: 10225 - DNA, 398 bp, Homo sapiens
  misc_feature 398: n = A,T,C or G
cgttgctgtcggcagaacgaggccagcaagaccaatgggctgggggcagcagaggcattcccctctggttgtacagcgacagctgggagagaaggcagcagccctgaaggcagtaccaggaggacgatcgaggggcagtctccggagccggtgttcggagatgctgatgtggatgtgtctgcagttcaggcgaagttgggagccctggaactgaaccagagggatgctgcagctgaaactgagctcagggtgcacccaccctgccagcggcactgcccagagccgccgagtgcacccgaagaaaacaaagccaccagcaaagctccccaaggcagcaactcaaaaacccccatctttagcccttttcccagcgtcaagcccctgcggaaatctgctan

SEQ ID NO: 10226 - DNA, 399 bp, Homo sapiens
  misc_feature 399: n = A,T,C or G
ggcacgagcggaagtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctan

SEQ ID NO: 10227 - DNA, 398 bp, Homo sapiens
ggcacgaggtcgcctttgcccgcgccccccgcctccccatcactggtctctacaacaagagtccctactactgcgggacttgtggccgctggttccgcgccatggcgggcttgcgactgcatcagcgggtccatgcccgagctcggactttgacgctacagcctcccagatcaccatctcctgccccacccccacctccagagcctcaacagactatcatgtgcacagagctgggggagaccatcgccatcattgagacatcccagccactggcgcttgaggacaccctgcagctgtgccaggctgcactgggggccagtgaagcaggcgggctcttgcagttggacacggccttcgtgtgacgcagctgaaaagcaacaacaaaagggtttggttgg

SEQ ID NO: 10228 - DNA, 401 bp, Homo sapiens
  misc_feature 269: n = A,T,C or G
attcgaattcggcacgagacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggngactacaagctcagcctggccggacgccggaaaaaactcttcaagaagaagtacaaggccagctatgtccgcagtcgctccatccgctcagtggccatcgaggtggacggcagggtgaccacgtaggcctgg

SEQ ID NO: 10229 - DNA, 400 bp, Homo sapiens
ggcacgaggatcttctgaaagctttgatttttctccaggcagtatgcatgcaccttccacctcctccacttcctcctcttcaaaggaagagaaaaagctcagtaattccttgaaaatgaaagacttttccaaaaacgtctctaaatgcgtcacaccagatggcaggaccatatgtgtaggggacatcgtttgtgccaagatatatggcttccctcggtggccagcccgtattcttactataactgtgagccggaaagacaacggccttttagtccgacaggaggcccgtatttcatggtttgggtctccaacaacatctttccttgctctttcacaactctccccctttttataaaacttccagtcacgctctaataacaagagaaagggcctgtatcgc

SEQ ID NO: 10230 - DNA, 400 bp, Homo sapiens
ggcacgagtgtccttccaccaccagcaccggaccacctgctccaagaccagcctcctggggggaccacgcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagggggccgaggacacgtcttcttcctcttctgcttttctctacccagcacgcctgtggtccacctctctgagctttctcccagtcctaggactccccctctccctgcagcacttgatgacatgcaagcaggggagtcagagagtccaggggcccgaggatgccttgcagaagctgttcgagatggatg

SEQ ID NO: 10231 - DNA, 404 bp, Homo sapiens
gaatacctggtccacgtggccccacactgcgccaacttcctagtgccctctcagaacctacacctgaccctggccctgctgcgactggcaggcgctggggaggaggccgctgccattggagctctgagacgggccctcttggccccggggctaaatgcaccccctcggctgagctttataaagctggtcctcctgggcccgcatgtgctgtgtgccccaccctctcccacactggaaagcatggcacaagtgctgagccagaggctggaagccgaggggctgagtacactacagtctccagggcagctgcacccccacctcaccgtggccaaggtgccccatggttcccaggtccacctccccaagctggagttcaccctcagccaggaagtggagtgccagcc

SEQ ID NO: 10232 - DNA, 404 bp, Homo sapiens
tgtcgggggaggcgtgggaggtattaggaaacggtttggattttgtgtgtgggagggtattttttgggggtagatgactgtcactttcctaagcgcttttattcctttcctttcttacaggactgcgcaggctttgcctagaaaaaccccaggcggatggcgggcacacacctgaggttgtagcccctttatctgccttcccggtactgaccccttgaccacaattctccctgaccccaagtgccacgcctcataccttgcacctaaccgattgccaagatccactactatgaagacaggctataacctaacgacctgcctggtccacccccggatactcacctttctcatgccacatgatgcgcgagcctccaacactgaagccaaagagctcaccttccttg

SEQ ID NO: 10233 - DNA, 402 bp, Homo sapiens
cattccgcacgagagaagagaaaacaaacgctgctaaggagttagaaaagttacagcacagttctgaaactgaactaacagaagccttgcataaacgggaagtacttgagactgatctactaaatgctcatggagaattaaaaagtactttaagacaactccaggaattgagagatgtactacagaaggctcaattattattataggaaaaatacactactataaaggatctcacagctgaacttagagaatgcaagatggggactgaagacgaaaagcaggagctccttgaaatggctcaggcacttaaagagagaaattggtaactatagcatagagcatctcaggctacacatttggatatgactattcttgagcacagaggagaaatggaacaaaaag

SEQ ID NO: 10234 - DNA, 398 bp, Homo sapiens
  misc_feature 347, 366: n = A,T,C or G
cgaattcggcacgaggccaggggctaaatagttcattgcaggagcactgagggctcagaaacctccagacagaactggcttggtcctgctgggcagagatgatgagcttcggtgtggccagaacggtgggggtcctgggcaccctgtgtcaccaatcccaggggagaggctgtgtgtggtgagccttgttggcactgcatcatgagccacgagcagggcgtggccactgttgtgcaggtgactccgccagggagccatggtggagctggggagctgggcctgtcatgcggtcccccggggagccgcagtggagctggggagctgggcctgtcatgcggtcccccggngagccgcagtggagctggngagctgggcctgtcatgcggcccccggcttct

SEQ ID NO: 10235 - DNA, 398 bp, Homo sapiens
  misc_feature 350, 371: n = A,T,C or G
ggcacgagctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttggcactcacttatctcagtggactccanaagccaaagctccgactactnagctctgtaggtccaagcctgtatacc

SEQ ID NO: 10236 - DNA, 400 bp, Homo sapiens
cgttgctgtcgcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggcc

SEQ ID NO: 10237 - DNA, 400 bp, Homo sapiens
ggcacgagccagcaccggaccacctgctccaagaccagcctcctggggggaccacgcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccat

SEQ ID NO: 10238 - DNA, 398 bp, Homo sapiens
gatagagaaaaaaaggcccagagagagtcccctcaggccaactttggttttcacttctcagttctgagagccgaggaagcaggaaggagctgtgagagactgagctctaaccttggccatcaaagacaagctgtgcagctctggttttttgagggcaggacatggagggtcaggcccagctggaggcgcaccaaagcccagagaaaattcagaaccacgtgaacttgttggatttcagccccttgaagcacatgttgctattgcagctgccttgataactggggggacaggaggagcacggctttcccatcttgtacggggactcgccaatccagttgcccctggaagagaaaaggacccaggagacagaggagcttaggactcattcaatctttatg

SEQ ID NO: 10239 - DNA, 399 bp, Homo sapiens
ggcacgagggcttattactgccgtttatacgcaatgcagactggaatgaagatcgagagtaaaactcctgaatggcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtgataacagtattcggagaactcactgatgaaaatgtgaaacacaggaagtatgccagatggaaggcaacatacatccataattgtttaaagaatggggagactcctcaagcg

SEQ ID NO: 10240 - DNA, 399 bp, Homo sapiens
  misc_feature 399: n = A,T,C or G
ggcacgagagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacgggaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaan

SEQ ID NO: 10241 - DNA, 391 bp, Homo sapiens
  misc_feature 320: n = A,T,C or G
ccaaagacagctcagacgtcaagagcaagacttacagacattagcacggctccatcttgtctctcattgacagtgaggccttctcttaccaccctattaaaatggcagctcctccatttatggttctccttacccaacctttcccatcctctttttctccataccactttaaaccatttcacttatgatatattttgcttatattgtgcattgccttttcttctccacctgatataagctccatgaaagcaaggatttttgctggttttgatttctgtagatttcaagcacctagtacaacagtgcctggcatttattangaacccgagtatttgaatgaactattttattaattgtagtctatacttggaaaaggtttaatttttttaaa

SEQ ID NO: 10242 - DNA, 396 bp, Homo sapiens
cgttgctgtcggtgggagatagttatattagctatcccacaggattgttcttatttttaagtgaaatggtacgtgtaaaacaaatggcatggtctttgatatataataaacgtcttacgtgatgttagctattgctgcttaagacaaaaagaagtgatgtataaaaggacttatagttttattggaggttcccaagccttcatttataagcatttcatgagatttaactttgttttttgatggcattaagcaggcaacaaaacctagtatttctcagttacagatactggcaagtctgtgttgctgcagtaggagcagctggcctgttgcactgattactaattgatcgagttatttttcttaattctcttctaatttccagccgtctcagtcctt

SEQ ID NO: 10243 - DNA, 396 bp, Homo sapiens
  misc_feature 36, 37, 38: n = A,T,C or G
ggcacgaggagagagagaactagtctcgagagcagnnntttttttttttttttttttttttttttttttttgggttttttttgttttttttagttgtttttttttttttgggggccccccccccaattataaaaccccccagaaacgagcccaccgggggggggggacaaccccccccggggggggggaggactgaaacacggaccgcgaccccccccccctacaaagatatttttggggggggggaaaaccaccacacgcaaaaaccgggggggggaaaccccccccgggggtttttcccccccgggggggggggtaaaaacagaaacactcaccgcgagggaccccgggggggggggggggggcccccaaaaaaagatgcggggggggaacccg

SEQ ID NO: 10244 - DNA, 393 bp, Homo sapiens
  misc_feature 393: n = A,T,C or G
ggcacgagctcggccttccagagtgctggaattgcaggcgtgagccaccgcacccagccagttgaacttacttgaacatccgcaaattattttttattatttttattttttgagacggagtctcgctctgtcacccaggctggagtgcagtggcgcgatctctgctcactgcaagccccgcctccctggttcacaccatcctacctcggcccctcaaggtgctgggattacaggcgtgagccaccgtgcctggccaaacatctgcagattaagtgctgggaataggttaagactgtactgtgccgtatattagattaggtgatcttttaaattcctcatgagttttctccagtccacttggaagttcagccggtgggagaagttagtgctgtn

SEQ ID NO: 10245 - DNA, 393 bp, Homo sapiens
ggcacgagcttattccctaggtccttttatgtttttgaccaagctgggttcccccagctggtattatggacttacacagttctgatgttagatgttaaacagttgccactcattgttttcgttgctttcaacaaaatccctggggatagggcttttcccactgagctagccagagtccagtcaaataacaggactttcaaatggagcttttctatgaagctgccagacaagacaggactttgggtacaaaactttttgaggaggtgcaaacctgaactgtccccccacctgccagtggctgcacagctctaggctttcatagttgccatgggtacaagacttcaggttttgaaggctactgtggagctggaagaaaaggggagcaaggcaagt

SEQ ID NO: 10246 - DNA, 391 bp, Homo sapiens
ggcacgaggtgagttacacagctagaaggtgccaggttggtgctgccagagattcagaggtgccatacacttgtcaaatctggatcattcgtagtgccagcacagtcctaaaagggctggagtaccacaccaacacaggtaggggtgcagggcttcaagtacaaagatttgcatccatgtatgtatcaaaagtgggttctctgggctgcggctttgtctagtagtaccacagtggctaaagtagaagaaaaccaaatcaaatgggatgtgtcttttgggaggatgtacaagacacaaatctttcactatgcaccgggcacagggaaaactgcagggaacaagagttgtagtgttagtgcaactgtctcaacgatgctgtgtggcttcagaa

SEQ ID NO: 10247 - DNA, 393 bp, Homo sapiens
attcgaattcggcacgagctggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccct

SEQ ID NO: 10248 - DNA, 393 bp, Homo sapiens
ggcacgagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaaggttagatttaagttccctgtgtaaaggtcttgctgggtgggtgtctcatgttcacatctgaggggcctgcagccctgtaccgtggaggcttcccaaggcccccattttatacacccctcgttcgacccatggtaccgggcagagcagagaggccttataaaaaaagcaccacaagccaaagcgtctctggggattaaggg

SEQ ID NO: 10249 - DNA, 395 bp, Homo sapiens
cgttgctgtcggcctgtatccataatttgaaggaaatggtaagagtgattagtgaaatgtaattactgtaattttttccccattcaactttatatatctttaactgatgaccagatcattgttgttctgaaccagtttgtggtcagcaagtgttttgtggggttttgtttgtttgtttttaaagaacagtttgggtcacttgacatggttctccaaagggatgttatgggttgtatttggctctgggtgataaccgacttgttagataatttagataagcaaccgagttgccatgtttgtttgtcgaacctcaagtgtagcttatattttatgttcctagagagcgtgtcagggaagaactgacccttttggcaaaccgtttgctagatattcag

SEQ ID NO: 10250 - DNA, 395 bp, Homo sapiens
cgttgctgtcggccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggcgatttctgaattagctagggaggaataatgaaaaaatattataaactatatcagctaaat

SEQ ID NO: 10251 - DNA, 392 bp, Homo sapiens
ttgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcatgggggctctgggagctttgatggcatgtctgcgaatagctagagctcatggacatcttcagtctgcaactgatacctgggagaacctcgtgtctgatgcaagaataaagcacggcttaattcatcagcattgccaagtaaggatagatacattaggcttgctttgtgaaagtaatcggagcacagaaattgtttccatggaagaaatgcagcggattca

SEQ ID NO: 10252 - DNA, 392 bp, Homo sapiens
ccatcgattcgaattcggcacgagccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcagcagcccctcccagggacccctcctttcctgtagggcggcgccggcccacctgggagcctcagatccccctcttcca

SEQ ID NO: 10253 - DNA, 393 bp, Homo sapiens
  misc_feature 378: n = A,T,C or G
cgttgctgtcgtaccattcaacaaagttttattttaaattaaatatagaaattattggcaacaacactggataggatttaaaacaaaaataaaaattgtttaccaaagtcaaatgatttgaaaacatttttaaaagcttatgtgcctgttaagatgaaggccttgcgctagttgctcatgaatcaatagctaatatgacgtaagagagtaaaaggaggcagatagctaaataagtggtatggtggtgggcgcctgtagtcccagctactcaggaggctaaggcaggagaatggcgtgaacccgggaggcggagcttgcagtgagccgagatcacgtcactgcactccagcctgggccacagtgtgagatctgtctcanaaaaagaaaaaaaaa

SEQ ID NO: 10254 - DNA, 392 bp, Homo sapiens
ggcacgagggtggtttgtgcagtgacatttggcagtgttttctcggcaagcgagtctttgaggctgccctcatgctgctcagtgggcacaccaagaacaagagctggccagggatgacggacgcatctaggccttctcggcctaagggttacattagttatacactctggaggtgacttgacctgtcattgtgaacaattattgctcttggacgacccaggacataggccagccagtacttaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaaggg

SEQ ID NO: 10255 - DNA, 394 bp, Homo sapiens
  misc_feature 394: n = A,T,C or G
tgttcctttggccgaagcggcctactgttggcagaagacgacagaagggattgtctgctcccttgtttttaagcaaattccagaaagccattcatttcactggttaatgtgttggaatgttttaaggcagattccagacactacatttcatctctaagtttgtcagagttcatctctaaaaaataaggactgcttattatatcatcaagtgccaatatcacagagtccatatccagattttctttttgttccctgggtgtcttttttttttttttttttttaaacgggattccccttttgcccccacccctggtgggagggggggaaatttggtttaatggaagccccccctcccggattaaccccatttttcaacccccgccctcccgggagn

SEQ ID NO: 10256 - DNA, 396 bp, Homo sapiens
  misc_feature 396: n = A,T,C or G
cgttgctgtcgggggacgtgtgttccctcaaagtctgtgccatcttctcccacccctgccgggtagaaagaggggctgaccccagggctgagagaggggaggggactggagggcagactggcttctcggtccccaaggagccgcttgggctgttggtctccagagcagggccactgggcactctgtgaggggggagcctttgtatgaaagcacaaccccctcgcgcttgctgtccacatgggttccccttcattggcattaatctgggcaccagctctctccatagcagtgacttgcctcaccactctcatgtctcagccttgccttttcttactgacactgtcgccccctcctctcaggagacaatgactatggccacctgacagaaggcttatn

SEQ ID NO: 10257 - DNA, 392 bp, Homo sapiens
ggcacgagggaaggtccagcccaggagggtccatgtcaaggaggttccatgcccaggagggtccatgctgaggtgggtccatgcccaggagggttcatgtccagaaaggtccatgcctaggagggcccatacacaacagagccctgtgcccaggaaggaccatgtcaaggagaaccccatgcccatgagggtccatgcccagtaagggccatgcccatgagatcctcatgcccaggaaggcccatgcccaggagggtccatgcccaggccagttcatgcacaggagggccccatgcctaaaagtgtccatgcccaggaaggtccatgtccagaagagtccatacccaggagggctgatatggttaggctttgtgtctccacccaaatctcat

SEQ ID NO: 10258 - DNA, 393 bp, Homo sapiens
  misc_feature 393: n = A,T,C or G
tcgaattcggcacgagccaggagtcaacccagaacttgccctgaaggacttcgccacacaaccaacctctccaagacaaacggagaggaaaaaggaagctgccgaggaagagcccacagtatgtcctcacttggggaaaaagaaaactatgcatggattggtatatgtaatatacatacatacatacatatatatatatatatatgcattaagtgagtaacaaaaagtctggaaggatacgttcaaactattaactggggttacctgcagggagggtgccaagggaacttttacttttactacatatatttctggcttatttggatttttcacccaaagatcccaagtgtacttggagtagttaacatgagaagaataataggggtgcaatan

SEQ ID NO: 10259 - DNA, 393 bp, Homo sapiens
ggcacgaggagccccgggcggcactggatcgggccccggagggtgtggggccttgaggaagccagatcccaggcctcgggggtggctttttcgcaattgtcgcacgttgtgaggcgcaggattggcgctgggtctcgggctcggggcgaggaactacggttcgggccgagtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatc

SEQ ID NO: 10260 - DNA, 392 bp, Homo sapiens
ctgtagtcccagctactcgggaggctgaagcaggagaatggcgtgaacctgggaggcggagcttgcagtgagccgagatcacaccactgcactccagcctgagcgacagagcaagactccatctcaaaaaaaaaaaaaaaggggggggggccaaaaacccaaaaaggggggacaaaagggggccccccccccttgggggaaaaaagggaaccctaggccccccaaaaggaatttgggggagcccccccggcccggcgggggaaaaaaacccggggtttaaattgggagcctttggcggggggggcaaaaaacccttgggggttaacccctggaagggacccccaacccaacccccccgggggggaaaaccttaaatggggcccgaacggggg

SEQ ID NO: 10261 - DNA, 397 bp, Homo sapiens
  misc_feature 169: n = A,T,C or G
attcgaattcggcacgaggggacatgagtgtccctgggccgccgtcttcggacggggccctgacacgggcaccctactgcctggaggccggggagccgacgcctggtttaagtgacacttctccagatgaagggttaatagaggacttgactatagaagacaaagcagnggagcaactggcaaaaggattgctttctcattatttgccagatctgcagagatcaaaacaagccctccaggaactcacacagaaccaagttgtattgttagacacactggagcaagagatttcaaaacttagagaatgtgattctatgttggatattaatgctttgtttgctgaggctaaacactatcatgccaaagtggtgaacataagaaaagagatgctgatgct

SEQ ID NO: 10262 - DNA, 396 bp, Homo sapiens
  misc_feature 298, 396: n = A,T,C or G
cgaattcggcacgaggggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcagaacttanagaatgtcattctatgttggatattaatgctttggttgctgaggctaaacactatcatgccaagttggtgaatataagaacagagatgctgatgcttn

SEQ ID NO: 10263 - DNA, 394 bp, Homo sapiens
aattcggcacgagaaggatctgtctgtgtgtcatggagcacctggagtgttctgtctggaatgctggctgggagccttctcctggcatttgaacgaggggcagctgtgtcctctgtttgccgtgtaaagaaaagaggacagagctcagaggagatgaaccccagcagaaaggggtgcttgaccagcaggagagaagataaccaagagggtctgtgggtgtctcttctgagctacaccagtttccaggttacctgggaccatggataactctcagatcagcaacttgtcagttgatttccaagctgctgttggctggactcagactcagcagggagcacctgggcgagccctgtgctgcgggctggactccggcccatctcgctgattactcttg

SEQ ID NO: 10264 - DNA, 392 bp, Homo sapiens
ggcacgagcctttctccaccctgcttacccaacctgaggtaagaccagtcacactggctcctccctcctagagggggtcagggggagggtgtatattgacatgaacagggatagagggtaaactggctccctgaatatgccagccttaacctccattccactgccagctccccttcaaagaggaggagctgggcttccctaacctctgcaggaggcagggcctccaggcctaggtgcagcctggccctgggatgggatgtggggagtgaatggtgaggatctgcattggtgggaggggtgtccgctgccctggagaagggttaattcagggagcagtggacttcacacccccatccaccctcctccaagcctgtggaatcctttaatcaagt

SEQ ID NO: 10265 - DNA, 394 bp, Homo sapiens
  misc_feature 353: n = A,T,C or G
gaattttattagacactttaaggaaatatgagatttggaacacagatgttcatcataaaacataatactgaaagtttgagaatgaccaaaacatccaaaaataaggaaagttataaattaagatttatccatataatggaatatgaaacaaatcatgtcttcaagaatttaatgacagaaaaatgtccagtggatagtagttttcaaaagctaggaaaactacattcagcatgatcccaattttatgtaacaaattcgtaaggaaggaaatttcttaacttacacatcaccagccattctttctaggttgtagaatgacaccagtgtgggttgtggggtttttgttttttgtntggggggataatttctgcccatttattgcacttttacaatt

SEQ ID NO: 10266 - DNA, 394 bp, Homo sapiens
gggcttctggattataggagagatataaggtactgatgatgcttcctgatgtgtaaagaactgttcaatagaagaaattaaaaaactatgccaggaacagttagagctcctgtctgaaaaaaaaattttgaagattcttgagggtgacaatggaatggactctgatatggaagaggaagcagatgatggctctaagatgggatctgatttagtcagtcagcaagacatctgtatagattctgcttcatccgtgagagagaataagcaacctgaaggtttggaattaaaacaaggaaaaggggaagatagtgatgtactcagtataaatgcagatgcttatgacagcgacatagaaggcccattgcacgaagaagcagctgctccccgggcaccg

SEQ ID NO: 10267 - DNA, 391 bp, Homo sapiens
  misc_feature 258, 306, 314: n = A,T,C or G
attcgaattcggcacgagacagagggctttggagtccctcgccacgaccctttgcctgaccccctcaaggtccccccaccactgcctgacccatccagcatctgcatggtggaccccgagatgctgccccccaagacagcacggcaaacggagaacgtcagccgcacccggaagcccctggcccgccccaactcacgcgctgccgcccccaaagccactccagtggctgctgccaaaaccaaggggcttgctgggggngaccgtgccagccgaccactcagtgcccggagtgagcccagtgagatnggaagccnggcaacccctgtccagaaagtcctcaccccccagaactgcacttcgaggcccggcgggccagccacgagcggcccgg

SEQ ID NO: 10268 - DNA, 391 bp, Homo sapiens
ggcacgaggccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggt

SEQ ID NO: 10269 - DNA, 397 bp, Homo sapiens
ttcgaattcggcacgagggaggacgttgcgtggagtggtgggaggaggcgggagccgtgtgcgagagcaggtggaaagccttgaggggcaggaccaggatgcagctggcttgtagaagagctcaggagtgagcctggcactccagagggcgcggcgggtggggaggcagcaggcaccagtccaggagagcttcgtggacgtggctcctgcgcgcacacccccaggagcacagccacgggctgcaggtgtggctggcctcagcactcagtcctcacccggagcctttgcctgctcctccttccaagagcactgaggcaccagtgggcttgcactccaccttgggcttccttttcctggagagccgccttgagggtccctcctgtgactggggtctctg

SEQ ID NO: 10270 - DNA, 391 bp, Homo sapiens
  misc_feature 305: n = A,T,C or G
ggcacgaggtgaggagtagttgctggccagcctggatgacgacctctgacccatgtcgccactggagctggtggcagtggggctggggaggaaggaacgccaagggccacagagagaacccaggctccatctgggccgagacatcctggcctctgagtttgacaggggagcccactgcccggccaaacaggagctggggctgggagctcagactcagtccagcccaggtgggagtcctggggaaggagatagcccacgagcctcaccagccctgggtgacagccagatggtgtccgaagccccangcctggggcaggcagggggtggtctggcccaggatgaacggaggccaactgggtaacaagcaaagtcggtgggcaggggctcatag

SEQ ID NO: 10271 - DNA, 393 bp, Homo sapiens
ggcacgagccgagaccacgccacgcacttggcggcagggacccggaggccgaccccttggcgggaaccagcacaaagtgttggcatcgcccggcgcccgggacagtcctgggcacagcctcggctctgagtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccat

SEQ ID NO: 10272 - DNA, 392 bp, Homo sapiens
cgaattcggcacgaggttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctg

SEQ ID NO: 10273 - DNA, 396 bp, Homo sapiens
  misc_feature 396: n = A,T,C or G
ttcggcacgagaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtgcccaagacagcagcttctacctaatgcacagcccccgaaactgn

SEQ ID NO: 10274 - DNA, 397 bp, Homo sapiens
ggcacgagctctctctctctctctctctctctctctctctctctctctctctctctctctcggtatctctctcggtgtggagctcttctccaacatctggggagctgggaccaagactgcccagatgtggtaccaacagggcttccgaagtctggaagacatccgcagccaggccttcctgacaacccagcaggccatcggcctgaagcattacagagacttcctggaacgtatgcccagggaggaggctacagagattgagcagacaggccagaaagcagcccagggctttaactgcgggctgctgtgtgtggcatagtggtcataccgacggggaaaggcgacctgcggtgatgacgacgtgctcatcactcacccagatagatggtcccaccgg

SEQ ID NO: 10275 - DNA, 394 bp, Homo sapiens
ggcacgagcccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtat

SEQ ID NO: 10276 - DNA, 397 bp, Homo sapiens
ggcacgagccagcaccggaccacctgctccaagaccagcctcctggggggaccacgcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggc

SEQ ID NO: 10277 - DNA, 396 bp, Homo sapiens
attcgaattcggcacgagggacagtagacaaaagagagagagaccgaggcagagatagagaaaaaaaggcccagagagagtcccctcaggccaactttggttttcacttctcagttctgagagccgaggaagcaggaaggagctgtgagagactgagctctaaccttggccatcaaagacaagctgtgcagctctggttttttgagggcaggacatggagggtcaggcccagctggaggcgcaccaaagcccagagaaaattcagaaccacgtgaacttgttggatttcagccccttgaagcacatgttgctattgcagctgccttgataactggggggacaggaggagcacggctttcccatcttgtacggagactcgccaatccagttgcccct

SEQ ID NO: 10278 - DNA, 396 bp, Homo sapiens
ggcacgagatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctggtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggt

SEQ ID NO: 10279 - DNA, 396 bp, Homo sapiens
atcccatcgattcgcaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttg

SEQ ID NO: 10280 - DNA, 386 bp, Homo sapiens
tcgaattcggcacgagggcagataaagggcagagggagacagttcccgagccccacaggctggcatgttgcctgcaagccaggacacctgaactgtcctatgagaccgaagctctggctttcagtcactgaaattcggggggttatttgtccagcagtgagaagtgccgattcagcagttacatctgcttcatggaatccggcttgaagcacaaagaaggatgaaatgaacaagtcccgtggagatctcacacatttagatatgtgatggggaaaatgcattttggatggtccatgactgtccaggtttcaaatattctagtctactggagtcctcacgttcactttttcttttttttttttttttataaagggggagcaacctgc

SEQ ID NO: 10281 - DNA, 388 bp, Homo sapiens
atcgattcgaattcggcacgaggctgagtaaatcctattttactatttgactgattaaatcacgaagatacccaggaggcaaaactgaaacagctcaggtgtctaggggaagtccaaagtagaggacactgtgaaccagctaccatgactgacctcagtttgaaactactggggtagtctgtattatggctgaaaaattcattctttctaccaagattttccattgaaaatttgcctttgacttatttaacttctaatcagctgaccttctaccttttttgcatttgaagtagatttcttttagtaggccagcgggtaaacaaggagaaaacacacagggcaagtcagatgcatcattgaaccgagtttctctctctaaacctgtaag

SEQ ID NO: 10282 - DNA, 386 bp, Homo sapiens
ggcacgagagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgtttta

SEQ ID NO: 10283 - DNA, 386 bp, Homo sapiens
  misc_feature 386: n = A,T,C or G
ggcacgagagagagagagagaactagtctcgagagcagttttttttttttttttttaagggttgataaaggcctctcccccgccccaggaaaaaaccccttggggaagggccaccggggggacccgccatttttttgggttccccaaaaaaggactttggaccccgttttttgaaaccccctttagtttccaaataattttttaaatataaagaggggacccattttcggttttagggtaaaaaaccccctctatttatatattccagttttggaaggggttttggcaaaaaattaaataggcctaaaccaattttgggaaaaaaccttttttttttttttttaaaaaaaaccgggcccccataaacttggtttaaagggctttan

SEQ ID NO: 10284 - DNA, 386 bp, Homo sapiens
ggcacgaggcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaat

SEQ ID NO: 10285 - DNA, 390 bp, Homo sapiens
tgcacgaggagagagagagagagagagagagagagagagagagagagagagagagagagagagagagagagagagagagagagagagagagtgagagagagcgtgagagagagagagagagagagagagagagagtgagagagagagagagagagagagagagcgcgcgcgcgctctttctctctctcttttttgtgtgcccacttacccacatatatatatgcccgcccacacggggtgtgtgttcttgagagagatatttttttctctctaccccctggagagcgcgtgtttttccccccccggggtggtggtctcttctctcttgagggggctgttatctaacctctcctctcccctttttttctcttttctcccacacaccgtggt

SEQ ID NO: 10286 - DNA, 389 bp, Homo sapiens
  misc_feature 389: n = A,T,C or G
ggcacgagatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcan

SEQ ID NO: 10287 - DNA, 389 bp, Homo sapiens
ggcacgagcttattccctaggtccttttatgtttttgaccaagctgggttcccccagctggtattatggacttacacagttctgatgttagatgttaaacagttgccactcattgttttcgttgttttcaacaaaatccctggggatagggcttttcccactgagctagccagagtccagtcaaataacaggactttcaaatggagcttttctaggaagctgccagacaagacagtactttgggtcaaaactttttgaggaggtccaaacctgagctgtccccccacctgccagtggctgcacagctctaggttttcatagttgccatggttacaagacttcaggttttgaaggctactgtggagctggaagaaaaggggagcaaggca

SEQ ID NO: 10288 - DNA, 387 bp, Homo sapiens
ggcacgagaatacctctactttttgcctattatgccagaaatactataaatctaaacagataaagtgtgtgagactttttctcataactattcatgacatttaaaatccctatgggctggcaagagagttctcattattctgaaatggtcctgacaagctgcatgaatagcaatttttttttgagacagagtcttgctctgtcacccaggctggactggagtagtgcaatctcagttcactgcaacctccgcctcccaggttcaagcgatactcccacctcagcctcctgagtagctgggactacaggcatgcagcaccatgtctggctaatttttgtatttttaggagaggccggggttcaccatattcgccaggctggtcttgag

SEQ ID NO: 10289 - DNA, 389 bp, Homo sapiens
ggcacgagattaagtgttggttcatagagattgccaataatcagaaagaaccttaaatgtgcatttaagacagtgtcccttcccttcttttcaatgaaggtccctgcctatataaatcatctggcacgctggtgggaaatcctttgctcttccaacgtgttattagtgctgggcagagatggggcacactcaggggccaaagaggacaaaaagtccatgcaaaacttgagtcttttaatggcttaagataatcaggagtcagttctgaatcttacaaagtgctctgcttaataagtaccttacttagcagagcactttgcaaacatattacttattagcagagctctttgtagaccttccacatctggctgtcagatcttaaggttgtg

SEQ ID NO: 10290 - DNA, 390 bp, Homo sapiens
  misc_feature 390: n = A,T,C or G
ggcacgaggagaaacgcccacaggtgtggaggggcaacccatcccttcactgaaccatttttattctttcagaaatgtgattgataacagtaaagccacactactcaagtgcctgaaatacccctcattgtcttcttcaggtggcaagggctctggaacagccacataaaggtgagggcaatatttttactgtagttctttcattgattggttgattgatttttttctcttagagggttagcatacatttatctgaaattgaaattcaagaggagagacaggcacctgtactagttttctcttgctgcctattatcacattaccacaaaccagtggtttgaaaccacaaaagtctggaatgaagtggccgggttctctgatcagagtatn

SEQ ID NO: 10291 - DNA, 389 bp, Homo sapiens
  misc_feature 352: n = A,T,C or G
ggcacgagctcaactccaccttttgtactggtactcaagattcaatgagtgatgccacttgtgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattntgcagacttcagttcagctggtcctagccaagttgta

SEQ ID NO: 10292 - DNA, 387 bp, Homo sapiens
cgaattcggcacgaggggcggagggagcaggctcaggcaccgagactgctgagccactggccacccgggaagcaggctgcgttctgagtcggtcaccgaatatgtccccccttggacgggagtagcgcaacgatgtgcaggccagctcaggaagtaacgctgggagcttctagaaggtggagcgggatccaggaccgtgggagcttttccggagaagcctacctctcctgtgttgcagctgatgggagcagcagggcctggagaagaactgtccccaggctgactcccctcttggagtgaggaggcctcccgtgtttgcctgccagcctccatctgtcatcttggttccagccattcaactttcctccaggagagcagagctgctct

SEQ ID NO: 10293 - DNA, 390 bp, Homo sapiens
ggcacgaggtctgggctaattagtccatttgggcttaggaaaacagtggcacctatttctgagatggtcttttactaacactgtgcattgcctgcatcttcctgtgcatggctttgtttgctcctatctgcaggttggtgagccccacagggcaggctgtactatgcactgtcatagcccaggaaagccactttcagaccaggtggcttgctccagaacccaaggctagtaaggggcaaagctgggtctagaacttcaactttctctttttctactccacgatatgactgacatttaggtttgcacacagcagcgttacatctatgggttctaatttaataatgataaataatttttttttctttttttttgagatggagtctcgctctg

SEQ ID NO: 10294 - DNA, 386 bp, Homo sapiens
ggcacgagaactccctctccagctcttctgaatcttgggacacagcctaaaaaggacaaaaagttagaagacagcatagcaactcagctcagggagctaccagagaaaaatagcaactgatgtgggtgcttttttttttttttatttggaaaaaaaaaaattaaaagggaggccttttaataaaaggctttttcccctttcccgcctacagttttttcttttcccttaaaaggggggaaggggtataaacctacggggtggggagtttaaaaaaagaatccccttcacccccaccttggccaaacaaaggggggttggcggttggaaaaggggaacacaaatcctggcacactggggatattttttgcaaatggcagcctttgggg

SEQ ID NO: 10295 - DNA, 388 bp, Homo sapiens
atcgattcgaattcggcacgagggcatccaaagccacatatctgtaggtgtattctgtgctttgggagctctggggtgagtctaacatcaaaccctatacctttgtttttctcacacttagattatacctctaagaccattagctcatcttgcattgtttgagggattcagtgtaagcccctggaccaaaaaggctttttcctctctgccttctgtgtctgctacaggcacaactctaaggtgaacaggagagagacaggccaaactaggagcccatcacctaaaaaagaggtctaccaaaggcgacatgctcccggatacaccagaaaactctctgcagaggaattagagcgaaacgggcagagattgatggaaacgccaatgaggg

SEQ ID NO: 10296 - DNA, 388 bp, Homo sapiens
  misc_feature 388: n = A,T,C or G
atcgattcgaattcggcacgaggtggcattagggagggattgtgagaaatgacttgtaaatataccttgggaaggtaaaacaaagatgatttattgatgggaaggatggaattgatagaatgtgagggaaagggagaactcaaggggaatactctgattttttagcctgtcattggttggatggtgaagcaggcaacaaaaatgggggggcctgggcaaagattaggggggggggagccaagagtttcatttggagctcatcagtttgaaatctcagtgagacttccaaattgaataggcagttggatgcagaaatgttgagcttgggccctgagatgcacaattgtttgagatataaatgggggttataagactatggtttataaan

SEQ ID NO: 10297 - DNA, 388 bp, Homo sapiens
  misc_feature 384: n = A,T,C or G
ggcacgagcccacctggaagagctgcacactcaggcccaggaggggctccgctccctacaacaccaagagaaacagaaactgaacaagggtggctgggaccatggagacacccagagtatccagttccaatggggagccttgaggagacagccccacccagatctccttctaccctgatagtcctcccggacggggccggatgaagacaacatctccttctgcagtcagaccacatcctacgtggctgagagctccacagcagaggacgcgctctccatccgctcggagatgatccagcgcaaaggtgattcaatggcaggggagagggacaagtggctccattggggccccagcatctgaagctctttttcttcttaatcagnggtt

SEQ ID NO: 10298 - DNA, 389 bp, Homo sapiens
cgttgctgtcggtgctgtccttttattaaacttatttttcctattttgaatgacagtctgtccctcttccatgtctctaatgttagtactgcccatgactagttggtggatagaatgtctttgcccatttttatatggcagtgggtaggcagaaagcattctgcttacagctacagtcacatccagcctgggcttgttgtggacaggatccattgcagaaatagcctgttgcatcttagccactggacaggaatcagttacaagtttccaaatgctttctgccataaccactgttttcagagctgtatgtacaatgcctagggaacacacagctcaaggtcagggaagaaagagcacgagcaacgttgacctgtctgcagcatcatggt

SEQ ID NO: 10299 - DNA, 387 bp, Homo sapiens
cgttgctgtcggccaagccatttgggttcattttaagcaaggccccccaggagcggcttgccccaataaactccgaaggtattatttcattatcagggtgccaggtggttttggccagggcctctgcaactcttttctctgtgaccattttccatttcggctcatatgaaccagcctttactacagagctataaagtaaaataatgtaattagtgcagccaactgcagctgttctcaaactcaatgtcacagccattacacatgtgaaatatttacaggggttttaatcaattttctttcctgacacccgtttttcattaaaaatgacaaaaataataaatgcacatggcagtagatacagaagaacaccaggaatgaattattatt

SEQ ID NO: 10300 - DNA, 389 bp, Homo sapiens
cgattcgaattcggcacgaggcctcacctccctgcagaggtccggccaggtctccttgtccctggacaatctcctgagcctctctgcttgggggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcacacccaggctgccccttggaattgtctacccaagcttttcccttggggctgggctcactccataag

SEQ ID NO: 10301 - DNA, 390 bp, Homo sapiens
  misc_feature 356: n = A,T,C or G
gaattcggcacgagggcatccaaagccacatatctgtaggtgtattctgtgctttgggagctctggggtgagtctaacatcaaaccctatacctttgtttttctcacacttagattatacctctaagaccattagctcatcttgcattgtttgagggattcagtgtaagcccctggaccaaaaaggctttttcctctctgccttctgtgtctgctacaggcacaactctaaagtgaacaggagagagacaggccaaactaggagcccatcacctaaaaaaagaggtctaccaaaggcgacatgctcccggatacaccagaaaactctctgcagaggaattagagcggaaacggcangagattgatggaaaacgccaatgggaggaggagg

SEQ ID NO: 10302 - DNA, 387 bp, Homo sapiens
  misc_feature 387: n = A,T,C or G
ggcacgagccacggtgagcaggctagaaactcacgacaccaggtagctctgcaggtgctgggagggcaactcagcccagaggaagagcaggctggggagccctcaccgcccaatggggactgacccctggcccctgcccctctccaccccactgccctgaagccagatttcctgctcagcatggacaggacagcaagaggctaaccctctgcccaggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcagcctcgcccn

SEQ ID NO: 10303 - DNA, 386 bp, Homo sapiens
ggcacgaggagagagagagagagagagagagagagagagagagagagagagagagagagagagagagagagagagcgagagagagagagagagagagagagagagagagagagagagagagagagagagagcgccgcgcgcagagagagaccccccctctcccctctctctctctctcttttctctctctacacacacacactttttttttttttgtgtgatgccccatagagacccccctccgcgcgcgcgcgagagagaggggctcttttttctctctgtacgctcggtatgtgtgttctctatatatagtgtgcgtctccccccccacccacacttatatatgtgtgttgtatatgggccgcactcctctgtctctcttatct

SEQ ID NO: 10304 - DNA, 390 bp, Homo sapiens
ggcacgagggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggccccagatccctggtgacaccttcctggagaagactctcaaaagtgactgtatatttgagttcaccagcaataactccccacactcgaagcaggtccaaacccaggatctcagggtccttgggctctgtggg

SEQ ID NO: 10305 - DNA, 387 bp, Homo sapiens
  misc_feature 387: n = A,T,C or G
ggcacgagaaggatctgtctgtgtgtcatggagcacctggagtgttctgtctggaatgctggctgggagccttctcctggcatttgaacgaggggcagctgtgtcctctgtttgccgtgtaaagaaaagaggacagagctcagaggagatgaaccccagcagaaaggggtgcttgaccagcaggagagaagataaccaagagggtctgtgggtgtctcttctgagctacaccagtttccaggttacctgggaccatggataactctcagatcagcaacttgtcagttgatttccaagctgctgttggctggactcagactcagcagggagcacctgggcgagccctgtgctgcgggctggactccggcccatctcgctgattactcn

SEQ ID NO: 10306 - DNA, 386 bp, Homo sapiens
  misc_feature 228, 307: n = A,T,C or G
attcgaattcggcacgagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgngttgggctggggggtttcccacatgcagtgtcagaggggccgcccggtggggctatctcccgtgctatattaatggcangactaaatgaaacctaaggcacggccctccgagctgcgtgtgccccttagaggtgacatcagagcagagcagtgagggt

SEQ ID NO: 10307 - DNA, 389 bp, Homo sapiens
cgaggctcatcctgcatcgctcggtgtctgggctgaagcagacactgctggcggagtccgaggctctgaccagctacagccaccgggtgttctcggcctgggacttcggtctctgcgggacgtccacgtgcggctgcgccagcgcatcatcttgtacgaattaaaggtggagctggaggagacagtggtgcggcgccaggctgcggtgcggacgctgtgccagcaagccagggtttggttggtgcgggtgctgctcaaccctgtgggtgtccgcgctcctgggggcaggcttctattgcggctactgggctacgggggtgacccggggagctgaaggagagcccccttggccaggagtggcaatggtgaacctggggggaattaccttc

SEQ ID NO: 10308 - DNA, 390 bp, Homo sapiens
  misc_feature 390: n = A,T,C or G
ggcacgagggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggactgtggggccgagggcagggatgggagagaagagatggttctgggctggaagcgagacagggggaccactccccgcaccctccccgccagccccagtgcggggacgcctctctggggtgcagggcacgtgcttggggacgctggcgagagccccttaccttcacatccgtgtccgaatcgctggagctgctgctggagtcggaagagctgtggtgtccttgctggatggaggtgn

SEQ ID NO: 10309 - DNA, 389 bp, Homo sapiens
  misc_feature 36, 37, 38: n = A,T,C or G
ggcacgaggagagagagaactagtctcgagagcagnnntttttttttttttttttttttttttttttttttcccccccccaaacttttttttggggcctaaaaagggggccccggggaaaatttttttttcccccaattttgggccccccgaaaaaaaaaaaattttgaaaatgaacagggggaacccccccgggttttcaaggggtccccccctttcaaaggcccgcgggggtgggcctaataaaaaaagggcgggccctttcggtgaacttttcaagcccttccccccccccgggggggcaataaaaaaaaacctctcccaccccaagggggggggggggattttttttttttgggttccccaagagcctttgaagaggggctgccc

SEQ ID NO: 10310 - DNA, 389 bp, Homo sapiens
cggcacgagcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactggggagcccagtggaggcgccctcccgaagcgccactggccatgctgaccacccagccctccggctgctgatgtcatgagaacaccactgtgcccatgcccccaggccacagcgactcatgtgg

SEQ ID NO: 10311 - DNA, 385 bp, Homo sapiens
  misc_feature 385: n = A,T,C or G
ggcacgaggtgacaagggatgaaaccaggggttgggcagggcaagactctgataccctctctgacctcggtcctcttaaggctgttggccctgtgcccaggaaaggaataactagaagtgctggtggaagaagggggactttccaaagcataagctaacttttgttcccaaaccttccccctgctgcttgaggcagaggaaatgtgcaaaggggcccgggaaagaggcccgaccggatggggcttcggcgccaggctgacttggagggccagggggtctctgaacaaggggcttctgctagagcagaggggcattagggagacccacccctagcctaggggaaatggagccttcaacccactgtcctgataagcaaaggctaacn

SEQ ID NO: 10312 - DNA, 385 bp, Homo sapiens
  misc_feature 385: n = A,T,C or G
ggcacgagtaatgacccaattacaagttctaaatgcctgtaagattggaggttattggaggattcttgaatttgattatgagatgaaacttctgaatcatgtaactcagcttgtggattctgaatcatggtcttttggtaaagttcctttgaacacatgccttcaggaactcggaccattggagccagaggaaatgatagaacactgtcttaaatgttatgggaagaaatatgtagatgaaggcgaagtttattttgagttggatgctgataaaatatgtagagcagcagcacgaatgctacttcagaatgcggtgaaattcaatctcgctgagtttcaagaagtgtggcagcagagtgttcctgaaggaatggtaactagtctn

SEQ ID NO: 10313 - DNA, 389 bp, Homo sapiens
ggcacgagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccac

SEQ ID NO: 10314 - DNA, 388 bp, Homo sapiens
atcgattcgaattcggcacgagatccaagccatctgcatcgcagccttttaccggaaggagtggccgctcctggtggtggtgccatcctccgtgcgcttcacctgggagcaggccttccttcggtggctgccatctctgagcccagattgcatcaacgtcgaggtgactgggaaggaccgcctgacagctggcctgatcaacattgtcagctttgaccttcttagcaagttggaaaaacagctaacaaccccttttaaagttgtcatcattgatgccaagagggtgatcctgttgtcgggcacaccagccatgtcccggcccgcagagctctacacgcagatcatcgcagtcaagccaactttcttcccccagtttcatgcctttgga

SEQ ID NO: 10315 - DNA, 385 bp, Homo sapiens
ctaattcggcacgagatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgttgccaagagggtgatcctgttgtcgggcacaccagccatgtcccggcccgcagagctctacacgcagatcatcgcagtcaagccaactttcttcccccagtttcatgcctttggacttc

SEQ ID NO: 10316 - DNA, 388 bp, Homo sapiens
gaattcggcacgaggctgtactgcccttcaggacatgcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaaggtgcaa

SEQ ID NO: 10317 - DNA, 380 bp, Homo sapiens
tacggctgcgagaagacgacagaagggcatcaaggttcatccatgtttttgcatatggcaaggtttcctttttaagtctgaataatattccattttctacatataccacatttactttatccctttttctgttagtggacatttaacttgttctcacagcttggctattgcaaataatgctgcaatgaatatctcataagtctcatatatgtccatacaagatcatgaaaatggacatgtctctgggtattttgaattggtgggacaattttgcttaagggtaggcatagtgggtggctctacatttgagaggtctaattcccaatcccatatataattcctttctttttatttaattttttgagatggggttctctgtc

SEQ ID NO: 10318 - DNA, 384 bp, Homo sapiens
gaattcggcacgaggtggcgcgtgcctgtagtctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgcctgatctcatggcacctggtccactagaaatggtcagggattcatttgggctctttgatacatcagccctcatattactttcttagg

SEQ ID NO: 10319 - DNA, 382 bp, Homo sapiens
cgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaaga

SEQ ID NO: 10320 - DNA, 384 bp, Homo sapiens
cggcacgaggagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacattcaggactctcagtgccatatgaaagaacaaaaggcagtatcggcccgaacagggtacattgattctaaaaatacagggccccattaaacactatcttagtgtgaggatgtttgagaggtgctgcgacaaagaagcattcttcatg

SEQ ID NO: 10321 - DNA, 382 bp, Homo sapiens
ggcacgagagtagagacggggtttcgcagtgttagccaggaaggtctcaatctcctgacctcctgatccgcccgcctcggcctcccaaagtgctgggattacaggcgtgagccaccgcgcccagttgtgcatttctggtttctaagaatcaaaccacttggctgtttttaggagttacttcccatgttataaagctgaggaagctttttttttttttttttgaaaaaaagtttttgccccccgggggggggggcgggggggcattttaacctccgggtttaaagcatttttccggcctaaccctttggagaaccaaaaataacgggggggccccaacccggggggttttttttttggttttttaagaaaaaagggggttccc

SEQ ID NO: 10322 - DNA, 383 bp, Homo sapiens
cgttgctgtcggtagtttcttctcgagccaatgcatgtattatagcagcaggtgtctttgtgctttctcatcatagtaacgtactacttgtaaatacatttttctattttctatttttttgtatttttttgacattttgtttcattggtgtgctgtatattttccatgccctcactcctttaagaaaaaaaaaaaggaaaaaagcaccacaatcctgtccttgctgttgggattatagccttggtttacctgcggggacaaccgggtgttggggacacatgtcaaatgcccctctgagatgggccctaaattccagtaactggggaaagaaccaactgctgtgtcctgagagcctggccctgtgctgtgatctctgctgcaaa

SEQ ID NO: 10323 - DNA, 384 bp, Homo sapiens
gaaattttgcctttcttggaggtttttgttctgatgtaatggtgaaaggtaattctatcatctctgcatgacacagctatttttgttgcttcagcaagatttatcaaagcaagtggtttttgaccattctttgtctccaagggagagacaattgtggcagcatcccatcctctgagctggtttttgtttttgttttttggagaataagtggttttgattacaggtgtgaacttgtggtattcacagatgttggtggcctgtcaggactattttaggagacctcatttatcctttgaccaagaaatatcctgactggggcctgacttgaatatatagctccctgtgggggtgatgccaaggctcccttccagtaataactgctca

SEQ ID NO: 10324 - DNA, 381 bp, Homo sapiens
cgttgctgtcgattttaaataaatttctttattgaaagtatgtctcttgattggaaagttttctgaaacaaagagacttactaattttttttgttgttctatttgattcttgcatctttgtcccacattttctctctttgtttctctctgcggctgttttatttttactttgatatgcttttacttctttcttatgttggtttctgtatctatacaggcatattctttgtggtacgtgggggattacataaaacctttaagagatacaatgtatttcagtctagttaaaaatgaacttttgttgcatgcaaaaattttttctcattacatatgttctcagatttgttcttgatgttgctaattatatttttatatgtatat

SEQ ID NO: 10325 - DNA, 381 bp, Homo sapiens
cgttgctgtcggccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattataaac

SEQ ID NO: 10326 - DNA, 382 bp, Homo sapiens
  misc_feature 296: n = A,T,C or G
ggcacgaggtggggggtgtgctggtggctgccttactggtcttcactgtggccttgctggttcggggccggggggccggaaatggccgcctccccctcaagctcagccacgtccagtcccagaccaatggaggccccagccccacacccaaggcccacccgccgcggagccccccgccccggccgcagcgcagctgctctctggacctgggagatgccgggtgctacggttatgccaggcgcctgggaggagcttgggcccgacggagccactctgtgcatggggggctgctcggngcagggtgccggggggtaggaggcagcgccgagcggctggaagagagtgtggtgtgatggacgggcagcttcctgtgtgctccaag

SEQ ID NO: 10327 - DNA, 382 bp, Homo sapiens
aaaaacaattagctaactggtgattgtgtgaaggatgaactggattaggccaaggtgatcaagaagaagattggtagattaacgtggtcaggaggtcatgagaacttcaaatgaggcagtgaccatcaggaaaaaatttgtaagaagaatggtcaggaccaaatgagtttggtttggtcctgctgagtttgaggcatatggtggaaactgcccagctccctccttcagaaatgagacactctttccctagctggcctggtataggctgttaatggccaccagctgtgttcctttatggggctcgcccttggctgaaaggagctacaaggagttcatgggtgactttggccagaggagttgatgaggagaggaaggtctgggg

SEQ ID NO: 10328 - DNA, 383 bp, Homo sapiens
  misc_feature 301: n = A,T,C or G
cgaattcggcacgaggagagggggacatgtgagcccctcttcatgttgatgttccattggggaactgcccctcccccattctgggtccagtgtcccatccattgcagaggggcctgaaggtgctgaaggagctcagagccagagcaaaaaggggggacctggcctcacagagaggaaggacaccttttggttttctgactgtctggcgaaggagatcaagatgattgcacatgcaaacaagttcgtcagtgccaacaattgcaactgagtattgggtgctcaagtggacaggggacttgangaagtggggaagccgttgggaagtgcttgtgatgcaaaaccgaagggggccaacccgaccgagagctgggttctcaaccttt

SEQ ID NO: 10329 - DNA, 379 bp, Homo sapiens
tcgattcgaattcggcacgagagagagagagagagagagagagagagagagagagagagagagagagagagagagagagagagagagagagagagagagagagagagagagagagagagagagagagagtgtatagagcgacagagcgccctccttctcggggagagagaaaaaaaacccccccactctctctgtgtgtgtgcacacacccgtgggagccccccccccagagatgtgtgcacatagacagcgcgagctctctctctctctcgggggggagagaaaaaaacctctctatattcccgcgggagtgggtgagttagagagatatttttttcttagagagccgcgcggtgttcacgcgcggtctccttttagg

SEQ ID NO: 10330 - DNA, 381 bp, Homo sapiens
ggcacgagggggagaagggtgagactgggggggcacgtgaacccaaaggagagaaaggccagccccaggagctgggccgcaggttcgccctgacagcaaacatctttaagaagttcttgcgtagtgtgcggcctgaccgtgaccggctgctgaaggagaagccaggctgggtgacacccatggtccctgagtcccgaaccggccgctcacagaaggtcaagaagcggagcctttccaagggctctggacatttccccttcccaggcaccggggagcacaggcgaggggagaatccccccacaagctgccccaaggccctggagcactcaccctcaggatttgatattaacacagctgtttgggtctgaatcctagagacag

SEQ ID NO: 10331 - DNA, 379 bp, Homo sapiens
  misc_feature 320, 336: n = A,T,C or G
atcgattcgaattcggcacgagcagaactggcggtttttcccagctccttgcccagaccaatacttccatgctgtcttcaagccctgcttcctgcacatctcccagcccagatggggagaacccatgtaagaaggtccactgggcttctgggaggagaaggacatcatccacagactcagagtccaagtcccacccggactcctccaagatacccaggtcccggagacccagccgcctgacagtgaagtatgacccgggccagctccagcgctggctggagatggagccaatggtggatgctcaagttcaggagctcttncaggatcaagcacccnctctgagcctgagattgacctggaagctctcatggatctatcc

SEQ ID NO: 10332 - DNA, 382 bp, Homo sapiens
ggcacgaggctttccgcaccttaaccccagtgagcgtgaaaaagaaagttaataaactataatacatggaagcaagaaagacactgcctcctctgagggaccttttcccaagcatgtaaacaagggggcccacagccctggctgcaggcatcatgacccatcttctaccaggcagatctttattacctgagcccctaaggcagtgtctcctcagctgggctgcttccactgagacccccgacccatcccctttccagtacacacacctgatgcatgtaagaatggtagaggggcttttctcagcattgaattaataattcagtggctcctcgggagtcgaatgggcatttgggacaccagaaggaaaagaaatcatcatagt

SEQ ID NO: 10333 - DNA, 382 bp, Homo sapiens
ggcacgagccattttcttccatcagctaaactttacagataatagtgtttccacctcatatccttttctttgccccttctcaaatgagtcagaatagtcatgttccccttgagggatgtctgacttgaatgtagaattgttctttcctctcttgaatcagctcactagctccctgatggtctgggttcaaggaaatggttaatgaggtagaggccacttatacaagtccttgggattgtaccattgctgtccacaaacttagtatcaacaacacatgctgtgccctgtgaacactctcctctcacctatttccagggttggtcttcctgagaaggggatggatgaggtaacacacagtttgggatacgtatctgttgaatga

SEQ ID NO: 10334 - DNA, 384 bp, Homo sapiens
  misc_feature 225, 326: n = A,T,C or G
ggcacgaggatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctggttttctcatttgttggngggtggggggggggcaggggtaaggcgggagagcgatgttggaattttggtttccaataagaaaccacaaggttgtccaaaattcatttcattggggctanaagagacaattggagatttccgatccttttccccggcccgattaaaaagcccctcctt

SEQ ID NO: 10335 - DNA, 383 bp, Homo sapiens
ggcacgagagccgggaggcgaacttgggacccgctggcctcgctcggcgcgcgcctccctccccgcatgcagcccgccgagcgctcgcgggtccccaggatcgacccgtacggattcgagcggtctgaggactttgacgacgccgcctacgagaagttcttcttcagctacctggtcacgctcacccgctgggcgatcaaatggccccggctgctgcacggcgggggctgccccacgagccggacagacaatatccaccaggagcccttaggaagacagcttcctctttctccctggaaagactatattcaacacacttagtgctgttggattcctatttcattctccatctcgagaatagacgtctgcatggaagcatcttt

SEQ ID NO: 10336 - DNA, 383 bp, Homo sapiens
ggcacgaggagagagagagagagagagagagagagagagagagagagagagagagagagagagagagagagagagagagagagagagagagagagagagagagagagagagagagataaaaacacagcgccccgctctctctcttttttttttctctccacacacgtgagggggggtgagacacacccccacaaaagatatctctctgtgtctctctctatactctctctctctctctcacagagagctctctctgtggtgtgtcaaaaacacacacgggtgtctctctttttgcgccccagagagacacacattctctcacacgcgcgcgctctgtgtgtatatatgtccccccccgcgcgcccccagagagtagatctctg

SEQ ID NO: 10337 - DNA, 383 bp, Homo sapiens
ggcacgagagaagctgctcctcgagacaaactgagcaacccactggatatatgctatgacgtgctctgtgaaaatgcctactttcagaaatttcagctagaaagggttaatctgcaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggc

SEQ ID NO: 10338 - DNA, 383 bp, Homo sapiens
  misc_feature 263, 264, 265, 266, 267, 268, 269, 270, 271, 272, 273, 274,275, 276, 277, 278, 279, 280, 281, 282, 283, 284, 285, 286,287, 288, 289, 290, 291, 292, 293, 294, 295, 296, 297, 298,299, 300, 301, 302, 303, 304, 305, 306, 307, 308, 309: n = A,T,C or G
  misc_feature 310, 312, 313, 314, 315, 316, 317, 318, 319, 320, 321, 323,324, 325, 326, 327, 328, 329, 331, 332, 333, 334, 335, 336,337, 338, 339, 340, 341, 342, 343, 344, 345, 346, 347, 348,349, 350, 351, 352, 353, 354, 355, 356, 357, 358, 359: n = A,T,C or G
  misc_feature 360, 361, 362, 364, 365, 366, 367, 369, 370, 371, 372, 373,374, 375, 377, 378, 379, 380, 381: n = A,T,C or G
ggcaccagagactttacagagatagtggggtgttttaaggcagggggaggaactgcacagcccagacctgggagggagggatccagggaaggagagatcctgggaattgcaatagcagcaggcagaggctgttggttcctattgtttcctggctgctatgaatgacttggctttaatgactcccaaggttctggatctctccagttcaaatttcaaattattgacaaaacaatctgattggccagcttagtcctagatatgcnnnnnnnnnnnnnnnnnnnnnnnnnnnnnnnnnnnnnnnnnnnnnnnngnnnnnnnnnncnnnnnnncnnnnnnnnnnnnnnnnnnnnnnnnnnnnnnnntnnnncnnnnnnncnnnnntg

SEQ ID NO: 10339 - DNA, 379 bp, Homo sapiens
ggcacgagaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtga

SEQ ID NO: 10340 - DNA, 384 bp, Homo sapiens
ggcacgaggaggcttgaatctccaggaaatagagtctgtgggcagccattgactccgagtcaatgagaacaaggtgtgctgtttcctctgtgctgtttcttccctgccccactccccgcccctttgtcctatggtgcccaggctgcctgcactgcccagataccacaggccttgccagggacctcctgagaggtttctgaggcttgcagccagtggtcccgttagtctgcacgtctccgagttgccctcccagaggagaaagcatatgctgctgggaccgactgcagctcctcatggatgcacctgccaccagaaaattgttgttcagtctgggattgctttctcttcccaaagcacaatctcacatgcagtcatgagcccagt

SEQ ID NO: 10341 - DNA, 381 bp, Homo sapiens
  misc_feature 361: n = A,T,C or G
ggcacgaggtaggaccaggtgtgcaaacttcacaggggtctctgtccccaaccaccccaagtgctagaaaaaagagttcaataattgggatggctcccatgtagcagctggtcctgaatgggtggctcaatacatctgccctctgccctgatcctggatcctcaagggtccaatcctttgagaaaaggaaccaggagagcgatgggtctgaagcgctggtgttgtagaaatcctcatcacaaagaggtgactgcgttccagttgctgccaggcctggccatattcccacaaagtgcccatgtctacaggatgctcagcccttgccttcctctgtcccgccaccacccttctcagctagaanggtgctgctatatttgaagt

SEQ ID NO: 10342 - DNA, 381 bp, Homo sapiens
  misc_feature 381: n = A,T,C or G
ggcacgagcggtgacaccccacaaggacacggcctcagcggttccattttcccccgaacattcagccacttccctggagcaatttttcctgccccgctggggaccagcgagtggcctagttgcggctgtggccctggacagcggcgtgaggcccaaacctctaggtagggcccagttggatcctgatttttcattgagccaggcagtctcagcccgagttgaaaggcctccttagccttggaactaacgtctcttcaccctgacttctgggcaaggggagatcccaggaaaaggtttacctgcaggttttccaaggccaaagccccagcaaggaccccctctccaacctttgttatagggctacatggggcctgggctcan

SEQ ID NO: 10343 - DNA, 379 bp, Homo sapiens
ggcacgagccagccttttccccagcctgtggacgcctggcccaccctgagtgtgagtcacagagaccctggccggtgcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcaggggccattccagggggcatcccttggttcgggaccccctgcagtgaggggcctgtgaaccccaccagggcagcagccccttccagggaccccctcttttctgtagggcggcgccggcccacctggagcctaagatccccttttcattacg

SEQ ID NO: 10344 - DNA, 380 bp, Homo sapiens
ggcacgaggctcaatgcactggaccttctcgtccagcctggatgcctctatcatttctctttgtctttctctggcctccataccgttctgaagagctcaccttcccctagggtcctcctgccctgctcttcccaagtgacccagccctcacctgtagggcagccaaggctggtggtgcagctgcccccagtgaaggtcattgggcatcgcactgggcagtgcagaggtccaggctgaggagttgagtggcgcgcccatcctggcgcctgtgcagagaacgggaggggggcccctggcttggatcctagaatcggtgaagtctgagggcccccctgcagtctcagcaggacctgctctatcaaggggcttactccttcctt

SEQ ID NO: 10345 - DNA, 379 bp, Homo sapiens
ggcacgaggactggcctgtccctcaggcccatgctgacaccggggagactggagccccatcagcagacagccaggctgatgttatacctgctgtcatgggcagacgtagcctctcgcctcaggaagatgccctcacaggctccagggtttggaacaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggt

SEQ ID NO: 10346 - DNA, 382 bp, Homo sapiens
  misc_feature 306, 351: n = A,T,C or G
ggcacgaggaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcanaattcagtctgtctgtctgaatgtttcttccacactgcagagtanatctggaccagactacaagatacccattgac

SEQ ID NO: 10347 - DNA, 380 bp, Homo sapiens
ggcacgagggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctggctaaaagaagtcttcactttccaggagagcccaaagcgtgtctggccctaggtgggaaaaga

SEQ ID NO: 10348 - DNA, 384 bp, Homo sapiens
  misc_feature 384: n = A,T,C or G
cgttgctgtcgcccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtagggggcctcccatctgctaagcgtttttccgttgagccgctccaaaaacactaagctggggacgccaggtgcccccccacctcgcccggctcacacccccaaagggagggacccacattgcacacactgtaagaaatgcactttccgaggaaggggaatgggagcccgn

SEQ ID NO: 10349 - DNA, 384 bp, Homo sapiens
  misc_feature 384: n = A,T,C or G
tggactacggttgcgacatgacgacagacggggcttaatctgatcatccctgaggctgaagagcagggccaggttgctgaccttaggtcacttaaggagatattgatggattacatcccataggtgcctgtgtgagccggattcccaacacattcttgctgtggttgactcggttattgactttacttcgtttgtttgacggtttttatgggactgtttctagccctgattcacgtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggan

SEQ ID NO: 10350 - DNA, 383 bp, Homo sapiens
ggcacgaggccctcctgatccccagctgtcctggggccctgaccgacctggccagcagtggctccctggcccgtatcctgcagcacttccactctgagagcaaacccatctgcgccgtcggccacggtgtcgctgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccaccgtcccggccgtgcagaacctg

SEQ ID NO: 10351 - DNA, 382 bp, Homo sapiens
cgttgctgtcggtgatcggccgctccctgttcaaaaaggaaaccaacatccagctcttcgtggggctcaaggtgcacttgtccactggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccag

SEQ ID NO: 10352 - DNA, 383 bp, Homo sapiens
  misc_feature 383: n = A,T,C or G
ggcacgagggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgn

SEQ ID NO: 10353 - DNA, 382 bp, Homo sapiens
  misc_feature 382: n = A,T,C or G
ggcacgagagaaaagaggccttcctcagttggggaccctgggagcaggcaaccattatgcagaaatccaggttgtggatgagattttcaatgagtatgctgctaaaaaaatgggcatcgaccataagggacaggtgtgtgtgatgatccacagtggaagcagaggcttgggccaccaagtagccacagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcaggctttcgccaaggtcttn

SEQ ID NO: 10354 - DNA, 373 bp, Homo sapiens
  misc_feature 329, 373: n = A,T,C or G
tacggctgcgagaagacgacagaaggggcagccataaggacagatgaaaaccaggagagaggcataggtcagaagccaaaggaagccatggacaatgatggcagccaacacaactaactcatggactaagaagaggaaagtagcaactacgtcattagaaatcttaggtcagtggttggaaaactgaatggaaatcaacgtattatagaagctatggggtagatgtgatttttcgggtagatcagctggaaaagaaggtatagggagaaagagaaatcactagaagtggtacagagcgaaaataaagtacttttaaaagttggccttanaaatagtgaacacatactgcttcctatgtgtcaggaactctttn

SEQ ID NO: 10355 - DNA, 374 bp, Homo sapiens
  misc_feature 374: n = A,T,C or G
ggcacgagggaggggagagggaagaaagtaaactgaccataaaagaaaccaattcaaatggaaaacagcgactaaccttgacacaggaatgaatcatgaaggctggatgggtagactgggaggggtgaaaagaatgtatattctttgttttaagctatatataaaattgtcagatttagccaaagcctagttggaatgggagttggctaaattacatgaaatgtaacacagacattgccaaaactacttcacagggttgttctgaacaacgagacacaaattgtgaagatgttccccaaattgcaaaatgctacactaatgtaagacagatagtttacacaatatttcaggttcaatctttcctttcactctgn

SEQ ID NO: 10356 - DNA, 374 bp, Homo sapiens
ctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgaaagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttag

SEQ ID NO: 10357 - DNA, 374 bp, Homo sapiens
  misc_feature 225, 326, 327: n = A,T,C or G
tacggctgcgagaagacgacagaaggggcgcacacctgtagccccagctacttgggaggctaaggtgggaggatggcttaagcccaggaggcagaggctgcaggcagctgagatcatgccactgcactccagcctgggtgacagagccagatcctgtcccaaaaacaaaaacaaagataacatgatcttgagctgtggaaattattagattgcatattctattgnacagcggcacctaggtattatttggtgggtttggatttgatgctatatttatttactttaaatctgcctcttttttcctctctgatactacctttatgagnntatactattaagtttgtttcctcttaaaggatctgacaccggcgcgg

SEQ ID NO: 10358 - DNA, 373 bp, Homo sapiens
  misc_feature 26, 27, 28: n = A,T,C or G
tacggctgcgagtaagactacagaannnggaagctggcagatgaaccatgtttcaaacccaggtccacctgattccacagctaggccctgatgtgcaagagctgcttgcagcaatgatttgaaccttcttgttttctaccaaaaggctttcctttgtagactgtctctaacaggcaaattaggtaagcaccctgtgggacaggggatgaaaaaagaaagacatacagtatgttgcagaaaacttttaaaaattatatcataacatatttacatctgatatcaaccatattcaatgtactttcatatacatcatctcttagtgtcaccacatatctgtatatggtaatgagcgtaatctgtaattatgctcatt

SEQ ID NO: 10359 - DNA, 378 bp, Homo sapiens
cgttgctgtcgggaggtttcagtgagccaagatcacaccactgcactccagcctggcaacagagcgagactccatctcaaaaaaaaaaaaaaaggtagaaaaaaaggggccccctttaaaggggaaaaaaaaatccaaaaaatttgggccggaggccggtataaaaaaaaaaagcgtttttcaaaggcggtcataggttggggggaaattaaacctttaattctctccttttggggggaaaaacaaggccccatttggaggggatttttttttaattgggcttttgggttcgggccagaaaaaaaacccttaggggctacccaatttttgggaaaaaaggtttcaggggtaaaaataaaataaaattatacccccccc

SEQ ID NO: 10360 - DNA, 374 bp, Homo sapiens
cgttgctgtcggttcccctcttatacttttccccagccagaagcacctggtaagcctctgcatgtcctcagaactagaaagattagaaagagagagagagaacacatgtggatgataccacagtcagcgagaagggactccaagctcatgcctctgggggatggcctcattgccatctctggatccagagggcaaattattagcagttctattcagaaaaagggctagagagcaggggcaagaaatcatgcttgctgttgctcttgagggcagatgtattagtttgctagggctgtcataagagagtactgcagattgggtgacttaagcgacagaaatttcttttcttacaattctggaggctacaagtccag

SEQ ID NO: 10361 - DNA, 378 bp, Homo sapiens
  misc_feature 378: n = A,T,C or G
tcggcacgagagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgctttcagggcctctgccttcaaggcccccatgggggctgccatccatggctctgcctacggaggggcttaatgcatgtgcctgcccttccccaagtgttttaatgaaactgaaaaaatagattggtcccgcagactggattcagaacctagctggccagcaggccn

SEQ ID NO: 10362 - DNA, 374 bp, Homo sapiens
gaattcggcacgagggcagataaagggcagagggagacagttcccgagccccacaggctggcatgttgcctgcaagccaggacacctgaactgtcctatgagaccgaagctctggctttcagtcactgaaattcggggggttatttgtccagcagtgagaagtgccgattcagcagttacatctgcttcatggaatcccgcttgaagcacaaagaggatgaaatgaacaagtccccgtgagatctcacacatttagatatgtgatggggaaaatggcattttgatgggccatgactgccacggttcaataatctaggctaactgaggctcacgtcacttttccttttttttttttattaaggggcgcaaccggc

SEQ ID NO: 10363 - DNA, 373 bp, Homo sapiens
  misc_feature 21, 22: n = A,T,C or G
tacggctgcgagaagacgacnnagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacagacatttattcagaacagctggggatcaaccgtttaacctgtccacagtgtcgagtgccttcccaatggtcagccacccagtctttggtctacattcagccagctcagggcattcagaattatgtggg

SEQ ID NO: 10364 - DNA, 377 bp, Homo sapiens
cgttgctgtcgcttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttgtattttttattattttattttatttttttttttttggattag

SEQ ID NO: 10365 - DNA, 378 bp, Homo sapiens
  misc_feature 378: n = A,T,C or G
ggcacgaggctttccgcaccttaaccccagtgagcgtgaaaaagaaagttaataaactataatacatggaagcaagaaagacactgcctcctctgagggaccttttcccaagcatgtaaacaagggggcccacagccctggctgcaggcatcatgacccatcttctaccaggcagatctttattacctgagcccctaaggcagtgtctcctcagctgggctgcttgcactgagacccccgacccatcccctttccagtacacacacctgatgcatgtaagaatggtagaggggcttttctcagcattgaattaataattcagtggctcctcgggagtcgaatgggcatttgggacaccagaaggaaaagaaatcatcn

SEQ ID NO: 10366 - DNA, 374 bp, Homo sapiens
ggcacgagccgtgtcctgcctagtaggggatgggggtggctttccagcacagccagccctcaagtttcccagaacagtctccccacctccccccaacactcgacattgttcctctctggctgttttttcctgttcgggtcccttcaaggcccaactgtgcccagccctctgcagctggggacactgagtgggttgggggtgtatgtttgcaaagatagaatttctcatgggggagtggccctgcttccttcccctaaaatggcttggggcttagggctggggacttgccctccatggaggtcagtgggagttgcagctgtaaggtggcagggcctacccatcttacagaggtgaagacgaggtccctctgcctc

SEQ ID NO: 10367 - DNA, 376 bp, Homo sapiens
ggcacgaggcagcttttagcatcctggcaagagctgtgtcaaagtgacctatccctggaccggcagcttaccggactctatgatgccttgcttggtgcttggcacacacaaatccagtgggctacacaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacatgaacacaatctggtaaaagtcacggagcttgtggatgctgtgtatg

SEQ ID NO: 10368 - DNA, 377 bp, Homo sapiens
  misc_feature 360: n = A,T,C or G
ggcacgagaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtcctttgagttctaccagaagaagaatctcgctgccattctcagacgagtgcatccatgggaagtgtgacggccaagggcatgtggaacccttgccacgagcangaacgcagaattgcggg

SEQ ID NO: 10369 - DNA, 374 bp, Homo sapiens
ggcacgaggcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctctgcgtggcaggtgaagtgcaccggtttagaacctctgacgtctctcaagccactttagccagtgtagccccagtatttactgtgacaaaatttgacaaacagggaaacgttactt

SEQ ID NO: 10370 - DNA, 378 bp, Homo sapiens
  misc_feature 378: n = A,T,C or G
ggcacgagcccaggctgtcctaacatttaatttaccctttattaaatgtttttgttttgttcctcaaaatgataaggcttctgaggcatttatctataatccctataatagctagatatgaacctgttacatggtagttcagtaaacatttattagctctccaactcgttttaatgcagtagatggaatcttttatttcattttaattcagtggattttaaccattttaccttgcaaacacaactgagccataccacactctgtaattacaaacagtggctatgatagggatgggaaatagagtagggaagaatggtattcttcctcttattgccctatcctgtcatctctgaggttaattgatgtctttgaaatttn

SEQ ID NO: 10371 - DNA, 378 bp, Homo sapiens
  misc_feature 306, 378: n = A,T,C or G
ggcacgagccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggngccaggccgggcccttgtgggtgctgatgctgcatgttgtccccgacacagcgtcctctccctggtggacan

SEQ ID NO: 10372 - DNA, 375 bp, Homo sapiens
ggcacgagcaagctgaagcacaagcatggccttgtggagcgggcgatggatgactacagtgtgatcggccgctccctgttcaaaaaggaaaccaacatccagctcttcgtggggctcaaggtgcacttgtccactggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatg

SEQ ID NO: 10373 - DNA, 374 bp, Homo sapiens
ggcacgaggggacacaggcagggacgcgggagctgatgcggctggaccggccggggaaacagtattttctggaagggggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgt

SEQ ID NO: 10374 - DNA, 372 bp, Homo sapiens
  misc_feature 21, 25, 26, 27: n = A,T,C or G
tacggctgcgatatgactacngaannnctgcttggaggaggtagataattttattaaattgtagaatcttaaacagaactacaaggttgcttttaaaaccagatctcagatttctttgagctaacaaatggtaaaatgtatctttagtattagagtgagataaaggtagttataacttttttttttttttaactaatttaaggtaaacgaaggcaccaaggggtacaaattgtaggaccccacctcattgaatttttatgtctgcccatgcctataaaaccaacccccaaagaaaaaggcggaaaattttctgctcccctgaaaattcccttgggccttttcctaataagaacctccaagggaacccacttt

SEQ ID NO: 10375 - DNA, 370 bp, Homo sapiens
ggcacgaggtggcgcgtgcctgtagtctcagcctcccaaagtgccgccgggattacaggcgtgagccaccatgcctggccttcattatctcttttttaaaaatgaaaaagtttataatttacattcagtaaaatcaccctttttagtgtctagtctgtgaattttgacaaatgcatggtttttgaaccaatcgataggacagttctggcacccaggacattcccctctggtcctctggtcctctcttcttcctgccccctagcaaacaactggggtttcctgccctccttgtcattggccattaatttaaaaaaaaagaatttaaaaatcaatttttgggggccaggcctaagttttgcaaaacccggcg

SEQ ID NO: 10376 - DNA, 367 bp, Homo sapiens
tacggctgcgagaagacgacagaagggcatcaaggttcatccatgtttttgcatatggcagggtttcctttttaagtctgaataatattccattttctacatataccacatttactttatccctttttctgttagtggacatttaacttgttctcacagctgggctattgcaaataatgctgcaatgaatatctcataagtctcatatatgtccatacaagatcatgaaaatggacatgtctctgggtattttgaattgcggggacaattttgcttaagggtaggcatagcgggtggctctacatttgagaggtctaattcccattcctatatatattacttttctttctattgatttgtttgagag

SEQ ID NO: 10377 - DNA, 371 bp, Homo sapiens
  misc_feature 371: n = A,T,C or G
gattcgaattcggcacgaggagacacttcctgtggtctgttctaaaaatagcagtgggaacagagctgaggggaagaggagggggctccttcgggagctgggtggggaggcctcacccccttcctcttcctgccaggcccgatgtgaggaagtcccatggagtcacataattccatctgggagagtcctggagccatcagccctcacaccccctcctcatacaggcgaggaggccctggaggcccggagagcagaaagcactggctggtgtcaagcaagcccagagagaagggcccagttggcaggctgtttttccctggctgtttcagcacagtggctgcaggccttgtgctgaggtttgctgtcactgn

SEQ ID NO: 10378 - DNA, 369 bp, Homo sapiens
  misc_feature 339, 369: n = A,T,C or G
ccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggggccttttcccccccagactgctgcttcctcgatgagcaaaangtgtttgccttctggagtctggagacatan

SEQ ID NO: 10379 - DNA, 369 bp, Homo sapiens
  misc_feature 18, 20, 21: n = A,T,C or G
tacggctgcgagaagacnannaaagggggcaggaggatcacctgattctaagaattcgagactgcagtgagccgtgatcttgccactgtagtccaggctgggctacggagagaccctgcctccaaaaaaaaaaaaagggaaaaagggtggcaaaaaaaacttaattgttgggaaaagggaaatttaattggcggttttttttttggaaatgaacggggggaaaagtccaaaagcccttttttattgggggttttggcccccgggggccaaaaaaaagggggggccttcaatccacccaaaaaaggttgcctttgggaaattccaatcaccaatggcaaaggggaatatatccccaataaagtttttgga

SEQ ID NO: 10380 - DNA, 372 bp, Homo sapiens
gccctgaagaacctctacatgagtgaggtggagattaacttggaagacctactgggagtgctggcttccgcccacatcctccagttcagtggcctgtttcaaaggtgcgtggatgtgatgatagccagactcaagccaagcaccatcaagaaattctacgaggccggctgcaaggttatttacctttagtgaattccatcttctgaaaacaatgcttttgtgggtcttcttgcaactgaactacaagattcaggcaattccgacttatgaaaccgtgatgacattctttaagagctttcctgagaactggtggcttctgaccgggacataggacagagcttgaggccgctcttcctctgcttggcgctgccg

SEQ ID NO: 10381 - DNA, 361 bp, Homo sapiens
ggcacgagtatcttgtggttgtctgacaatacttcacctttcttttaattccccatgatgttttcaattatggagagagtattaaaaactagatttaagtttctgcattgttctcattacactcaacactatttcattaagttcttgataatatgtagccttctgtgtgcgaggaaagaactaaataacacatttatttgctgaatgagatttaaggtgcgcaagtagcattgatggttttcccacacaggattctatacacttataccatcttatatctggcattttttttttaagatagcttttactgacgaacacaaagcttggttgtgcgcaaatataacgctaaataaatggcgcc

SEQ ID NO: 10382 - DNA, 361 bp, Homo sapiens
ggcacgaggtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagtttttttttttttcaatgggcctggggaaaaaaagggggaaaggtaaagggggggcattttttggtgggaaatctaaattggggcacttcaggagaattttaagccaacgtttttataaccaaaccttggggaccccagggcctttccaagcaaattttttcttggaaaaaagggggaggaaaaaagtaaaggg

SEQ ID NO: 10383 - DNA, 366 bp, Homo sapiens
cgttgctgtcggcactttgggagatagaggcaggtggatcccttgagcttaggaatttgagactaggctgggcaacatagtgagacctcatctctaaaattaaaaaaataaaagccaccagaaaaaaacctaaaaacatgccaagtgacatcagtctttgatgaaaatggcagcagaagagtgatgccatgggtgggggtgggaaatgctatttcagcagagagggagctgtcacggaagacaccatgtggctgggcgcggtggctcacacctgtaatcccaacacgttgggaggccaaggtgggcagatcacttgaggtcaggagttcaagaccagcctggccaacatggcaaaaccccatctct

SEQ ID NO: 10384 - DNA, 361 bp, Homo sapiens
  misc_feature 200: n = A,T,C or G
tacggctgcgaaaagaacacagaagggaaacctcgatgctgcagaactataagccactgggcccgggcctcagtttccccactctgtactaggaattatgacagccccactgcagagctgcttgggcttctgtgaagggttcaagccggcacctggcacacagtgacacatggaaaatgttcacacggcaatgggacgtncccagccagcccctcgctgcgctcagtgtcccagcaccaacaggaggtttcctgcacagagaagggttggtgagctaaaaacctcgacactcagcgaattgaaaacataacgcccacacacaaactcatataagccaggcacggtggctcacacctgtaat

SEQ ID NO: 10385 - DNA, 366 bp, Homo sapiens
attcgaattcggcacgagcagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacattccactttctgctacttctgtcagctatactctggagaaaaatacaaagaatgacttacacgcttggccaggaaataggaaatgggggttatttgattatggacaaggtaagatgaagatgtgactattagaggacagaaaaaacttctagaagaatactcagc

SEQ ID NO: 10386 - DNA, 365 bp, Homo sapiens
tcagagcaggcaactgagagaaactgtattacagttaccgagtggcttattaaggaaagtggcgcaacaatcaggtccatgtttcattcaaatgaccctccattcccccaacaacatcctcacatctgccaaagcaaattatgctgctgtgctcatttgatgatggaatcagcatcgcatgcaggctgaacccctactacggcagaaccaagaaagccactctttcccctctcctcctaagatgccaccacagagcagggtgccagtggtgggtggggagaaagacggagacacagaaacgtctctttttcactgtgattctcctaaggaatatacagtcacccccacaggaaaagcaagagttg

SEQ ID NO: 10387 - DNA, 362 bp, Homo sapiens
  misc_feature 242: n = A,T,C or G
ggcacgagagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggccgagcatttattctgtggggaggggtggaagctttagnaagaaccccactgggatcatgaggtgcctgccaagccttcctttatggagaaaactttaggtggtggaggttaccttttggggttggttttcttatcatttctggataaaagttatggag

SEQ ID NO: 10388 - DNA, 366 bp, Homo sapiens
gaattcggcacgagatccaagccatctgcatcgcagccttttactcgaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaaagttgaaaaacagctaaaaccccttttaaagttgcatcattgttgcaagaggtgatcctgtggcggcacaccaccatgtcccggccgagagcttacagcagacatcgcagcagccactttctccccagttcatgccttggactcgc

SEQ ID NO: 10389 - DNA, 359 bp, Homo sapiens
gtcgcttcagcgttctcgggtgctacgctgctgcagctgtcgcctcttccaggcgcaccaggtaaaaaagagtgtcaagtggacatgcaaagcttgtggagagaagcagtcctttttgcggactgttcagtcagattctctgctccaagtccatagaatctcattccaagccaactggaagagctgagtctcaattataaattcctaggagaagcaacctggttggcccaggctgactcggatgcccacctctggtccagtcaactgggattgggtctcagaagagaggggctggcttaccaggtttctcaggcttatggtgaaggctctggtgctgattgtagacgccatgtccaaag

SEQ ID NO: 10390 - DNA, 359 bp, Homo sapiens
ggcacgagcagggataagactgagcaagaatataatacttcaaaaaatgtacagctactgtttaagttttaaacagacaccatcacagtttgtggatgaaatagttttaagccatatactttctgtctttttttccccatattaatattggggggcggataatatcactttgatgtacattgatattaaagtttggtaatgcagcttttactgtctacatggtactgtacattagtttttaagcagaaacacaagaaaaatgggtataatttcaaagtagttcttggcagatggctagaagaatactgcagtgaccctgtatcccgaatacacagatatccctctattacaagtttggg

SEQ ID NO: 10391 - DNA, 357 bp, Homo sapiens
  misc_feature 357: n = A,T,C or G
gccgttgctgtcggctttggcgggtctggtttgaagctctcctgtttgacgaaagtatgtctcaggaaggtgcggtcccagctagcgcggttcccctggaagaactaagtagctggccagaggagctatgccgccgggaactgccgtccgtcctgccccgactcctctcattgtctcaacattctgacagttggattgagcatattcactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcan

SEQ ID NO: 10392 - DNA, 359 bp, Homo sapiens
  misc_feature 359: n = A,T,C or G
ttcggcacgagagaagctgctcctcgagacaaactgagcaacccactggatatatgctatgacgtgctctgtgaaaatgcctactttcagaaatttcagctagaaagggttaatctgcaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtaacctcgtcggcccctctcagaacaccattaaagttgtgcaacgataataatgcaaatgcaaattgcagaaggcggtcagn

SEQ ID NO: 10393 - DNA, 358 bp, Homo sapiens
tacggctgcgagaagacgacagaagggcgggaggtgtaggttgcagtgagccaagattgcgccactgtactccagcctgggccacagagtgagactctctccccaccactcccccacccaaaaatgcataaggataaagagatcaagagagaagacaacagaaaacaagtaaattcgtcaaaaattcagaggctggaacacaatatatgagatgagtgctaaaccagcataattggagaaagctgaaacctgaggctggtggtgatgggctcagttcttagaggtactgtatacttctgaggtacagggtaaatggaaagctgaaaaaaggaaaattgattgaaagtccaactcaaga

SEQ ID NO: 10394 - DNA, 359 bp, Homo sapiens
cgttgctgtcgcggggcggagcttgggtgcaagaatgtccaggagcaggcagagggcatcgaggagcagggcctggggcgtggcccggctgcgcgtggctggcgcgatgccggacaccagcgtctggatcaggttcctcatctggctcatccggttctgggcctcctgctggctgctggggaaggtgatcctgggtgtgtggctggaagcaaacagcacatggaaggccacgggcaggaagggtgggtagcgcagcagctggaagctctggctgtgatgagcagcccccgccagcaggtcatcgaaggccagccagtcgagggccacacacacagcacccaggctggagtctcgcagcc

SEQ ID NO: 10395 - DNA, 358 bp, Homo sapiens
ggcacgtggtgaccttttaagctttaagaggaggtggaattttggccaggacttacttctttgacattgggatctggacaggcagaagaagaagaggaaacctcttcagataactctggtcagaccagatattattctccctgcgaagagcatcctgcagagaccaaccagaatgaaggcgctgaaagtgggactatcaggcagggggaagagctgccatctgaggagctgcatgaaagacaagggctcttgcattcccaggaggtccaagttctggaggagcagggacagcatgaaaccagaattttggggggaaaggaactctgagggaggatgtttgtgctgatgggctttattg

SEQ ID NO: 10396 - DNA, 358 bp, Homo sapiens
cgttgctgtcgctcaaaaatcagatctctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaat

SEQ ID NO: 10397 - DNA, 353 bp, Homo sapiens
  misc_feature 353: n = A,T,C or G
ggcacgaggagacgtcggggactgaggcctcttcccttaccagggacctaaaaccttttctccggttgggctagttcgctctcggggaagaactacacctcctacatccaccctctacctctcattttaagtcccttgtgcctgagcatttctctccacgtgactcttaaggtgagcatgggtttatgcgtcttaggcattattgtgatggcgagcaccaattctctgatgtggaccttctttagccggggcctcagtttctccatgtcttcagccattgcatctgtcacagtgactttttcaaatatcctcagctcggccttcctgggctatgtgctgtatggagagtgccn

SEQ ID NO: 10398 - DNA, 354 bp, Homo sapiens
ggcacgagcagggataagactgagcaagaatataatacttcaaaaaatgtacagctactgtttaagttttaaacagacaccatcacagtttgtggatgaaatagttttaagccatatactttctgtctttttttccccatattaatattggggggcggataatatcactttgatgtacattgatattaaagtttggtaatgcagcttttactgtctacatggtactgtacattagtttttaagcagaaacacaagaaaaatgggtataatttcaaagtagttcttggcagatggctagagaatactgcaagtgaccctgtatcccgaatacacagatatccctctattacaagt

SEQ ID NO: 10399 - DNA, 353 bp, Homo sapiens
ggcacgaggaagaatccagcatcatttcgtcttctgattatattcatagtcattacggtgctgccaagatgttatttgtctgacacacttgcacatagtagggatttaaaaggtgagtgcataggcacctataattagtcctctatgtaggttcctacatacaattatagttaatcataaacccattaacatttagaaaaaaaacaattataacatggcttaggatggagctgtaatagcatttgtgatagtcagtgacatggatgctccacatggtcagaaagccttgatgttaggacaccaggatctagcctgagcttcttaaaaagcataaaacaaagcaaaaccaaaaa

SEQ ID NO: 10400 - DNA, 349 bp, Homo sapiens
ggcacgagacagaccaaccaaccaccttgctggaacccttgctagcaggcattcttataaaagaaactttccagcaatataaggaggctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaaaaaaaaaaaaaaaaaaaaaaaaaaaaaaaaaaaaaaccccccccccttaaaaaatttggggggggtttttccgaaaccccccccttgaaaaaacc

SEQ ID NO: 10401 - DNA, 348 bp, Homo sapiens
cgttgctgtcggctggatgtgaacctcctgggctcaagtgatcctcctgttttggcctcccaaaattctgggattacagttgtgagccactgtgcccaacaagagtgaaacactgtctcaaaaaaaaaaaaaaaaaggggaaaaattaaattggccacttttccgcaattattaagggcttaaaaatttttaaaaagggaaaaagggattgaaaccaaaaaaaggggaaagggaaaggggtatttttattaacttaagggccagggcccccgcccccatgggaaaacctcccaaaattttaaaagggaaaccggtccctcattaggaagaaaaaggaccggaattttc

SEQ ID NO: 10402 - DNA, 348 bp, Homo sapiens
  misc_feature 2, 3: n = A,T,C or G
tnntgctgcgagaagacgacagaggggcagtttgaaaaaggacctggttgccaaagtaccatattacccatcaatgtcctctcctacccatttccctttttcacaccctctaaatctctataagcaaatgcggaaaatgcaaactaagctttgaacagaatcaaatgagtccctctgggacacttgcaggggacttatttcttccgaaggatgtgacagcagcttctcccaatagtggcagcgtttgtttcactgttagactggaggagcacaaggagcatacaacatgtggctctgtccacaccactgtgaagttgttggttctgagaaattactggggggagtgtt

SEQ ID NO: 10403 - DNA, 349 bp, Homo sapiens
agctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttcttgcagcccctgctcaggggcctgcactcccagaacttcacgcaggccctattggagaggatgctctctgaactgccagccttggggatcagcgggatccggcctacctacattctcagatgaccggtgaactgatcgggggcaacacccagacttgaccgaatgctcgcggattttctgcagcc

SEQ ID NO: 10404 - DNA, 351 bp, Homo sapiens
  misc_feature 351: n = A,T,C or G
ggcacgagcctcggcctcccaaagtgctgggattacaggtgtgagccaccgtgcctggcccgggaatatttagaagagagtgatcatctctatcaaatacttcgatacattaaggtgaaaactgagacaggctattggatgtgaccaaatagaagttggtggtcaccttgataggcagtttcagtcaatctgattggagtgggttcacaaaagaacgggatgagaagcaaacttagacaattttctggggacttttgctgtaaatagcagagaaattgcataatagggttaaaagagagggttattattattttattaaaggtgcattgggagtgatcctatagaaaggan

SEQ ID NO: 10405 - DNA, 354 bp, Homo sapiens
  misc_feature 9: n = A,T,C or G
tacggctgncagaagacgacagaagggggaaatggggctgggggccgtccccgggagacaggcggccttccgagagggactggagcaggccgtgcggagtgggcattgcttgatgggcaggaagttgagtgttccttgcaagggtgctgtggcaagaggaggcctggtgtatttggcagcgttcctgaggctgtacatgatccacctgatggctggtcgagtaccccagggagctgatcgaatagcagtcaaggctgagatggaggccgtttttctggagaacctgaggcatgcagctggggttttggctcacgaggacctcgtgggactgctggagcccatcatcacgcgcat

SEQ ID NO: 10406 - DNA, 346 bp, Homo sapiens
tacggctgcgagaagacgacagaaggggtttcaccatgttggccaggctggtctccaactcctgacctcatgtgatccaccctccttgacctcccaaagtgctgggattacaggcgtgagccactgcgcccagcccaaaacaaacttgttgggactcccaggtgcttatagacatgtgtttggaaatattagatagacaactggatctgggctctggaacttagcagagaggcctagactagagatacaaatctgggagtcaccaccacatagacagtggaggaagctggagactggtgagattacctgccaagagagggagtgtgggtggagaggagggcacaag

SEQ ID NO: 10407 - DNA, 333 bp, Homo sapiens
aacatacaatatagaccgtatatacgaaaattcacacatctattcattctttgccgacactcaacgatatgcgcttcacatgatcactactgcaggcgaaaggtctatgacatgtgacttcattgctttattcctgactatacattcgcgactttcagctaggaaggcacagcattagcattcattcaacagacttcgcttctcttagaccaggaagaggtactaagagaactttccataggcaactctcccgcctttttgaaaattaactgtttgtgatttggtatcataaacaagtgatgtaacttttcaggtgaattgtttctgtgttta

SEQ ID NO: 10408 - DNA, 320 bp, Homo sapiens
  misc_feature 214, 238, 262, 269, 274: n = A,T,C or G
tacggctggtagacgacagaagggaccattcttttactctgagttcttccattgtgatcatctagtcagatgggtagatccttataaggctgagcataataagcttcctgatagctctacactggtatgttttggggttcatggctgagctacttttgtgttttatttatcttcctgatctctttttcactgtaagagacatccagcacccagngaaatttgctggctaattcatacntcactcttcagactagtactagtngtcagtnttgtntttgttttttttctgtgctgaaattctattaaaattgtcaggctgt

SEQ ID NO: 10409 - DNA, 297 bp, Homo sapiens
gttgtctaccatgtatcagatgctcaaatatagttacgtgattttttcattatgtagcaactgtgcatcttcatgtcacaaacttgcaagaaatagaatttctttattatcttataaattgggttgtctcacgtgtcccacttctgcctgatgggagaaacttaatatacagttaatgccaggataactcagtcgattaagagtttttttcaggtaagtcttaatattcctgtagatgaatggataaacaaactggcacatccagacgatgggctattattcagcactaaaaagaat

SEQ ID NO: 10410 - DNA, 694 bp, Homo sapiens
  misc_feature 509, 521, 569, 588, 611: n = A,T,C or G
gattcgaattcggcacgaggccaggggctaaatagttcattgcaggagcactgagggctcagaaacctccagacagaactggcttggtcctgctgggcagagatgatgagcttcggtgtggccagaacggtgggggtcctgggcaccctgtgtcaccaatcccaggggagaggctgtgtgtggtgagccttgttggcactgcatcatgagccacgagcagggcgtggccactgttgtgcaggtgactccgccagggagccatggtggagctggggagctgggcctgtcatgcggtcccccggggagccgcagtggagctggggagctgggcctgtcatgcggtcccccggggagccgcagtggagctggggagctgggcctgtcatgcggcccccggcttctcagaggtgttatcatcaggtccccccacacactgataggggtgaggttggaacctctgtgctccagctccctctgggctctttgggagccagcctgggaggcctcanggaggaacttgnatggagactgggactggagtcttgccttgggtttcctttggggccggnctgcaagctttttggcttnttagcagcccttggaaacaaccngatctgtataggaggggagttgacaaaactcccggagaggagaagacgacacatgccaactgttgcgtggtaacacagcagcc

SEQ ID NO: 10411 - DNA, 646 bp, Homo sapiens
  misc_feature 307, 316, 324, 387, 514, 572: n = A,T,C or G
tacggctgcgagatagacgacagaagggtaaggggtgagcccaagagcatcaaggctcccatcaacagccagtcctgtgagtgaggccatcttggacctgccagctcagtaaacccttttgctgaacacagcccaaggaaggaacccttgcaaaatgaaatcgtgtggtcagtttgcggggtggttattacacagcagtagatgattgaaaaggcccagtgtcttcctggggactgaaacacccacctcctgttcatgttgatacacggtgagcagcatatggatgtgggagtggtgttggttgcangtgaggtanagaagcantgaacagagcacgaagacctgatgttccagggtcgggagtttagacttgatcctaacaacggncataggcggatataggcaaagagtaaccgtggcagattttcattttaaaaagtactctgacatccattggaaaatgaacttgatgtcacaaggctgatggagccaggatgaccatttgggaggtgantgtagtaatctacttacgagttcattacgagctggggaatgttgatggtgttaagacnaaaaaatggttttgcacacccgacggagtgataaggtcttaatgggccacgcgcgcatgtctcccctcttaccg

SEQ ID NO: 10412 - DNA, 660 bp, Homo sapiens
  misc_feature 502, 597: n = A,T,C or G
ggcacgagaaagggtctggggaaaaaatttttcttaaagcgacaagactcttatatctaaaaggaaactgacttgccaccttgccagaggaattcttgaaatgtttctgcagccacttggccttgaaaataaagggcgcaactctcaagtcttgttctaacccggctggaggaaccacaagacccaatgaaatagcattttctctccttttgccagcactagtatataacctatgaggaacccttgtctctgaatctgctcagcttgaaattttgtctctgaaggaagagaatgaactcagccctagtctgacagtcctagatttctgtgaaataagagtattcttcaacttagtgctcacactcacataccatgagggttctctgcaggggtttaggcggttcctgaatttaaaagttctttaaaggcctctctttggtaaaacaattgaaaggcagacaccaacaaagtctgcaaaattactgtccagataggatattangagctgtaaattagcttgagaaatgacctatcttacgtttaacaagtagaaatctaaattgtaagcttctgacaagtgtatgtcattaatgctangacatggatgattttatcccctactgggatatgttggtaacaaactcatggatgaagggcaaa

SEQ ID NO: 10413 - DNA, 219 bp, Homo sapiens
ggcacgaggaataatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtat

SEQ ID NO: 10414 - DNA, 215 bp, Homo sapiens
ggcacgagggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacag

SEQ ID NO: 10415 - DNA, 445 bp, Homo sapiens
ggcacgaggagagagagagagagagagagagtgagagagagagagagagagagagagagagagagagagagagagagagagagagagagagagagagagagagagagagagagagagagagagagagagagagagagagagagagagagagagagagagagagagagagagagagagagagcccccctctcgcgctctttttttttttttttttttgggcccccttttttttttctttttttttttttattaaaaagagggggggggggggggggggccccccccccccccacaggtatttcttttttttttttttttttctaatgaaaggaaggggcccttttttgcgcccccccctccccccctttttttgggggggggggggcccccccggccttccccctctgggggccaccacttccgtgtgttttttttttttttcttt

SEQ ID NO: 10416 - DNA, 449 bp, Homo sapiens
atacatgcaagctacgcaggattccatcgagacgaattcggcacgaagccagcatggcaaaaccccatctctactaaaatacaaaaattagctgggcatgatggtgcacagttgtaattccagctactcaggaggctgaggcatgagaatcgcttgaacctgggaggcagagattgcagtgagcccagttcgtgtcacttcactccagcctgggcaacagagtgagaacatgtctcaaaaaaaaaaataaaaacagtgaatgggtgtaggtgtgatggaattcactttacttactaaagggtttcgggaggttgtttctccaggtaaaattgtcgcctctctggtcccattcccaccttcaaacattatatgcaaacagttttaaaaaatcttacagttctaaaaggcttgtgacaaaaaaagaggcagtccctctttcacattgacaa

SEQ ID NO: 10417 - DNA, 451 bp, Homo sapiens
tcgaattcggcacgagacctggtgtctgagtgattctctgcagacccttcccctcctcaaggatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccaaatctctcctgccctccctggcaagcagggaccaacaccttgtatcaccccaccacacgcagactcatgcacgcacacaggaaggaggcctatcttgctcaaagctgcaaggaagggccaagaacccgctgggaggggggggcccttttgttgaaaacggtaagaaagcgaggagagggtttgattagagaagcttggggcccctgccagcttcttgg

SEQ ID NO: 10418 - DNA, 431 bp, Homo sapiens
  misc_feature 339, 367: n = A,T,C or G
ggcacgaggtttatcgaggacacaatgaggatgccaaggcacagagaagttaaggaacttgtccaaaatcaccttagtgataactggcagagcttgaatcagaattcaagtaatctggcgtcatgtccaataccactaaccattgcattctgctgcctctcagaaataaaccaggcatagagtaaaaattcatctgtagttcaagaaacaatttattgaagcttcctttttctgtcaagtttggaaaacgggagagaagataggaatcgagactgagaagacgaccaagtggttctgagctgagagaactgggaaattgaaggacgtagattagctaanggaagaatacaagacctgatccttctanaaatttttttaatggagggaattcacaaaacataacagccatcttaagtgaacaatcagtgaaa

SEQ ID NO: 10419 - DNA, 437 bp, Homo sapiens
tcggcacgaggcagaaatgagtaaagtttgttttatcttttcttaatatgacaattattgtgttggttcaacttatgttgtactttaattagaagaaatttggccgaaaatacaaggaaaatatacaaatgcaagtaattttttttaaacttccctgaaagcagggtctaaagaaattaccaaccaacttagactggatctagaagaaaaggaagggtctttgcagtcttaggactcttccgttccgcgacagacgtgttaggataacagccataaatggttgtaagactttgggctcagatacagagacttaagttcacattttgacttattttacaagcgcgcgatttttagcaagctcatcttcctaaaccatgagctgcttaatttgaaaggggacattagccactcttcagcagcagccctggtacttactt

SEQ ID NO: 10420 - DNA, 429 bp, Homo sapiens
tcgattcgaattcggcacgagggaacacgttcaggggattgtgaggtcttgcacaagccacgtggggcaccttggcttcccggcaggaggtggacacccagccagaggcctggctcaaggtgacctcaccttcaccatgggcttcctgggtgcgcgggcctgagcgcaggttgttttgtacatattggaatatgtgttaacttatgccccgcatcccaactcacacggaagcacgggtcttgtctcagtctcttcgctgcatttggaaagcagtctcctctcgggccagcgccgggctgaggtgtccagaggcggcggcagctggcagtgccctcagcccccaagtgtccagcctggcacttcccattcaggccacctgctttgggtcaacagttcctttgccagcagcatctcctaaattgaaggact

SEQ ID NO: 10421 - DNA, 434 bp, Homo sapiens
  misc_feature 422, 426, 427: n = A,T,C or G
cattcggcacgagattgaacaccagtatacaataactttagggtcatatggatcattggtttcacgattacagtaggtctggtgcatggcactcccagatctagtagaggctctgatgtcagtagcaggatggaggagagctgggcttacagcctctcaacttgttggcccttataccatcactgcactcatgtccttgctctgtgcagaagtagaatcagaaaagcatcaggcaccttcatggtataaattgtgtctatgggtgcagtgaataagcaaaaatcagaagcagaccggagggacttataaaaataggtacagggtcacaatgggtgcctatatgtagcctgtgacagataagaagctgacagtgagacaaacaaaaaactgaggctagagcctcattcctctgactcctaatncagnngtctctc

SEQ ID NO: 10422 - DNA, 438 bp, Homo sapiens
ggcacgaggcaaggcccagtggatgagaatcccatgatggccatatttctgcagcatgccgcaggactcttacatgcaatgtgtacactgtgctttgctgtcactgtgaaggcatacagcatatttgacaataatcgccaggatcccacagggctgacagctgctcttcaggcaaccgacctggctggagatcttcatatgctctactgtgtcctcttccatggcaccatcttggaccccagcactgccatgcccaaggagaattacactcaaaataccatccaagtggccattcagaggttacgtttcttcaacagctttgcagctcttcatctgcctgcttttcagtctattggaggggcagagggcttgtcccttgcattctcgcacatggccagctccctgctggccactgcagccaaagtctctgtgaaagcc

SEQ ID NO: 10423 - DNA, 434 bp, Homo sapiens
ttcggcacgaggcctccaggaggcaccaggcaggccctgtatcaggctaggacgctctgagctgtgcatgtacatatatacatatatagatacatttataatatatacacacagtctatatatttatatacactgtttcctggccccagagctcatttgggttcaggcgcacttcaaaaccctccctgggggaggctgtttcttctcaggattccttgccagggaggaaggggagggaacagggtgggttttctcactgaagagagaaagcagaaggttctagatcctggcacagactgcatcccatgttcccatgctcttctccgtccccaggaatgcgaacggcagtttcccttcctcagtggacgtctaggtggggacaggggatcttggcttccagcctgaccatgagagccctgcttgcctcttgtctt

SEQ ID NO: 10424 - DNA, 425 bp, Homo sapiens
  misc_feature 129: n = A,T,C or G
gcatcagaccttctgcggatcccatcgattacaattcggcacgaggccagcagtcctctgcagacatcccttagccggcctgctggccttgctgactttggaccttcaagcgcctcttctcctttgagntcccctttgagcaagggaaataatgttcctgggaatcccaagaacctccacatgaccagcagcctatccccagactctctggtccggaaacagggcaaaggcaccaacccctctggaggacggtaaccatctgggccctccgacttccttcaaccaaaccagggctagagtcctgacctgccagtggtctttggatggcttgccccgtgcagcatcttgcatcctgagtcagaagtggaaatgtccagcaagggaaggacaggcaggtggatggtgtgagcacttttatcatctgt

SEQ ID NO: 10425 - DNA, 432 bp, Homo sapiens
ggcacgagagccggccgaagcgtggcggccacagactgtgggtaccgggtccgagggactcgcgcttttgtgtccgtgccatggcgccagcgagggccacgaacgtggtgcggctgctactaggctccacagcgctgtggctttcgcagctcggctccgggacggtcgccgcgtccaagacggtgactgcccacttggccgcgaagtggcccgagaccccgctgctgctggaggcaagagaattcatggcagaagaaagtaatgaaaaattttggcagcctttggaaactgtgcaagaattagcaggttataagcgaacagaatcagattattcctattacaacttattcctgaagaaagctggtccgtactagacatttacacatataccgcttaaagtgagctggcgccatattggcatactccccagct

SEQ ID NO: 10426 - DNA, 430 bp, Homo sapiens
  misc_feature 407: n = A,T,C or G
ttcggcacgagttgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaaccaagaagaagccaaggcccggcccttgagagtangcgacacggagaagccagagctt

SEQ ID NO: 10427 - DNA, 430 bp, Homo sapiens
  misc_feature 329: n = A,T,C or G
aattcggcacgaggttgggcgagatgaagctacactgtgaggtgtaggtgatcagccggcacttgcccgccttggggcttaggaaccggggcaagggcgtccgagccgtgttgagcctctgtcagcagacttccaggagtcagccgccgggccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggccatttccagcagtttaaaaggnttcctttcagctatgagactggctcatatgaggctgtatggtgatacaaccagttcaacgctcacacccagtgagacttcagaaattgaaaacttaatact

SEQ ID NO: 10428 - DNA, 408 bp, Homo sapiens
ggcacgagggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggct

SEQ ID NO: 10429 - DNA, 405 bp, Homo sapiens
  misc_feature 405: n = A,T,C or G
cgatgctgtcgatccctccagaaagtaattaaccagcagtagagaaaagcagctgagcttgaaacagtccgaagagaataggacatcagggcttttacctttacagtcatcatccttttatggtagcagagctggatccaaagaacactcttctggtggcactaacttatacagtattctggaagaaaagactaaggaaaataaaggcaaggaaattggcaaagaagtaataaatgaagatggtgaaagtcctcacatcgaaaagcctcaaaaaataccaaacaacaaatactttttaaaaaatccacattttgtcaaaaaagatgctggtgaagttgtggagaaaaagaaatgtgtatacactgttggtaggagtgtaaattagttcaaccattgtggaagagn

SEQ ID NO: 10430 - DNA, 414 bp, Homo sapiens
cgttgctgtcggtttctataaactttaattacctctgatgaggagtgtatcccctcatcacattcaccccaaaggtacagaggagttcatttttaaaaatgtgttagagcaataaaaggccattatagggagggaggatggggtgtggaagagacgatagagcgagcgagagagagagaaaacacactagctctccctgctggaataataggcttgaaatatgaggaagttgatcaactgccgctgccttccaaaaacagattaatccaccttggtagctttcctttcagagcaagcttttggctctgtcgactttctctatcagcctgaactcaaaaggacacaggccacatgccatctgagcttaagagttattttgtgtgttgatctgagaacttcacattttaaaacaat

SEQ ID NO: 10431 - DNA, 412 bp, Homo sapiens
  misc_feature 241: n = A,T,C or G
gtccgtcgctcgccatatacattgaaaactcttatcttgtgttcactttgcattccttgcaggttgaggatgttttgatttctggtcttagtctcattcttccttctttgtcctgttggtcttgttcttttctttttgatttgtagggtatattaggatggtgcaaaagtaattgaggcttttgcatcgttgaaatttgtcatttgatactggaataccctcttaaaccttcttaaatgtnggtatgttatacatcattttaatgggcatttctcactttgttttttttttttgctaaggactaataactggctgtttatatttattttagactatggaaaggattttagacaaaaggcaccttcaggtggttttcttatttgagtccaaaatgggtcataccgcagcaaaa

SEQ ID NO: 10432 - DNA, 407 bp, Homo sapiens
cggcacgagatttctatggataggaggctgatttgttccattatgcgaagatgatgggaagaaaagctggatgtgcaaatgcaggtgaatttgtggatatattagaacgaagacgacaggccttgatggatggttgaagaactcaaacattagacagtactgggtctgagttctgactctgccttttgcaagctgtgcaaccataggccagttatgaaaccttagttatcaagttataactaataggattgtgttgaacacgaaatgacatgataaacatatgtaaactgcttggatcagtggcccactagctcttgttaggagctaaaatgttagctcttgctgagggtgctgtcaaatggcttctgtttctcatggagcagacatctataaggacatccactggt

SEQ ID NO: 10433 - DNA, 407 bp, Homo sapiens
cgttgctgtcgggcatttatatcttctatacttcccaaatgaatttaagatgacttaaaataaaatttcttaacagaataaatggtttttatatgtgggaggcgagtgcctccctccttagaggctttctgcaaatcatttgtctttaccttggctctctgaccttgatgaagtactgatgaactgagagtgtttttgtcttttctctgattaccaaacaacaatcatttattaagcattcattaggaaaaagacactgcgctaaatatagagatacaaagatataaaactcaaattttctacctgtaagaagctcataaactaggcacggtggctcacgcctgtagtcccagcactttgggaggctgaggcgagaggatcacttgagcccaggagtttgagaacag

SEQ ID NO: 10434 - DNA, 415 bp, Homo sapiens
  misc_feature 407, 415: n = A,T,C or G
cacgaggacacatggaagagatgaaggttctaacaaaactcggatggaggatcaccgatttcaaagcttccgtggtctcccagtcgcttctaacaatcactcacgcctgaaggcaactcccaggccttcctgactgcacaccccaagtgtctgactccctcacaaggctagaaactacttcaggtagaagccacaggggtggcataatgattaagaataaaaacactggactcagagaggtggctagaaacccacactccaccctcccttgctccatgactctgcaagcaacctccggagaagctcagcttcaccctctctaaagcagaaacgagaaggaatcctgtgtgtgtgtatgtgtgtgtgcatgcgtgtgcatgcgtgttttaaattataacgctatatcntgaaaaan

SEQ ID NO: 10435 - DNA, 413 bp, Homo sapiens
  misc_feature 64: n = A,T,C or G
cgttgctgtcgggcattttgaagaaacatatgatatagctgtttggaaataaattcatctatgntacttttttttttcttttttttttttttttatgaccgggaaattttattggccaaaacctctttgggggtgggggggcccatgggccccggaaaaaattttccattattcaaaaaaatggttttggggttttgaatttttagcccctttcattggtttttcccacccccaaaacccttgttgggttttttgttaaaaaatttgataaattacccccctttttttttgtttttggctttttggaaaaattgtaccaccggagcgggtttgcaaccttgggggggaaaaaccaattttcctctagggggacccaaattgaaaattggggcccgggatttaatttaaaaccc

SEQ ID NO: 10436 - DNA, 406 bp, Homo sapiens
  misc_feature 354, 390: n = A,T,C or G
ggcacgagagcaactagggccctcatcacttcgccgccgaatccccggcgccgcccagcggggcagagccaggccagggccgcccgcccaacctggtccgctgcctcttcggccatggaagctgccggcagccctgcggctacggagacagcttctccactcttcctcctcctccacctccgcccatgaaatggtgcactctccctttaagactaagatggtggcttgctacgatcgggactccacttccggtggggaggggggcgggaccccagcccgctcacgccggaagtggttgcgtttcaagatggcgactcctatgtactgacgagaccggcgggggggaaccgccanactctcccttcttttgactcaccttggatacatcanggcagagatggaccaa

SEQ ID NO: 10437 - DNA, 413 bp, Homo sapiens
ggcacgaggacagccagagcccccagcacctggcactgctctgccagcccctgaccggaagcgcttctccctgcagagctatgcggattatatcagtgccgatgagctggcccaagtggaacagatgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggg

SEQ ID NO: 10438 - DNA, 422 bp, Homo sapiens
ttcggcacgaggagagagagagagagagagagagagagagagagagagagagagagagagagagagagagagagagagagagagagagagagagagagagagagagagagagagagagcgcgcgcgcgcaaaggcgcgcgccccccccccctctagcgcgcgcgcgagagctatctttttacaccacaaaaagtgtgtatatacgcgcacacacacacacaaagaaaaacacacgcgcgccacacccccttgggggggggcacacactgtgtctcgagagagacagcatatattcgcgagagagcgctctctagaaaaacacgcgcgcctctctgtttttatttgcccccccccaccacgcgcgctgcaaaaaaaaaaaaaacaccactctctcttgtttttgtggggtaccccacccaccg

SEQ ID NO: 10439 - DNA, 417 bp, Homo sapiens
ttcggcacgaggagagagagagagagagagagagagagagagagagagagagagagagagagagagagagagagagagagagagagagagagagagagagagagagagagagagagagagagagagagagagagagagagagaggggcctgtgtgtatctctctctctcaaactctccctctctctctagagatttttttttgtgcgtgcccgccagagtgtctctctttttgtgcgctctctatatctgtccctggtgtgtgttttccccctcctcttctgcccccccggttttatatttttgctccccccccagagagagtgtgtgggctctttttcttttttggggccccccctccctggggggggggtttttttcccccggggccttgggccctattcccagcttgggggggg

SEQ ID NO: 10440 - DNA, 422 bp, Homo sapiens
  misc_feature 357: n = A,T,C or G
attcgaattcggcacgaggctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattancagcctgaggagctggctggctgggagcctcggggaccgcccagccttgctcccagctcacccac

SEQ ID NO: 10441 - DNA, 405 bp, Homo sapiens
  misc_feature 391: n = A,T,C or G
ccatcgattcgaattcggcacgaggctgaacgcgcggtcaccctcggccgccgcacccagcgcacttcccggcgcgattcctggacgcacactgcaggaccaagggcacgcagaggtcggagcctgcccagaagccacacctggccagaaaaaccgaaggtgtatcaaggtgtccgagtgaagatcacagtgaaggagctgctgcagcaaagacgggcacaccaggcggcctccgggggaacccggtccggaggcagcagtgtccacctttcagacccagttgcaccatcttctgcaggactgtattttgagcctgaaccaatttcttccacgcccaattatttgcaacggggagaattttccagttggggttcatgtgaagaaaactcangctgcctcgaccag

SEQ ID NO: 10442 - DNA, 418 bp, Homo sapiens
ggcacgagcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatc

SEQ ID NO: 10443 - DNA, 398 bp, Homo sapiens
  misc_feature 398: n = A,T,C or G
cgttgctgtcgggctagcgcagccccccggagtccttgttctccttaagagggtctcgctctgcaaagcattggcgccatggcttttcctttgcatgggtgtgcacaccgagagacaggcagcttatgaaaaacaacataaggaagacttaaaaggatgcactgatttacgacgttttttgatgttagccatttttttggaaattgttttttaaagcaaaagttctttaaaaacatggtttatagtttttcacttacatatactattgcaaatacttagcagagtcttaagttactgtataaaacatttcattgcgtttgaagacatacttatgggtcttgaggcctgggtcctaatacttttaaatagcgtatttattatgtaaactgaggagtgcn

SEQ ID NO: 10444 - DNA, 388 bp, Homo sapiens
aattcggcacgagcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccatcgggtggaggggagggggaggctgccggaagcctccagatgctgcctgcctgcctgcagaagcctgcagtggctgctgctcctgcctctgcagccgccccctctctccacccaggccccactcagagctccgcggcgggcagccctagctgtcacaccgatcagctcctcctcctcacggg

SEQ ID NO: 10445 - DNA, 388 bp, Homo sapiens
cgttgctgtcgctttttactaatcgccaaattgattagttagcaaatcacctcatcttccaatgaggtgaccctgtgtacccacactcaggctaagatgctggcaaaggctaagaaacagcagagtcctagctagctttgcttacttcctggaactgttaacactttttgaggcaagcattagacaaaaagggtccttttgagacaataaccccataataaaaatgccttacatttttgagcactatattttaagcactgttttttatacatattcattcatttaattttctcaacaactttaccaaggtgacactacaatgatgcctatttcaaagataaggcaactgagagctgagaggttaataacttaaatcatcctcaattct

SEQ ID NO: 10446 - DNA, 398 bp, Homo sapiens
ggcacgaggcagaaatgagtaaagtttgctttatcttttcttaatatgacaattattgtgttggttcaacttatgttgtactttaattagaagaaatttggccgaaaatacaaggaaaatatacaaatgcaagtaattttttttaaacttccctgaaagcagggtctaaagaaattaccaaccaacttagactggatctagaagaaaaggaagggtctttgcagtcttaggactcttccgttccgcgacgtaagtgttaggataacagccataaatggttgtaagactttgggctcagataagtagacttaagttcaaattttgacttattttacaagtgtgtgatttttggcaagctcatcttcctaaaccatgagctccttatttgaaaggggaca

SEQ ID NO: 10447 - DNA, 398 bp, Homo sapiens
  misc_feature 366: n = A,T,C or G
ttggtctttgtttttcctatagggaaaaaagtcaaaataagttccaaaaactatcctcaaagtagtattgtgcttgtagtaaatgaaggttggatggatggatactgacaatggtggcaggcatttcaagccttttaaattagtactttttgtcgtcttgcttattaaaattttgttaattttagcaaagaccaattgttgtgataaactggggttttttggatgcttcaagcacacgtttacccattttttaaattcccttttgggttcttcccattgtcttaaataggactttcatattattaaaaccctcaaaagatgatccacccaggatgaaccaagatcaccaggggggagaaaacattnttatctttaccgaaacctgtaaggatatatat

SEQ ID NO: 10448 - DNA, 402 bp, Homo sapiens
  misc_feature 402: n = A,T,C or G
cgttgctgtcgcttttaatgcccagtctctccttcaaaagccggctcctttctctccctcgccttcctagattccttctccactccccaggatcagcctcctcctccccaccccaccactgctggggggatgtctgtggtcaggcatttatcagagaccctgaggtgggggtcctttatgtgtctgggggatggagagtctagaggaggtagcgttcagacctctccatggtgcctctgctgggctcacatgtgaccaagcacagcaaaccatgaggcaggggatggtcttgaccatgagagcccttgcagcagctgccatgggcctcagctcctctccaagctgggaagagccctgaaaagccaaggtgttttttttccctctttatttcagtgtaagtcn

SEQ ID NO: 10449 - DNA, 386 bp, Homo sapiens
aaatcatattacaccttcaaaatacacactctgaattataaagatgtgtttgttttctttccaaatcatgtagaattgatttccagttcaaggataaaccaaaacaatatttagaactatcaagtgatctaatttattttcttttggcttcttctttacatttactgttattttattattattagtagtagcagcaacagagtatgatatgacccaaaagccattgtaaagtgccacattaccaaaattaattaagtaaactttatagcctgtgggagtctattataatattattttgcaaaagagaaatatattattgttcatgagactcttgtgagtgctagatgtaccatactttatcttatttgagatagaatagcatgatt

SEQ ID NO: 10450 - DNA, 385 bp, Homo sapiens
taccgctgcgagaagacgacagaaaggcagggtctcactgtgtcccccaggctggagtgcagtggcacaatgacgactcactgcagcctcaacctcctggggccaagtgatgctcccacctcagcctctcaagtggctgggaccacagaagtgcaccaccatgcctggcttttttttttttgggacaaaaggggggaaccttgtatgcccaaaatgggtttcaacttcgggaccaaagggagaccctctgggtttggccccccaaggggtggaattacagaggaagaggaacatggcctagctgattccagggtttaacaacaaaaaaaacctcccccaactgccatttctaatattttaaaaaaacccggcccccaaacttggg

SEQ ID NO: 10451 - DNA, 389 bp, Homo sapiens
ggcacgagggatttaagaacgttgcctccaagtttttgaattgtgaatttttgatcatatttgaacaaaaccccacctacagtctgcatggtcattgttctcacaagggtttgtgtgatgcactgacaagaacagaggctttggaggtgactcctgggtttgaatcaccatttgccactagctaattctaaccttaggtaagtcagtgtctctgggtctcaacctcttcctctgtgaggggtaggaaatagcacataacttgtagcattgttataagggctcgtgataatgtttttaaaacacctgactcaagcactcaggaaaatgttgtattatgaggaccacgtgtctctgacaggagtgacactagagtctggagacactacact

SEQ ID NO: 10452 - DNA, 402 bp, Homo sapiens
  misc_feature 287: n = A,T,C or G
ggcacgagatacttctaaatttaaattgatgtgtatccatatacattagtctatctaaaacatgttgaatgaaaatggtacattacaaagacatacatagaacatttttgttgaattcaaaaacctaaaacattggcatatactatttatgaacacttacacacatgagtaaaaattaaaacatgcctgatatgtctggcacataataggtgctcaggaaatatttgttgagtgaataaatgatactgagaatataacctgataatgtaggatagttcttagcctanatatttaaaacataagaattggtggtcttaaaaataatatttattttcatatcttttagatatgggtaagtgtcaccttaccaaaggcaaacaggctctagagattcgaagtagt

SEQ ID NO: 10453 - DNA, 388 bp, Homo sapiens
  misc_feature 388: n = A,T,C or G
cgttgctgtcggaaaagtcagtttttctagagctagttaggcaggccctcattcctggtttggtttcaattgcagagagttcttgtatctctgcaggggaatttctgactcatggggtgggtccctgactccttactcctctctgattgagtgaaccagcatctggggcaaatacgtagcagtcagatgctctgatgaatgtccctgttcagttctttgacttttttgtatcctccttaaataataatggttttaaagataagcagaagcctatctatagtactttatagatctcagcagggattattcatcttacagttaatacaggaagaaacatctttgatacggaaagactagggtgttaattcagcaatctctggttaggagn

SEQ ID NO: 10454 - DNA, 386 bp, Homo sapiens
  misc_feature 386: n = A,T,C or G
tacggctgcgagaatacgacagaacggacgaaagcgagaatgagccctgtactctgtcatgctccaaactgctgccccatttttagaccacagagcaagatgaatgctgttggaaggaatgtgtttatgacagagacagtttttaatccatcagagagcaatacttgcgactttaaatatggcatatggtgaaaaagtgtccctgtgatgagtcagcaaagaaaattatttcacccctcacatatacgagggcttgattagctcactgattgtagttttactagtgtgcagcacagactcttatttaaatatagcttgagggaaaactctgacatcagaatttgtgcatgataaactgtgttgctcaaacttcagaggtctggttn

SEQ ID NO: 10455 - DNA, 387 bp, Homo sapiens
ggcacgaggtttatcgaggacacaatgaggatgccaaggcacagagaagttaaggaacttgtccaaaatcaccttagtgataactggcagagcttgaatcagaattcaagtaatctggcgtcatgtccaataccactaaccattgcattctgctgcctctcagaaataaaccaggcatagagtaaaattcatctgtagttcaagaaacaatttattgaagcttcctttttctgtcaagtttggaaaacgggagagaagataggaatcgagactgagaagacgaccaagtggttctgagctgagagaactgggaaattgaaggacgtagattagctaagggaagatacaagtacctgaatccttctaaaaattttttttattgaggtg

SEQ ID NO: 10456 - DNA, 397 bp, Homo sapiens
cgttgctgtcgctaccttggctctttatctaccttcattttttaaaatgtatttattcttcactagttttctataaagagtctatatagttttataatcaagaaaccaaaatccctcaatttactgagaaagaactattggttaggagtgacaagcatgcttgggaggatattttcttagaaaagaggtaagtgttgtaaaacaaaacaaaaagcgtatttcttcttctaagatttcagaagaattgaaagaagaaaggtacatggctgctttatcttcacccctagttttatcctaagtgtgccccttcagtctctgcctatcactgagacagtctggtggacagtgagaagcagcctcataattaccctttggtattctctgttaactctcatca

SEQ ID NO: 10457 - DNA, 397 bp, Homo sapiens
gaattcggcacgaggagagagagagagagagagagagagagagagagagagagagagagagagagagagagagagagagagagagagagagagagagagagagagagagagagagagagagagagagagagagagagagagagagagagagagagagagagagagcgcgtgtctctctctctctctctctctctcacacacacaaaggggggggggagacaccccgatatattttttttctctctctgctcagtgcgcccccccccctctctctctctgtgtatatatatatatctctgttctctctctctctctctcacccctcttttttttgcgcccccctctctctcgagagatctctctctctttttttcacacccccccacgcgctcttttt

SEQ ID NO: 10458 - DNA, 393 bp, Homo sapiens
  misc_feature 36, 37, 38: n = A,T,C or G
ggcacgaggagagagagaactagtctcgagagcagnnnttttttttttttttttttttttttttttttttttttttttttttgttttattcttttttttttttttttttttggggcccccccccgggccttaaaaaagggggggggccgccacccggggggggtgtaaaacaaacacaacacaaacccaattaaaaaggaaaaaaaaaaatttctccccccccccaaaaaaaaaaaaaaagggggtgttgccccccaaaaaaccccctcccccaaaaaaaagggggggggcttttttttgtgcaaaaccctccccccccccaacccaagaggggcgcccccccccccccaaaaaaaaaaaagggggcggctctcttctcttctctaaaaaaag

SEQ ID NO: 10459 - DNA, 398 bp, Homo sapiens
  misc_feature 398: n = A,T,C or G
ccatcgattcgtgtccatataaaattctagcccagaagttctcatctggggtagattttggccttcagaagaccaatttggtgatgtctggagacatgttgggttgtcaaaactggggtggggaaaaggttgctactgtgcaatgcatacctcctcaacacccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccn

SEQ ID NO: 10460 - DNA, 387 bp, Homo sapiens
ggcacgaggttagaattgactggatagtaacaggtggtctggtggatagcggggagcatggctcagcaccagagcagaggcccagccagccctctgcagcccaaacgtccccaacggttgcctggcaccatctctctctgatgagacgaatctcattttcatttccattaacctggaagctttcatgaatattctcttcctttaaaacattttaacattatttaaacagaaaaagatgggctctttctggttagttggtacatgatagcagagatatttttacttacattactttgggaatgagagattgttgtcttgaactctggcactgtacagcgaatgtgtctgtaattgtgttagtttgcattaagcatgtataacattcaa

SEQ ID NO: 10461 - DNA, 388 bp, Homo sapiens
  misc_feature 21, 49: n = A,T,C or G
cgttgctgtcgagctagagangtctagcttgctctgtatactcaacaanaaaaaaggctgtgcatttcttccagtgcaatgaaactcatatggtgtcccaccttatttaatgatggtacaatgtaaaatcttagtcaacttctgtagaaagttttctctatgaaagtaaagctgtttgaaaaaatattatttttttacagatctttctataaaaaataaacatcttttgattgcttggatttaggaattcaatttttgtttcaatgaccaatgtcaagttgcaagctttgtgtgttgcatatttaatatttctactaccaccgtatgtcaactgggtaaagccttccagagctctctatatacctgagagacttaaacctttttttac

SEQ ID NO: 10462 - DNA, 404 bp, Homo sapiens
  misc_feature 34, 35, 36, 37, 38, 39, 67, 68: n = A,T,C or G
cgttgctgtcggaagaattcgcggccgtaggagnnnnnntttttttttttttttttttttttttttnnggggaaaaaccaaatttttttttttaaaaatttttttccttttgaaaaccccccccctttttaaaaaaccggaaaccccaaaggggggtttttcccccctgggggttttacccccccccccgttttaaaaggaaaaaaaaacccggggcgggggggggccccccccccttaagcccccccggggggggaaaaaaagggggggaaggcccggccccccaaaaaaaacccggggtggggggaaacccccccccccacccccccaaaagggggccccccgggggtttggggaaaaaacccgcccccttttcccccaggggaaccccttttgggggcttc

SEQ ID NO: 10463 - DNA, 404 bp, Homo sapiens
  misc_feature 404: n = A,T,C or G
ggcacgaggagaactagtctcgagagcagtttgtttggtttttagcatttatgaggtgagcccatgaagttagtggtccattactttttaaagatgcattttcattttaaactgtctcctggcctgtggatttgtggaatggacagttttgtgggttttaatttatttgtgaggagtcggggctgagaaggcattttatcaggaggtctccttttgcacgtccatgacatgagcttttcggaggcaaaggaagtagaggagggtgagagatgcaggtcactgccagaggcacctctgtgacacggaacattccagacacgtcgcagccttgggcttcggcgaggaggaagtctgagcctgtgaagcgagaaggccaggcagtagactggctctgaggttttgcn

SEQ ID NO: 10464 - DNA, 403 bp, Homo sapiens
ggcacgagaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaagtacaacctatttgtaccttttgagacaatatttgtgttacttttg

SEQ ID NO: 10465 - DNA, 401 bp, Homo sapiens
gattcgaattcggcacgagagcgggggcgcaggctcgggcgcttctgtaggtactgcgggaggtgcgggacgccttaatgtcaggatgccctgctcacatatcaataccattaaaacctgacttctttccctgcactgttgaagctccttcttgaggctcacattatggatataattttgattctttcttcagcggtatagataactacttgtaacctaagaacaacttggtgaaagtcctctaatacattattttttaaaaaaacacaaatcaatgagctcaacttattaactaactttcatctattcatttttgagccatccctgtctgattgtgaatctccatgaatccaacactctgagcttgggatagtgcctacacaaaataaaaagaggtggag

SEQ ID NO: 10466 - DNA, 396 bp, Homo sapiens
  misc_feature 396: n = A,T,C or G
tgcacgagagtgtgcggagctgggcctggcgctggggacggagtctctgctgctgctgacggacacggcggacgtacactcgaccgtggagggtgtcatggacgccgcctggtccgaccgcggcccgggtggcctcaggctcctcatccaggagtctgtgtgggatgaagccatgagacggctgctaggagcggatggggcggcttacgagtggcctacggctgtattgcgccgaggacatgtgggcccggagaggctgtctgtcatgtgtacctgagtccacgcgctatgagcgtgaggctcatagccagggtgcacaggtgttccacgctggtgatgtgccttctgaacgcccattctatcccccaaccttggtctccaacctgctcccagccn

SEQ ID NO: 10467 - DNA, 388 bp, Homo sapiens
tttttggaaaggatggtgtattaaaccagccaaacagagtctttggacttatattttatatactacagctattacttggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagcttacttgaacgatgcctggaagcggcagctgcaacccaagcaagactgacgcccgacagactccaccctaacagtctcaagcccctttccattcagtttattttgcagcgaggttttattattaatattatc

SEQ ID NO: 10468 - DNA, 401 bp, Homo sapiens
ggcacgagactccaaccaccgtctcctgggttcaagtgattctcctgtctcagcctcccaggtggctgggattacaggcacccgcaatcatgcccggctaatttttgtattttagtagagatggggtttcaccatgttggccaggctgatcttgaactcctgacctcaggtgatccgccagcctcggcctcccaaagtgctgggattacaggcatgagccaccgcgactggcctctgtgtcttccttctccaatgagtcagtgccccagacatatagccacaggtgagaagacagaattagaagccccttcccggcctggaatcacctgcactccagatttttctaatttccttctttccctccaggcctttcaactatagatctggatgagtcatgcagg

SEQ ID NO: 10469 - DNA, 395 bp, Homo sapiens
ggcacgaggatttttttgcatttctttacactgagtgtaaaactctacaaagagttatagtatttactactttgaggtttccctcacaacttctggctccatacctagcccctcttttataatcttccttaaaagaaagagtgtagcctataaatactaaatatgataccttttccttctagaaagtgtttatttatatatctatacatgttgtatgtacaaatatcctactacttttaatctgatttttcttcaggattattgagtaggttgtgaattttctttcttaaaaattgtaaaacataatggtacccaagttttaaacttagatgtgcttcatcttagtgaaatttaattcacaaggaatcataaattgtgtttttgaggctgggcgc

SEQ ID NO: 10470 - DNA, 397 bp, Homo sapiens
attcgaattcggcacgaggaggacgagagctcattggagtcttaaactctctgatatcacttaaagctggagggtattttaaaacaaatgaagcatgggccacctcatgatgcatcggctcctctctggttgaggcgagggaaaattggaaaaactgggcgagtaattatcaataattttttttaaaaagaggatcccaaactgtaaaagattgaaataatctttctcaggattttttaaatgtctaagattatgatgacatatctcccacttaccttataagtaaaaaggttaatatcaagtaacttattagctcttaaagtaaaattgaacttattaaaagctatctatgatttaatagatttaataaaattccttcacgacctgggacccttgt

SEQ ID NO: 10471 - DNA, 396 bp, Homo sapiens
  misc_feature 56, 57, 58, 59: n = A,T,C or G
ggcacgaggagagagagagagagagagttttagttttagagagagagagagagagnnnnatgagagagagagagagagagagagagagagagagagagagagagagagagagagagagagagagagagagagagagagagagagagagagagagagagagagagagagagagagagagagagagctctctctgagagaaacactccctctctctgtgtgtgtgtgtgtatacattccctacacatatctcttttttttttctaggtgtgcgtgtgcgccctctctctctgtgttttatctctctcccccctctgtgggggggggagacacccccccccctctcacacacacgcgccttttttgtgtcacacacacatatctctccccccccccctc

SEQ ID NO: 10472 - DNA, 400 bp, Homo sapiens
ggcacgagctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcaggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgt

SEQ ID NO: 10473 - DNA, 399 bp, Homo sapiens
ggcacgagagaaaatcaagtttgaccagtgcagtttctaagcatgtagccagttaaggaaagaaagaaagagaaaaaaaaaaggcctggatactgcttttgctgtctctgttatgagatggaaaacttacatgtttgtgataaaaggggaccatgagaatgaattggcttggcttactttccccctgaaatcctctctcctgcagactgtcttgaaaacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatgg

SEQ ID NO: 10474 - DNA, 390 bp, Homo sapiens
  misc_feature 170: n = A,T,C or G
tcggcacgaggctgtatctctaggtctctataaaccttaataaatatatagttcatagaaaaccttattggaatgtcccttatattcaattaaaagataaattaaaacctcagtcaagatagcagcttctaaggcatcaaaaacacttattaagttctatactctttggntattttcataatcccaattctaaaaaaaataaatggattcagcacattaaaatccgacattttggatgggaattgccggtacagtactattaaggtgatgaaaaatggctagccttacatataaactctgcctattaacctaattttggattattataccatttaagaaacctaacctttagaaaaggattaatggctcctatataccttaccttccaaa

SEQ ID NO: 10475 - DNA, 403 bp, Homo sapiens
cccatcgattcgaattcggcacgaggttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttggtttggtcttacaagttttactggcctcatttgtcagctaatggatcaaaagtgattgggactgcctcgagcttttttcaagtatggtcttagatgtgagtcagagaatattatctatt

SEQ ID NO: 10476 - DNA, 392 bp, Homo sapiens
tcgattcgaattcggcacgaggctcatcctgcatcgctcggtgtctgggctgaagcagacactgctggcggagtccgaggctctgaccagctacagccaccgggtgttctcggcctgggacttcggtctctgcgggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttgg

SEQ ID NO: 10477 - DNA, 392 bp, Homo sapiens
  misc_feature 326: n = A,T,C or G
cgaattcggcacgaggctcatcctgcatcgctcggtgtctgggctgaagcagacactgctggcggagtccgaggctctgaccagctacagccaccgggtgttctcggcctgggacttcggtctctgcgggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggngtgcaccgtggagctgcaggagatgccccttgtccaggagttgccactgctgaagcttggggtgaa

SEQ ID NO: 10478 - DNA, 388 bp, Homo sapiens
  misc_feature 343: n = A,T,C or G
ccgagaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggttacactcagggggctgaaaggcaagttgatttttatttttaacacacttgaaaaaaggntggaagagcccgactttcatatataacttgggggatatcaacctg

SEQ ID NO: 10479 - DNA, 393 bp, Homo sapiens
  misc_feature 338, 393: n = A,T,C or G
ttcggcacgagcagaagttgtcctattaactttttttttggtctgaggttatgtacttcttgggagaaaaagtggttcttccatcaatatcaaaccttcccttcatttctctagttgaactggtgcacgagtcctcctcactccaagcatgttggccctcccttcctcgagtagaaatacggctttccacctttttatcagaactcctattcatgcttctcaaacagggcctaggatagcagaggctcagcagccagagggaaacagggaggaagctgtttctccatccccagagatgtaagctgggcgagagtgtcagggcctggccataccactgnacctcagaaaatgagcctgggggacagtactaagggtgtgggggggcaggtgtgn

SEQ ID NO: 10480 - DNA, 402 bp, Homo sapiens
cgttgctgtcgcaaaaattatacaaaaagtaaatttgaggttttataatatagaagcaaacaaacgtatgcacttaaattggagagcaacaaagaacagcagaacataagaaattttccttgtggtaactttccatcatgaagaaaagttcaattatgatcagtatacactgcttaagaaggcacaaatgtggaaagactttcttgtttttgtaattcaagaggtactttccaaaaatcttagaacacatgattttttaaataattatgatcagtatacactgtttaacaagataaaaatgtagaaagactttaattttttaattcaagaggtagtttccaaaaaatcttggaacacttgattatttttaacaattaattcctaagaattagaggtcttact

SEQ ID NO: 10481 - DNA, 402 bp, Homo sapiens
cgttgctgtcggtgggagagaagtattcacattctcaggctccaggcctgtgcaaccagaggagtggaattgtcattgaagggaggcgggaggaggggtgatggtgttagaagagataatatgcatgtggccacccccacaaacctttaggaatgcagtgcataattaggactaaaggcactgatttggatgtggtgggtgataggtggtctgtgggagtaaatgagatgaatgagacactagaagtaggttggaaatagaatcctggggacaagaatcagtggagaaagaggtgactgtgaaggaatcaggatgcaagaagagtcagtaaagtttagccttcaagaagtcaacagaagggggagaatttgaattctgttttcaacctgttttggttggagg

SEQ ID NO: 10482 - DNA, 387 bp, Homo sapiens
aattcggcacgagattgactgcagaattaaatccaaatgtccaaataaggcatattatgatttagcatcattccacctttagcactgtctttcactacctttatgcatgtcttgttttatctaaagcagaaatgccttttctaatgcccttctgtcctccagaataccctttctttactcatgtttttttctctaaattttacccatctccttaagtgtccattcagaatctattctttaccacaaacccctcaccaagaacacattataccttcttatgtcttacagcactttacacatttttgtcttgcatcatagttctttgcatatcattttttacaaaattatgaattcctcaatattaacaattgtcttgttcacttattg

SEQ ID NO: 10483 - DNA, 388 bp, Homo sapiens
  misc_feature 388: n = A,T,C or G
ggcacgagctgaaagtatgtctggcaaaacctagaactgcatcctagccatcactgtaccttctgccctccctgctgtctcctctgccagttacagttaaaaggttgtgggtgaggacgctgggcagagtcccaggcgtctgctgtcagctccccagcccggcctgcctgccgagccatctgggcgtcccacggtggagagtgtggtgcttgtgacgcggtggtgctgggagccatcctggtggcagatgtgggctctcactgcaagtcagtgtaagtccccagggactgtcagcagcacgtcctgctgcccctctctctgcagaagccctggtaacctgcgtttggaaaaatctctaaggatttctgaggagctgtcaggccatgtn

SEQ ID NO: 10484 - DNA, 399 bp, Homo sapiens
cgattcgaattcggcacgaggcggggcacagtggctcagtcctgtaatcccagcaccttgggaaggccaaggtgggaagatcacttgaggctaggagtttgagacaagcctggccaacatagcaagaccccatctctacaaaaataaaaattttaaaaagggctggggcatttgagctgggtcccaacagtagacaagtagaaaaggcatggagagggcataccaggtgggaggagctgtgtgcaaaggcctggagatggaaaagcatgctggccaccagcttctgacaagcagtttagtatgaacggtatgcatggaaagagggaaggagggcagaggggtgcgcacgagcacccgttagtgtccttaaatgaccagcatgggaacctggtctctttc

SEQ ID NO: 10485 - DNA, 402 bp, Homo sapiens
ggcacgaggaactagtctcgagagcagtttttccacctcggcctcccaaggtgctgggattacaggcatgagccaccacgtccgtgcccaaatatgtatttaatttaaatttcattttaatgtgtttaagggatgaaagtaaatacatgcttgttacaagccattcaaatgtagaagtaggaaggtggctgcccggcctcccctctcctgggaggatctgtggtgagcaagtcggatgtgcatccttctggtcttttttctattaacgactctttgctggatttgctgttactaggctttcgcagcaaacgtgggattgttgtggaaaatgctttgctgggagaaggggagccggagattcacaaaaggaggctcccgtgttcatttgcgtatttggcagct

SEQ ID NO: 10486 - DNA, 395 bp, Homo sapiens
ggcacgaggttacacctctcgcatactggtgtccacagagcagccatcttagctggaggtgtcgagtgcctcccccaccccccaccatgtgcttgagtgcacacccggcgccaggccctgatcctggcacttcttgtgaatcacaccgtgtcatacccatgacttccattgcacagtggggaaactgagtctagagaggtgaaataacatgtctaaagtcacaggaagtgaaaaagctgaggacatggagccagttgcccaatgacaggagagctgaaatgtcctcactgctgggggtagaccgggcctcaccagcttcctggagagtcacatgtttgtctgcatcctcagggggctcgccggttctccagcccggactgctgccagaggcttct

SEQ ID NO: 10487 - DNA, 399 bp, Homo sapiens
  misc_feature 352: n = A,T,C or G
cgaggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgagaattcagccaatcagattgcaggcaaaatacccaacttttgtgtcctgctccatggtagcctanaagtggaaggaatggtagcgattgttcaattaggtcctgaatggcag

SEQ ID NO: 10488 - DNA, 389 bp, Homo sapiens
ttcgaattcggcacgagagcaactagggccctcatcacttcgccgccgaatccccggcgccgcccagcggggcagagccaggccagggccgcccgcccaacctggtccgctgcctcttcggccatggaagctgccggcagccctgcggctacggagacagcttctccactcttcctcctcctccacctccgcccatgaaatggtgcactctccctttaagactaagatggtggcttgctacgatcgggactccacttccggtggggaggggggcgggaccccagcccgctcacgccggaagtggtttgcgttttcaagatggcgactccctatgttactgacgagaccggcggggtgggaaccgccaaacctctcccttctttttgacc

SEQ ID NO: 10489 - DNA, 402 bp, Homo sapiens
ggcacgaggagagagagagagagagagagagagagagagagagagagagagagagagagagagagagagagagagagagagagagagagagagagagagagagagagagagagagagagagagagagagagagagagagagccccgcgcgagaaacccccccgtgtgtgcacacacacacactctctctcgtgtgtgaggggggggtgtgtgttttctctccactctctctgtgcgctctctctttttgcgcgctcatatatctctctctctcttttttttgtgtgtgtgtgcgctcgccccacacacacacagtggggggggggtgtgctctctcttctatatacacacactctcctctctctcttgtgcgcccccacagagagatgtgtgtcttctctct

SEQ ID NO: 10490 - DNA, 401 bp, Homo sapiens
gaattcggcacgaggcggcttggagtggttcagcagttggtggagaagggcgccaaccctgagcacctcagcgtgctggagaagaccgccttcgaggttgcactggactgcaagcacagggaccttgtagactacctggacccgctgaccaccgtcaggcccaaaacaggtcaggctgcatgccccccgtggcttcacagaggaccccaaattgtgtttatgtggcttaagctgaggattgctctactggaaggacacgcagaactcagagtccagccctgcagaccactgagactgaggaagtggtgtgcttaagtatcggggggattgcctgagacatgacagttctgggcccactcttttgagagcgatttggttgccctgggcaagagcctggaaac

SEQ ID NO: 10491 - DNA, 401 bp, Homo sapiens
  misc_feature 22, 23, 24, 25: n = A,T,C or G
cccatcgattcgaattccgttnnnntcgatttccccatgtcatcaagtagtgactgaaagcatacttttcgaatgattgcccaataatccgttgagctgctgtgtcaaaatttgctcaacagatcctcattgctggatattcaggctgtctctaatctggagtggctgtaaaccatgaacatcctggagtgtaaatctctgtgctgatctctgatcctttccttagatataggcatataggtacaacgaataggtcaaagggaatgcacctttttaacaaggggattttaatgacaaatttaagtgttcctaaatacctatcagtgcagcatctgattactgggatttattgaaaattatttttttaaagatcagagaggccaagtgtggtggttcatgcc

SEQ ID NO: 10492 - DNA, 393 bp, Homo sapiens
  misc_feature 58: n = A,T,C or G
ggcacgaggagtcactgaccttcatccttcaccctggtcctccatggtgcagcagcanttcatgggccttgtggctgtcagagcccgtggttggaaccccgtccactggtcccaaacctggaggggcagctgcagatgaggtttagacctcctggtgtctccgtggattctgagtgcccaggaggggaggggagggggtggcatcctggcctctaggataaatgcctggagtatagggcagcgccacgggcacttggagaccctgtcctgcgcatctgccaagcctggcagtttttagagttttttgaaatgttttgatactttttgatacaatttgctaataactgttttgtagaatgcctgccggggttttccacctcatccctttcctcc

SEQ ID NO: 10493 - DNA, 397 bp, Homo sapiens
  misc_feature 380: n = A,T,C or G
gcacgaggctgcccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggngaccgcccagccttgct

SEQ ID NO: 10494 - DNA, 397 bp, Homo sapiens
  misc_feature 397: n = A,T,C or G
cccatcgattcgaattcggcacgaggcttagggaacaggagtgaacagacttcagccccacctggcaggggctggctcccgaggttgggcccagtccctgagggtctgctctgctacgggtctgcccttgagtggccttccgtggagggtgtgtgaccaggtggatggtgcagggcctctggagccctctcctcaggagcagtcctcagcctttttctgtaaaagacttttctttggtgttctaggtggtcagcaggttccaggctggtgtttacaatctcggaggaagtgcgatggtttctgttcttttgacagttcagtctgatttcaagtcagtcgaaagcgaaccagaagcaccgggcacagcagctcctctggctgtgtagacagacctggn

SEQ ID NO: 10495 - DNA, 394 bp, Homo sapiens
  misc_feature 367: n = A,T,C or G
ggcacgagggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagtctcaaccagctgaaatagcagaaaaggaaacattggaatataaaacaagtagaacaatctctggatcttttgaagcngaggaaaccggaggattaccttagaga

SEQ ID NO: 10496 - DNA, 386 bp, Homo sapiens
ggcacgaggggaagtgccaggaagaggagggtggccatgcctggccatttcctgatacctgtgctagtgacggccgcggtgtgtccactggaaagaaacactggcgtgcacggctgtgactgtggtttcagcagttctgagacaagagccttccaagtcgggggctggggagcagagtgcgggagctcctgagtcctgggggcctccgcgcctcacagcatgggcacatgtgggacagaaggcctaatggggtgcctgagggtggcctggttgctgtccccccagggtgggaccatgagcgagtaggggtggcacacgggctcagctctctgtggccggggtggctcctcttgcgggactcaacgtcagccccaaggcgatgttca

SEQ ID NO: 10497 - DNA, 386 bp, Homo sapiens
  misc_feature 50, 51, 52: n = A,T,C or G
ggcacgagggctcctggaaatgaagatgagctccacctggcacccgagcnnnttggctgtcccccctcactgagggggccccccgcacccgggaggagacgcgggacttggtccacgctccgttacccttgacctggaaacgctcgagcctgtgtggtgaggagcaggggtcccccgaggaactgaggcagcgggaggcggctgagcccctggtggggcgggtgcttcctgtgggtgaggcaggcctgccctggaactttgggcctttgtccaagccccggcgggaactgcgacgagccagcccggggatgattgatgtccggaaaaaccccctgtaagccctcggggcagaccctgccttggagggagactccgagcctgctgaa

SEQ ID NO: 10498 - DNA, 386 bp, Homo sapiens
ggcacgaggagagagagagagagagagagagagagagagagagagagagagagagagagagagagagagagagagagagagagagagagagagagagagagagagagagtctttttttttttctctacctataaaaacccccccccgtgcgtgtgtgtggggggggacacccagaaaacacactatattctctctctctctgggcgcgcgagagagagcacacacgggggggaggggagaaagcacgctctcccccccccccgtgtttttttttttttttttggcccccccccaacaaaaaaaccacctttggtttccccccccctccgggagaacaagccctttccccctttcccattaaaacagcccttcccccccccccccct

SEQ ID NO: 10499 - DNA, 399 bp, Homo sapiens
  misc_feature 397: n = A,T,C or G
gattcgaattcggcacgagctcacaccacagctgagagggaaaggaaggttggaatggcggatcgccaagcgcgcccccacctctcctgtggtactggggtccctaaagccgacccccgctccggcggggctcgccggcccccaagtcgccagccgcttacctcacaatcccgcttggactgcatggctctccagctggccccctcgtaccctctttataacttcctccccaccggcctctggaagcttccctacccctccaccccgcaagctctcattggctctgagcgcgaccccgcctcccaggggggtggaggtatccactgcacgtgcgccgcccgggcttcgctcagaccttcaggtgaaagctgcaaagtcgcgggtgcgtatgtacggngg

SEQ ID NO: 10500 - DNA, 394 bp, Homo sapiens
ggcacgaggcagcctgtcgtacggtccttctgtgggtctgtcggtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtca

SEQ ID NO: 10501 - DNA, 390 bp, Homo sapiens
  misc_feature 390: n = A,T,C or G
ggcacgaggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttataattaatccagactggaaaacn

SEQ ID NO: 10502 - DNA, 391 bp, Homo sapiens
  misc_feature 51, 52: n = A,T,C or G
ggcacgagaaaacgatatggaaatgtaatttaaatgggttccaggtcttannaaaagcgcagaagagatggtcaaaaacaaattggaatggaaaggataaactgaccccttgggaacaatttttagagaagaagaaagagaaaaaaagactgaaaaggaaacagaaggctcttgctgaagaggccaatgaagaggaacttccctctgatgttgatttgaatgacccatactttgctgaagaagttaaacaaataggtgtaaataaaaaatcggtgaaatctgcaaaagatggcacatctccagaagaagatattgaaatagatagacaaaaggctgaaatggctttgcttatgatggatgaggacgaggacagtaagaaacacttcaatta

SEQ ID NO: 10503 - DNA, 396 bp, Homo sapiens
ggcacgagcagtactagagtcttcggcttcgctcacgcgccttgggcataagagtcctctcgttggtcccggaggtggggttgcgctcacaaggggcgaccgtcgccacggtggcggccactgcatcgcgtcccacctccgcggccctgggcgccgtggtgtcgacgggccccgagcctatgacgggccagggccagtcggcgtccgggtcgtcggcgtggagcacggtattccgccacgtccggtatgagaacctgatagcgggcgtgagcggcggcgtcttatccaaccttgcgctgcatccgctcgacctcgtgaagatccgcttcgccgtgagtgatggattggaactgagaccgaaatataatggaattttacattgcttgactaccattg

SEQ ID NO: 10504 - DNA, 385 bp, Homo sapiens
ggcacgagggaacaacctgggcaggatcccacctcagacgacgtcatggactcgttcctggaaaagttccagagccagccttaccgtggcggctttcatgaggaccagtgggagaaggccaagacctataaagatgagggcaatgattactttaaagaaaaagactacaagaaagctgtaatttcatacacttgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacacttt

SEQ ID NO: 10505 - DNA, 398 bp, Homo sapiens
ctcatccccccagagtcactgcagcagccatcctagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgag

SEQ ID NO: 10506 - DNA, 389 bp, Homo sapiens
ggcacgagcccgcgctcgccgcacgcacgcgcactgcgcccagcatgagggtcgcggctctgatcagtggtgggaaggacagctgctataatatgatgcagtgcattgctgctgggcatcagatcgttgctttagcaaatctaagaccagctgaaaaccaagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggaaaaagaagaagtagaggggatatcagtaggt

SEQ ID NO: 10507 - DNA, 397 bp, Homo sapiens
ggcacgagatcaaggaccatgattttattctcttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacacaattcttgaagaagatttaaatagcctttttgatagggggaagatatgtgccatctttattgtgccatttttttctttatgtctttaaggtggttttatattattctttgtagaatcccactatggtatttttataatatattgtattttttatgggaaatttttctcatctcttctaaaatgttattctttttattattat

SEQ ID NO: 10508 - DNA, 381 bp, Homo sapiens
ggcacgaggacatgaagaagacgttcacggagcaacggctcagaaatggaagctcaattctaactcaggattctcatgatgataacagcttggtgaccaaggaagagaaatgggtcactagtatgaatgagattgactggctccacgttaaaaatttatgccagctagaatctgaagagaagcaagttaaaatatcagcaactgttaacacaatggtgtttgatattcgaattaaagccataaaggaattaaaattaatgaaggaactagctgacaacagctgtttgagacctattgatagaaatgggaagcttctttgtccagtgccggacagctatactttgaaggaagcagaattgaagatgggaagttcattgggag

SEQ ID NO: 10509 - DNA, 374 bp, Homo sapiens
ccatcgattcgaattcggcacgaggtgatgatcgcatgtgtttacaatacacagagacgcccagtgctggcaagactataataaagcgagcgtactcacaccactgcggctggcaccaaaaaccgggattgcagtggaaatgtttttggaaagcagtttggcaactgtcaacaaagcgactacagaacagttgtcaatgagacacagaaatacgaaggagaggagggagggcagaaacccagttaacaatgtaagcgggcacggagggaagatcagcgtgcaaagctaggtcggcaagacgtgcaaagtgcacccacagccataacaatccctccccagaccccaacgtgtcctcacggtggtggcagtggccc

SEQ ID NO: 10510 - DNA, 378 bp, Homo sapiens
ggcacgaggcgtgtggagctgaagatggatctgcctggggtttccattgcagacgagggggagactggcatggtcttcttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcag

SEQ ID NO: 10511 - DNA, 378 bp, Homo sapiens
aattcggcacgagcagcagccatggccacctgcatgccagtccttcgtgtattgctgcgtatgagcgcccttccttggatgtggatttccatgacatggcctttctcaccttccttacttcctgtcctgctatgtattgtgtcctaccatgaattcactccatgctagccacattggcctgtatggctattccttggacacacctaggatgttcttgcctcttagcttgcctacctttctctcatcatttgggcctcagcgaggatatcatctcctcagagaagccttctgtgaccatgctatctaaaatactccagcacttcagtcaccctttataccattactctgcttttttagaaacattggtgctccctgaaa

SEQ ID NO: 10512 - DNA, 374 bp, Homo sapiens
  misc_feature 341: n = A,T,C or G
cgttgctgtcgaagagttcactggtggttattttttgttttgtgtgtgtgtgtgtgtgtgtgcgtgtgtgtctgtgtgtggggtcttcctgtttgtcaataggccttcccaattaattgaattctacataagatacatagatgttagtgccccatagggcctcatcttgtaagtgatgttagtggagtaaatggtgatataccattttcagtaagaagcctgagtcagtgtagaaagtaaaagttggtcatctgggcttgaggcaaatattctgccttcactacatatgaagtcctgtgaggatgggccagagaatcatacaagaaacattgttttcattntttccaccatctctcccaccagtctttcttgtt

SEQ ID NO: 10513 - DNA, 368 bp, Homo sapiens
tggattcgaattcgcacgagattccctttatattgtaaaggccataaggacactttaagtaatcaaatttggcatcaccattggaacaaacatgtgcctcttcttttgatgtgatagaaaggaccatcacctttatagtatttgtgccaaaaacatttaatttgaacataataagaaaacatttagacaaattcagatgtgcggaacaatgtgcaaaacagctgtcctgaatgcttcaaatataacaatattatgaaatgttttatataataggccagagacatgccaactaaatacaatgagcgacccactagtaacaacttaataaatattcaggcccttgtttagacagatgggagacatctgag

SEQ ID NO: 10514 - DNA, 374 bp, Homo sapiens
  misc_feature 374: n = A,T,C or G
ggcacgaggtgaagagtggcagaacttaaaaatgggtccacaaagccaaatgagagcccccttccccaattcatacagtctgctttcctcttgtgagtcagggaaatagatctggctaaggaaggatgaagtcttaagctggggttggaaagggggacttgggaggagagtagtgagttgagctttggacaggttgccttgggactcggtgctttacagctattggggcctataatggatgttgaatgaggaagtgatagtccaaagggggtattttctgtgtaccatcctactgagatttgaatgcacaagaaacaagatttggcttctaagatccatgtgcttgagatagataacggatttttgaggctctn

SEQ ID NO: 10515 - DNA, 378 bp, Homo sapiens
cgttgctgtcggtggcgggcacctgtagtcccaactactcaagaggttgagacaggagaactgcttgagcccggaaggcagaggttgcagtgagccgaaatcacgccattacactccagcctgggtgacgagcgaaactccgtctcccaaaaccaaaaaaaagaagagaaaaactctgagggatcccttgtcctggaagtggctgaacttgggggtggtacaggggagacaactgatgggcctaacggggtccgtgcacaagggccggttgtcactgagctgggctgttggaaattttttgctgctcgctggccacggtctgtgaatgggaaacacactgaggccgcgtatttttgggcttaggcttcctgggggaga

SEQ ID NO: 10516 - DNA, 382 bp, Homo sapiens
ggcacgaggtcccttgctttcccttgaagcgggagaagacccggcagaggcgctctgtccgctgcagccgcgcgggtggaggaggcagagtctgaggtgtgaccccgaccaagtttgacgcttctgtcctcctagggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtaacctgggaggacgccgagctcgaggcgggcccctcggtgggctcgggcgtgcggtctccgggacagggagca

SEQ ID NO: 10517 - DNA, 381 bp, Homo sapiens
ttcgaattcggcacgagatgtcctcagggctgcctgtggccaccctgatgggagacctctgtttgcttctgggccactgcaggttggcctcctcaatacaagctgatgtctgcagggagcgccgcgtgctgggattgcaccacgtgttggtcacaaatcgaggtcgccttttggcctggtctgctcaggctggccctgacccacgtggtttcctggcttctgagacgcagcgcattcttcctgttagcggtagcgttctctgtctcaaaaataataatcaaatcaagtattttaagtttggctctttttttcaagaaaggcttttcggatacctaaaataccttcatgtatgtggcttgaattttgtttcagaaaaggggg

SEQ ID NO: 10518 - DNA, 378 bp, Homo sapiens
cgttgctgtcggccagagcttaaggctgtacataataatctgtttcttccaggagccacttcccccaagaaactccaaaggtattatttcattagcagggtgccaggtggttttggccagggcctctgcaactcttttctctgtgaccattttccatttcggctcatataaatcaacctttactacaaagctataaagtaaaataatgtaattagtgcagccaactgcagctgttctcaaactcaatgtcacagccattacacatgtgaaatatttacaggggttttaatcaattttctttcctgacacccgtttttcattaaaaattacaaaaataataaatgcacatggtagtagatacagaagaacacaaggaat

SEQ ID NO: 10519 - DNA, 383 bp, Homo sapiens
  misc_feature 383: n = A,T,C or G
ggcacgagattgaacaccagtatacaataactttagggtcatatggatcattggtttcacgattacagtaggtctggtgcatggcactcccagatctagtagaggctctgatgtcagtagcaggatggaggagagctgggcttacagcctctcaacttgttggcccttataccatcactgcactcatgtccttgctctgtgcagaagtagaatcagaaaagcatcaggcaccttcatggtataaattgtgtctatgggtgcagtgaataagcaaaaatcagaagcagaccggagggacttataaaaataggtacagggtcacaatgggtgcctatatgtagcctgtgacagataagaagctgacagtgagacaaacaaaaaan

SEQ ID NO: 10520 - DNA, 382 bp, Homo sapiens
ggcacgagcagaagttgtcctattaactttttttttggtctgaggttatgtacttcttgggagaaaaagtggttcttccatcaatatcaaaccttcccttcatttctctagttgaactggggcacgagtcctcctcactccaagcatgttggccctcccttcctcgagtagaaatacggctttccacctttttatcagaactcctattcatgcttctcaaacagggcctaggatagcagaggctcagcagccagagggaaacagggaggaagctgtttctccatccccagagatgtaagctgggcgagagtgtcagggcctggccataccactgacctcaggaaaatgagcctgggggacagtactaagggtgtggggggtc

SEQ ID NO: 10521 - DNA, 382 bp, Homo sapiens
ggcacgaggcggggcacagtggctcagtcctgtaatcccagcaccttgggaaggccaaggtgggaagatcacttgaggctaggagtttgagacaagcctggccaacatagcaagaccccatctctacaaaaataaaaattttaaaaagggctggggcatttgagctgggtcccaacagtagacaagtagaaaaggcatggagagggcataccaggtgggaggagctgtgtgcaaaggcctggagatggaaaagcatgctggccaccagcttctgacaagcagtttagtatgaacggtatgcagggaaaagagggaaggagggcagaggggtgcgcacgaagcacccgtagtgtcttaaatgacagcatgggaacctgtctct

SEQ ID NO: 10522 - DNA, 378 bp, Homo sapiens
ggcacgagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaagaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgctttcggaaaagtgtttggaaa

SEQ ID NO: 10523 - DNA, 383 bp, Homo sapiens
  misc_feature 22: n = A,T,C or G
ggcacgaggtggacccccttgngatcagccgaggtctgtagaggtgacattgcagcccagcacctccctcctccgccctgccctcctctgtcctccttccacaggtgtggccaagggcactgcccagttggcctgtgacccccagctgaggctgcttcctgggcagctgacttcaagtttgtgacctgagctctccaggcccccgagcggctggtgccttggccctgcagttctgcggccaagactcctcctctgggatctcgtcttaccctgctgcgggtgccagggctgcatgaagcaagggcgaaagtccccttcgcccgggcgctgccctctgcctgctgtcccctgtgctcctgttccccgtggctgcccagggacag

SEQ ID NO: 10524 - DNA, 383 bp, Homo sapiens
ccatcgattcgaattcggcacgagccagactccttcctccaacccagagccttctcccatagtatctctttagcctcttctgccttctagactgtccctgcctccagggacaccatactcacctggccttttccaggagggcctcctagaccgaacgcaagtaagcacagcttctcctgagcccaccctctactctacttgctccccaccattatttgtaaggaaactcttctctttactccccaacattctccatcccccttccttggctgcctcctcccttcttcttcccagcctatcctttatgccccgcacgggctttcccaccagaactcttggctcagaaatcagttgggacaaagcccctgtctcttccagtctgg

SEQ ID NO: 10525 - DNA, 372 bp, Homo sapiens
  misc_feature 372: n = A,T,C or G
ggcacgagagaagagaaggcccgggggggccggggagggggtacccaggctctgcacagtacccaaggggcttctggcagcaggaaggaagctacacatcagagttggggacttgtgccctggggctgcctggcatctgggggcctcctcagagccagggctctttctggttgaggctgagactcactggtgtcatcaggcccctccatgaatgagacaaacaaaacacttgttgggccttcggagctccccacagcgtctgctgtggcccctggcccaggcactggggctcgggcatggcctgtgctggtaggatttgtgctgggggctgtggtcctctcgctcctcattgcacttgctgccaaatgccan

SEQ ID NO: 10526 - DNA, 377 bp, Homo sapiens
  misc_feature 221, 249: n = A,T,C or G
cgattcgaattcggcaccagagactttacagagatagtggggtgttttaaggcagggggaggaactgcacagcccagacctgggagggagggatccagggaaggagagatcctgggaattgcaatagcagcaggcagaggctgttggttcctattgtttcctggctgctatgaatgacttggctttaatgactcccaaggttctggatctctccagttcanatttcaaattattgacaaaacaatctgnattgccagcttagtcctaggcatatgccctcgagccaacctggccaatcaaatattgacaaaacaatctgatgggcagggtggcctcagggcatatgctaggacaaactttggccagatgaggcacat

SEQ ID NO: 10527 - DNA, 377 bp, Homo sapiens
cgttgctgtcggaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttcccaaccgtgaaaattgcacccattgcagg

SEQ ID NO: 10528 - DNA, 370 bp, Homo sapiens
ggcacgagccctccagccactgctttatactctccttctctggttgaaatttttgaagtaaataggtcactctgcccatcgttcatcttccagtcactctgtgtgtttatcttccagggaagtgaggctctatgctaccaagccactgaaataatttttttttttttcaagactccatctcaaaaaagggagatgatttacaaaattaagccagggggggccccacacctgaggcccagctattggaagcctaagcgggaagatggccctacctgggagggcaggctgcgggagccagaaggcccccctgcctccaaattggggacaaacaggaccttgctaaaaaaaaaggggtggttaattttcaaaa

SEQ ID NO: 10529 - DNA, 370 bp, Homo sapiens
tacggctgcgagaagacgacagaagggggaaatggggctgggggccgtccccgggagacaggcggccttccgagagggactggagcaggccgtgcggagtgggcattgcttgatgggcaggaagttgagtgttccttgcaagggtgctgtggcaagaggaggcctggtgtatttggcagcgttcctgaggctggacatgatccacctgatggctggtcgagtaccccagggagctgatcgaatagcagtcaaggctgagatggaaggccgttttctggagaacctgaggcatgcagctggggttttggctcaagaggacctcgtgggactgctgggagcccatcacacccgcatcactgacccccagtat

SEQ ID NO: 10530 - DNA, 368 bp, Homo sapiens
  misc_feature 353: n = A,T,C or G
ggcacgaggaagaagcggagccagggctgagatcccgaaggcgggcgaggtctgggatggggcggggcctatgggagcggggctgaagccctgggcccggcagaggaaggtcgagatggaccatgttgggccccttctctccccgcccccaggccgcagttcgggggccacgccccggcgtgctcgggtcaccgcgggaagcccttgaaccccctggcgcccggcacccacgtgcggtaaccgcggctcctcgagagctccagggatgcggatctacagtaagggctgtggccagatgaatgaatgcacattttttagtgggcagaaagatgttaaattcatgattagaatangcacaaaggaggcgg

SEQ ID NO: 10531 - DNA, 379 bp, Homo sapiens
ggcacgaggcagcggcgaggagtgaacacctggctgcaggtgacggcctgcaggaaggaggcgaagatggccccagggaaccaaagaggctttgccgacccccgggagaggaggaggtggactgggaacccctggccaaattccgagcagcctgcgggccagagctggcagacctggtggctgaggagttggcctttgctaggcagcatgggacccggggtttccactggaccggagctggctttgcccttaaggacggcacctcggacttcttcctggatggggccctgacacgctgcagctgctcaattcacgccgcccgccgtctgccctgcagacacctctttgcagcgcgcctcctcactggggctgccttatg

SEQ ID NO: 10532 - DNA, 380 bp, Homo sapiens
  misc_feature 356, 365: n = A,T,C or G
gattcgaattcggcacgaggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaagccacaggatcccagcccggcctttgntggactgangtggcgctgagtgga

SEQ ID NO: 10533 - DNA, 369 bp, Homo sapiens
ggcacgagggaagtgcaaagacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaataatgatgaccaag

SEQ ID NO: 10534 - DNA, 374 bp, Homo sapiens
ggcacgagcctacctgaggcgggagccctgggcttggtcacttcccaccttccagatgtattaaaataccggaggaggagttagcctttctggatgtcctcattatctaacaacccctccctttgatttttaaatcctcacaggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaattttgtatggtttattcag

SEQ ID NO: 10535 - DNA, 382 bp, Homo sapiens
ggcacgaggttgggcgagatgaagctacactgtgaggtggaggtgatcagccggcacttgcccgccttggggcttaagaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggccatttccagcagtttaaaaggtttcctttcagctatgagactggctcatagaggctgtaatgttgatacaccagtttcaa

SEQ ID NO: 10536 - DNA, 383 bp, Homo sapiens
cgattcgcgccggccgccctgcgtacgctcgcaaggcgctcgcagactccggagtcgccaacatgtcgaccgccatgaatttcgggaccaagagcttccagccgcggcccccggacaagggcagcttcccgctggatcacttaggtgaatgtaaaagctttaaagagaaattcatgaagtgtcttcataacaataattttgaaaatgctttgtgcagaaagggatcaaaaagatatttagaatgcaggatggagaagaaattgatgctaacagaccattgaagaaactggatttggagacttgactagtgaaaatcaagagcaaaaaatgaatttgatgaaagacccttggccgggtcagggtctctcagacggaggcacatc

SEQ ID NO: 10537 - DNA, 372 bp, Homo sapiens
  misc_feature 351, 367: n = A,T,C or G
ggcacgagtaggaggagatgactcagaccccagatcagagaacgaagcccccaggaggggctggagttagaagtccggtggccttgggacgggggtgaccctgacgagggtcagcaggggcgaaagcagcagagcagggacagaacttcagtcccatgaaaccttgacaggcgcgaacttccagaggtctggctggcccatgtgcagcaggccgctgaagggcgaggtgctccactggaacgggggcacctggtcccacgtgggaccgctggccgccagcaggctcaggatcctggccagtgacatgctggtcaccttcacatcgatacccccatgggagcgctgacgcangggcctggaggggtangagcc

SEQ ID NO: 10538 - DNA, 373 bp, Homo sapiens
  misc_feature 373: n = A,T,C or G
ggcacgagggaagatctgcagacacctgttccacgtgctggcacacatctactgggcccacttcaaggagacgctggccctggagctgcacggacacttgaacacgctctacgtccacttcatcctctttgctcgggagttcaacctgctggaccccaaagagaccgccatcatggacgacctcaccgaggtgctatgcagcggggccggcggggtccacagtgggggcagtggggatggggccggcagcgggggcccgggagcacagaaccacgtgaaggagagatgagccccccgggccggacaggggcacacgtgtgcaaagagacggtggggtgtgttctcttctgcatctgcgtgtgcacacatgtgn

SEQ ID NO: 10539 - DNA, 373 bp, Homo sapiens
  misc_feature 307, 373: n = A,T,C or G
cccatcgattcgaattcggcacgaggcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacnagtgtgagctggtgaaccggctgggctccgcgcgggctagtgcggagctgcgcattcagagccccn

SEQ ID NO: 10540 - DNA, 380 bp, Homo sapiens
ggcacgagggaacaacctgggcaggatcccacctcagacgacgtcatggactcgttcctggaggagttccagagccagccttaccgtggcggctttcatgaggaccagtgggagaaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaaca

SEQ ID NO: 10541 - DNA, 383 bp, Homo sapiens
ccatcgattcgaattcggcacgaggccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctctttcacatcccccgggttacctcccttaagcttgtaggcccttgggg

SEQ ID NO: 10542 - DNA, 384 bp, Homo sapiens
  misc_feature 261: n = A,T,C or G
ggcacgagatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtatgccataaccaacgacaagaccaagaggcctgtggcgcttcgcaccaagaccttggcggacctttntgaatcatttattggcggcgctgacaatgataaggaattggaataatgtcatactttcatgaatggctgcctcctttcacgatggaagaagtcaattggatcaggaatggaatggaccccaat

SEQ ID NO: 10543 - DNA, 358 bp, Homo sapiens
ggcacgagctatcatctatctatctatctatctatctatctatctatctatctatctatctatctaaatgacctgacagaagaaaactgttaaaaatggatattattggaggggatttaaaacagtgggtgtgaattatcattctgatggaaagaaaatagcaaaacaatgtgttacaagtatttgctaataaacagtatactgccagcttctaattgctttttgatgtatgaaaggcttatataattttcttttcgttgggtgacttttgccagatgagaggaggtggcacaatggtgaatgcaaggcacagtcctagccttctgtgggtatacttttggagttgtgacttggctgg

SEQ ID NO: 10544 - DNA, 354 bp, Homo sapiens
ggcacgaggagtgagagagagagagagagagagagagagagagagagagagagagagagagagagagagagagagagagagagagagagagagagagagagagagagagagagagagagagagagagttttctctctcgcgcgctcttctcttttgtgcaagagagggtggtgttttttttttttttggacacgcgcctttgtttttttttgtgtggctctctctcgcgctttagctcctctctctcgcggtgtcacgcatactctctctctctctcgcgcgtgtgtgagagtcttttttttttttgcgccgtgcattttttgtctttcacccccccctgtgggggcgtttctc

SEQ ID NO: 10545 - DNA, 359 bp, Homo sapiens
ggcacgaggcggacttgggcggccacaggtaactttctcgcaaggagctgaattctttcactaaagggtacaagcccgagggacgagctgcgcgatgattggctggggagctccctcaggtgagctgccattggcagaggcgcgctcaggtaaggcccttctccaagtgcaggtaactcactccgaagtttacctgagtggagcggcggcatgcttgcagctcggcggcagcctgtgagagctgagggtcagttcttcgagtagatctcaagctgcgttttcctccttctccaaagcagggatgggaaggtggaggctactggttgaagagaagaaaggggttgggggaatgcaacacc

SEQ ID NO: 10546 - DNA, 362 bp, Homo sapiens
  misc_feature 362: n = A,T,C or G
ccgggagtgcgggaggcagtgttagaggtaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttgcatatgctggttacattccccctagcaaagaggaaagtgactggccagcctcn

SEQ ID NO: 10547 - DNA, 354 bp, Homo sapiens
actacggctgcgacatgacgacagacggggctgggtacctacgatgtcctggctggatacggtgtaaagacttctctagggagacagatggattagggaatggtggatggaccacactggtctttatttccctactactctacgttatgtgtctcttaaattatctctgccagaactatgctgagaagcgagcatttatgttataagaattatagccaccaaatcaaccctgtgcacatggcacttccgtcacctcatgctgtgacctctcataggtctcggtcccccaggtttgaggagatgagtccccctggctgatgcatttctaacagggctggaggatttctgcaggaa

SEQ ID NO: 10548 - DNA, 360 bp, Homo sapiens
  misc_feature 360: n = A,T,C or G
ggcacgagaaaatacagagtcttattggagtacacatatttgggagaacatagtttgtaaaggaagtaggaaggtttgtgctgtgatctaataatgattttgaggtaatcagatgaaaagtcggaagaaagtttcaggcagaaggaacaacgtgcaaagatgagagaaattaaaggaacaaaagttcagtgtgtctagagtgtagaggatgaggaagagggatgtgacgtgagatgaggctgaagagaggcagggacctgaccatggggcaccttgaaattcaggatcagttggttgtattttcatcctaggcacaatgggaagctattcaagagttttatgcagaggattgactttgcn

SEQ ID NO: 10549 - DNA, 353 bp, Homo sapiens
  misc_feature 205: n = A,T,C or G
ggcacgagaaaatacatagtcttattggagtacacatatttgggagaacatagtttgtaaaggaagtaggaaggtttgtgctgtgatctaataatgattttgaggtaatcagatgaaaagtcggaagaaagtttcaggcagaaggaacaacgtgcaaagatgagagaaattaaaggaacaaaagttcagtgtgtctagagtgtanaggatgaggaagagggatgtgacgtgagatgaggctgaagagaggcagggacctgaccatggggcaccttgaaattcaggatcagttggttgtattttcatcctaagcacaatgggaagctattcaagagttttatgcagaggattga

SEQ ID NO: 10550 - DNA, 352 bp, Homo sapiens
ggcacgaggctaggtgagccctgctttgtcctcagtagagagccggttccctgggctcatccaggggctgagagacggcgggacgctggggcagggcacactggcggagctgcttgctcagtaaggaatgtcagttgttgcgctgggccatgagaaatccgccagaaaacgttaggtgagcagacatgccccccatgccagtgggctgctgtgagtgaggataaagtgtgtgttgggcatataaaccctggctgcccgcccaccctgtggagacaagtgcagctcctccagctggagagggctgcctctctcctgcccacttccctcccttctccatgatttccatggagag

SEQ ID NO: 10551 - DNA, 357 bp, Homo sapiens
  misc_feature 357: n = A,T,C or G
cgttgctgtcggtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttn

SEQ ID NO: 10552 - DNA, 365 bp, Homo sapiens
ggcacgaggaagaagcggagccagggctgagatcccgaaggcgggcgaggtctgggatggggcggggcctatgggagcggggctgaagccctgggcccggcagaggaaggtcgagatggaccatgttgggccccttctctccccgcccccaggccgcagttcgggggccacgccccggcgtgctcgggtcaccgcgggaagcccttgaaccccctggcgcccggcacccacgtgcggtaaccgcggctcctcgagagctccagggatgcggatctacagtaagggctgtggccagatgaatgaatgcacattttttagtgggcagaaagatgttagaattcatgaattagaataagcacaaaggg

SEQ ID NO: 10553 - DNA, 356 bp, Homo sapiens
  misc_feature 356: n = A,T,C or G
cgctgctgtcgacttgccattggtaccacctaccaaaccgcaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtn

SEQ ID NO: 10554 - DNA, 366 bp, Homo sapiens
  misc_feature 188: n = A,T,C or G
tacggctgcgagaagacgacagaaggggctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcggnggactatgggcaacatgttcagcttcgcggcggcatggggccctgacatggctagatttctcggctgagcagacatggggaccctgcgcagcgaacacagagggtgccatctgacgagaagagcttaagcttttctcaagacctcaacgaggccaagaagcccgccgtgagaacaccc

SEQ ID NO: 10555 - DNA, 358 bp, Homo sapiens
ggcacgagagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccga

SEQ ID NO: 10556 - DNA, 360 bp, Homo sapiens
ggcacgagatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtatgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcatttt

SEQ ID NO: 10557 - DNA, 334 bp, Homo sapiens
acccagaaaccaacttagagacacttcaaattttttgagctagagatcacaaacatcaaggtatttgactcttattttccatcacttgctacttgagggggtcacactaaccaattctggctacatactttcctgctatggactctagaagaaaaactgcaaagaaacagaaaactaaccttcttaaacatatataaggaatcaagggtttccttaaactattacctgagagtcctatttttgccttctgtatagtaagcatgtcattctactcactattctgccggaatacatcttcacatttcagactggattactttccaaatactggata

SEQ ID NO: 10558 - DNA, 685 bp, Homo sapiens
  misc_feature 456, 462, 503, 515, 534, 545, 546, 685: n = A,T,C or G
tccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggngagtanaaattcttcatattgatgacattagatactacattgaacanaagaaaaagagntgatttactcacgaatcangacttcattannagatggggcaaaaaagttgtagtggtgcccataaaccagacaggagattccaaagctttttgtaggtggagattggaccaacttataggcactttatctcgctgacaaatgcctttatattattcattcaggcctgctn

SEQ ID NO: 10559 - DNA, 657 bp, Homo sapiens
  misc_feature 459, 474, 494, 509, 518, 520, 548, 611: n = A,T,C or G
ggcacgagcccaggctggcctcgaactcctgggctcaaagcagtcctcctgccttggcctcccaaagtattgggattacaggtgtgagccacctgtatttttttttgtagagacaggattttgtcatgttgcccaggctggtcttgaacccctgggctcagagcagtcggcctgccttggcctcccaaagtgctaggactaccggcgtgagtgagctacctcacctggcctctcatagactttaatatgctaatagacattgttcccctctaaaaggcaagtatggtggccttcaaactttcttggccaggcaacatctttgtagaagaccactcttagagtactctagtattctggagaatacagtttgtcaggggcagttgtcttaaccttctataaatgtgtacttgaatcattgtaatgcaatgttgggcacattaggaaatacacagtacattnttgcctttaaggaantttaaatggagaatgtccanatgatactattacantccattagnantagacatctgatgaaatggtctttgtgnttatttgggagaaacatattgaagagctggctatgggttcacaggagcttaccattggatagnggtaaaaggattgaaactcataaaaatgtacatacaagcgactttt

SEQ ID NO: 10560 - DNA, 604 bp, Homo sapiens
tactgctgcgataagacgacagaagggagttaaattacacaactctgcagatgtttaaccaccgtacgacaatatactactttttgtgcgtgtgtgtatgtgagacagagtctcagtctgtctcccaggctggagtatagtggcacgatctcggctcactgcaacctctgccttctgggttcaagcaattctcctgcctcagcctcccgtgtagctgggactgcaggtgtgtgccaccatgcccagctaatttttttttgtatttttagtagagacaggctttcaccttggtggccacgctgatttatgactccccaccgggggctagttgcctggcttggcctcccaaagtgccgggattacctgggggagccccccaccttggaaaaaaagattgttttagttggcccccaaaaaggaccaccccatttttttccccgtgaggggggggggtgggccctgctgtatgacttcgtttgggagctttggggaggacaccgtcggccgtttccttgtccctgaaacaggggaaagccccccccttatacaaggatttgggggcggggggaaacacttttcccatttggaaggttgcccaactggt

SEQ ID NO: 10561 - DNA, 225 bp, Homo sapiens
ggcacgaggagagagagagaactagtctcgagagcagcttttttttttttttttttcgggatggaaagaaaccttttgtggaaccaaaaccaaacctttttttaaaggatcaacagcccaccccaaaacgcttttaatccaaaaaggaccccagggcccaaaaaaggttggctaatattaaaaaaaaaggccattttaatcttcgggggcctacacaaagctcat

SEQ ID NO: 10562 - DNA, 226 bp, Homo sapiens
  misc_feature 26: n = A,T,C or G
ggcacgaggtcgagtccagggccaangcttgtgttcaatcgtgtgaatggccggcggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccc

SEQ ID NO: 10563 - DNA, 496 bp, Homo sapiens
  misc_feature 26, 29, 30, 31, 32, 33, 35, 36, 37, 43: n = A,T,C or G
cttgacactaaactacttgcagcccntgnnnnntnnngaaganccgatcgattggaattcggcacgagattccctttatactgaaaaggtcttaatgtcatttaagtaatcaaatttggcatcaccattggaacaaacatgtgcctcttcttttgatgtgataaaaaggaccatcacctttatagtatttgggccaaaaacatttaatttgaacataataagaaaacatttagacaaattcagatgtgtggaacaatgtgcaaaacagctgtcctgaatgcttcaaatataacaatattatgaaatgttttatataataggccagagacatggcaactaaatacaatgagtgacccactagtaaaaacttaataaatattcaggcccttttttaaacagttgggagatatctgaatataggatgcattgtatattatatcaatattaattttcttgagtgtgatataatgatattgtgtacataagaaaggttttg

SEQ ID NO: 10564 - DNA, 448 bp, Homo sapiens
  misc_feature 250, 298: n = A,T,C or G
ggcacgaggtaggctggtacctcaagtgagtcactcagggaacaatgagcacttgaagatttttttatacaaaaggccacagtgaggccaccttgagtcaagccgactaaggcccctcaaccctgtcactaagcagcacgtgacactggcaggaccttcatctccagcatcccacccctgggtgtgggactttggggcagccgtgtgtgcaggtgtcggcacaggctagctcctcctgggttggggtggnggttgccattgcagagcaagctgccacgaagacccctgggcatgattntgcttgtatttccggaagtggggttgctgggtcatagggcaggtgtaattttttttccttgagaggtccacttcctgttctgggaggggggcccaaggggtctgcttttggcaggcgcagtggctcaccgctgaaacccagccttcagaa

SEQ ID NO: 10565 - DNA, 444 bp, Homo sapiens
  misc_feature 336, 355, 398, 401, 402, 410, 411: n = A,T,C or G
aattcggcacgaggaatccgggaggcggagctttcagtgagccgagatcgcgccattgcactccagcctgggcaacagagtgagactccgtctcaaaaagaaaaaagaattaaatggggtcaggatggtctcagatcttataacaagaaggcaatgaagcaaaaggctccaaaggtttgagaaaaagtgccaggaattttatactttgccaaagttgtcttataatacaaaggctatagatgttctcaagtttgtaagaactctaaagtacaaatcatgagtctttgggaaaaaaccgcccaataatgaaattcaactaaagaagagatgaatcanattaagggacttaggacanagaatcaagtaaaggagtgtagtaaacacttcagaaaacttanaanntatggcanntgattataagtcaatattatgaacactgtctat

SEQ ID NO: 10566 - DNA, 431 bp, Homo sapiens
  misc_feature 208, 228, 431: n = A,T,C or G
attcggcacgagctgagcccttttatatacttagccactacttctgtctgtctgtctgtctctctctcttcctctccctctctctctttctctctctccctctctctctctttctttctctctccccccctccctctctcttcctttcctctctcttggtggaactgggagtggaggcccagtggctggggagacattaggtggtggngcccagcccgacctccaggntcttccttctccctacgctgtgctttggtctggccactcccagcccccttgtccccttggaagcttgccctgccctcatcttgcccatgccttctactggcaggagacttgcacccatttcacctcctaggcggggcaaagtgggcaaggatggacaacacaaggggggaaggtctggtcattccccctgcatcacagacgan

SEQ ID NO: 10567 - DNA, 426 bp, Homo sapiens
  misc_feature 426: n = A,T,C or G
ctctgtttttgggatcctcggtcaattcgcacgagacgtgaagaatattttgatataggtattatgacaaattgaagtaagagactgttgcccagtaatcagatgttggacaaagtaactttactggaatttggttcttgagctaatcggtcagagagattaacttccatatttgtatttcttataaagtcagaattttttgtctgtatttctctagatgaggaactctggatgatattgaatattttatctcaattgatataagagaatgaagttagaatgtgaatattgcagctattttataatcaagggttcagatttgggttctcccaattaccagctctgtgaccttgaaccctctgtgacccgtctgtacaagggagtactatttagaggtgcctgccttctatgttgttagagaaggcn

SEQ ID NO: 10568 - DNA, 428 bp, Homo sapiens
atcgattcgaattcggcacgagagaaaagaaaacaaatgctgtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaataattaaattagaaggt

SEQ ID NO: 10569 - DNA, 422 bp, Homo sapiens
  misc_feature 422: n = A,T,C or G
attcgaattcggcacgagtcaggtcacactgcagacctactgaatcccagcctaccttttaacagaaccccctggtgatttgtttgcacattagagtttgaggaacactggtgtaggtttctggttactcatagagttgttccccttactcaggtgcccaccccactggtggatgggggagcgaggcggaccatgtgacttggcatgaacacactggggccacaagatgcacatctgatacataatctaagactgttgggttttcctttagctcatagcatttccatcaagggtattggtagtctccagttgctgagacaaagtgaatagagaatctcatgatttatttaaaaacaaaactattttaatatgtccccattttatttatatcttactttttattagcccaaagataattaaan

SEQ ID NO: 10570 - DNA, 415 bp, Homo sapiens
ttcggcacgagctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaaccctgtgcaaacttaaaaatggcaagaggtgagaatgacattttgaatctgtgccaatattcagaagactgcatggtttcaagacttatgaatttgagacttagtcagtgggctaacaagtgggaatgaatgtttgagagaacaaaagaaggggtttggcgga

SEQ ID NO: 10571 - DNA, 414 bp, Homo sapiens
  misc_feature 306, 414: n = A,T,C or G
gcacgaggaactagtctcgagagcagtttttccacctcggcctcccaaggtgctgggattacaggcatgagccaccacgtccgtgcccaaatatgtatttaatttaaatttcattttaatgtgtttaagggatgaaagtaaatacatgcttgttacaagccattcaaatgtagaagtaggaaggtggctgcccggcctcccctctcctgggaggatctgtggtgagcagtcggatgtgcatccttctggtcttttttctattaacgactctttgctgggatttgctgtactaggctttcgcagcanacgtgggattgttgtggaaatgctttgctggagaagggacgcgagatcacaaaggaggctccgtgtcattgcgtattgcaagtcttagctggagtaagaaacttggtn

SEQ ID NO: 10572 - DNA, 416 bp, Homo sapiens
  misc_feature 294: n = A,T,C or G
ggcacgagggaacctcctgtatccagaagggttgttcatgcttttgactggttatgaatgaaaaaagatttctgcctttgaggggttttaaaagatggaaataaggatgtttgtgatggtgctcttgctttgcttgggacataaaagatgattcaatttcacttcagcacctgacacgtcatcaccaacatgcttgcttacaagttcctttcaattttagaataataattaaaaacaaatatatagctactacttcaattctaaaatatcccaaagggtagttattaaaagcanatcaaagaattttatcttattttagtttttccttccctttctctaacaaaaataacataagtaaaaatatatacaaactggtcctttttaaacttcgcagaatgtctaacaggacatttaat

SEQ ID NO: 10573 - DNA, 418 bp, Homo sapiens
  misc_feature 369: n = A,T,C or G
ggcacgaggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaactnttaagcccctgccatgggtgctcctggaaggagaaccagccaccctgag

SEQ ID NO: 10574 - DNA, 415 bp, Homo sapiens
cgatgctgtcggccggcgggctgctcgcgccggctggtggccgagctggggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgaga

SEQ ID NO: 10575 - DNA, 411 bp, Homo sapiens
cgttgctgtcgggcgagaagggtttagacaagatcatctctaaaaacctcatggttggctgagcacagtggctcatcaaccctgagccaactttgggaggccaaggcaggaggattgcttgagcccaggagtttgaggctacagtgagccgtgatcacgccactgcactccagcctgggtgtaaaaataaataaaaataaaaggctcatggtaattttaaaaggctatttttctatgacacttgattgccattgcaggggaggggacaggaatgcttggtgtcatggtacaatttgatgtaagtgacttagttttggataaagtggggtttctaaatctcagtgtggaggctttatctattttgtttgtcattggtaagattgccaactcacttcttggcaagagggatgg

SEQ ID NO: 10576 - DNA, 409 bp, Homo sapiens
cgttgctgtcgaaagcttttacgggattattttcagtgtactactggactccaaatacagacatcatgagatgtccacttgcccacgtgtggacacacaggcaggagcggcccagatcctcccttgtctgtggcctggtctttccatctcacattccctaacaggttttgtacgagtcacatactttaggcttaaatgtcatttattagtcatatcttttctctgcagcaataaaatatagatataaatattaaagtttgtctatgagtaacaaaattgataaaacccaaaaatataacaaattcttataaaaccaaaaattaaaatgttactgaagatgcctttcttagtgtatttagctttaaaggaaaccacctgattcgttctgtattcactgatggttgcacag

SEQ ID NO: 10577 - DNA, 412 bp, Homo sapiens
ggcacgagcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtggtgggttgctcagtctgtcttccctcatgagaagctactgctt

SEQ ID NO: 10578 - DNA, 411 bp, Homo sapiens
  misc_feature 142, 146: n = A,T,C or G
ttcggcacgagagagagagagagagagagagagagagagagagagagagagagagagagagagagagagagagagagagagagagagagagagagagagagagagagagagagagagagagagagagagagagagagagagngggngcgggggctctctcttttctctctcttgtgtgtgtctctgtgtcgcgagcgcacacacacacgtgtgtctccccgcgcgcggggggcgcccccccccgtgtgtgtgagagagagggggggccaccacccactctccgtgtacactctgagagagggcggggtgttgatatctcgtaaacacccccccccccccacacccgggggggcgggatttttttggttgcgccccccccccccccacttcttttccttcttggggggaggg

SEQ ID NO: 10579 - DNA, 408 bp, Homo sapiens
cgttgctgtcggacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtg

SEQ ID NO: 10580 - DNA, 410 bp, Homo sapiens
cgttgctgtcggggagccgggactacgcggaagtgggggtaggggccgcgggacggggaggggcgtccccagtacccgcgagtggcttcagggagcgcaaggccagctgagtctgggcgctggatgggcggccttggcattaggtccagatttgggtcctaagtactgtgcccaaccggcccgaggggaagggggaggagacaggaaccgcgcccattttccggatcaggttcttggaaccagcccggaaatcctgggactcaatctgggggccagatctggaggcgatggtttttctagagacgggctgatgcagccccagtatgccgtcgcactcatttcccacattccaggaacggtccaggtctgcccttcagcggtttgggaactccgcgacgactccctctctc

SEQ ID NO: 10581 - DNA, 402 bp, Homo sapiens
ggcacgagtcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcgggtatagcacaataagaaaccgacaaaaacagcagctgatgactcactccaacaacgcacagcaccagaaggcaaggaaatcaaacctcagaggctaaatgttccatgacttctccaagatcatgaagtaagcactgagtaagtagggagggggagcaaggactcaaccccttgctcctaatctttactctataccgcattcaggagccgc

SEQ ID NO: 10582 - DNA, 404 bp, Homo sapiens
  misc_feature 404: n = A,T,C or G
aattcggcacgagatttatcttttttctgaattatttttaaggttaaaagtatagaagtagaatttatggggcaaaggatatggtcatttttacagcccttgctatgtagtaccatattgtgtttccaaagggttgtatctatttaaaacgccatctgaaataaatgcattaaaattttccttctaaattttttttaatcagaaatgctaggtagttttaaacttcagtgagttaaaaataattattgtctctttttaaaaaatgaagagtgtggaatagatggtctcacagataactaatggtgcaaaggagttaagcaacacatcccaactattcccaagttatggcacacatggaaagcgatgctgtaggcacactgaggaaaatggacaaaggtggttcn

SEQ ID NO: 10583 - DNA, 402 bp, Homo sapiens
tacggctgcgagatgacgacagaaggggggggtgatttcgactcttgggacatttggcattgtctgaagacatttttgtcatcacacagagaggaaggctgcttatattagtgtctattaattagaaatcagggtgctgctgagcatcctacagtgcacaggacagcccccctcatgacaaaaaaaaattagcccaaaatatcagtaacgctgctgttgagataccctcttttaaagttgacattctcctcaaattagtctgtaattttaacaaaattccaaaaaatgccaagtgtttttacttgtgtggattgcagcaacctcggtttaaaattcatatggaaattaaggatgaaaggataagcaagataatttttaagatgaaaaataaagtgaagaaat

SEQ ID NO: 10584 - DNA, 403 bp, Homo sapiens
  misc_feature 382, 403: n = A,T,C or G
gaattcggcacgagggaagatggcggcctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtgtggaaaggtacttgaagtttattgagttgcccttgactcanaagaaagtttggcaaacatgn

SEQ ID NO: 10585 - DNA, 406 bp, Homo sapiens
atatatacaagctacttcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgtt

SEQ ID NO: 10586 - DNA, 404 bp, Homo sapiens
  misc_feature 404: n = A,T,C or G
ggcacgaggttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttcttn

SEQ ID NO: 10587 - DNA, 403 bp, Homo sapiens
gattcgaattcggcacgagttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaatta

SEQ ID NO: 10588 - DNA, 398 bp, Homo sapiens
  misc_feature 243: n = A,T,C or G
aattcggcacgaggtgagccaccacgcccagcctatggtaaatatattttgaactacaaaggtgctgtggtactttaaagaaaaactatttttactagtttatctgaatggtctgtggactttatttagaaactgtttttcagtttagttttttggacatatcctttgctcagtgtgttttgttacttctctagtaaaggtagaagtgaagcagatgccattgtaggttttaccagcatttanatatattatgaattgcttagcaatgaaatgcaagtatgcatcttttacttaaagatactatttatgtattcagctacagagatgaataacattttatgtggtaattggtttggctataaaatttaagtccttacagcatttgggggttatacact

SEQ ID NO: 10589 - DNA, 400 bp, Homo sapiens
ggcacgaggatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagctactggagccctcct

SEQ ID NO: 10590 - DNA, 400 bp, Homo sapiens
cgttgctgtcgattaaataacaatatattaccatgggtaacttcctatatggttagaattctgccaatctgaatttttctttctcagaattcaaggcgataacattataaaaataatagttatagatcctcaataggatatttcaagggaattacattcaccaaaaggcagcctttcatataaacatatcatgcaagctgacataaacacctaagtgaacctaaatgaaaacaatgttttctattgctctgagctctgtgtgaattggctcatcatagcaaaatgagcttcttagtggtcagtgcattgagaaaatggaagaactgtcatgtattcaaaaaccagaaccaagtactggattacagattaagaacagacaatctttggttttggaatcaaa

SEQ ID NO: 10591 - DNA, 396 bp, Homo sapiens
ggcacgagaagcacttgaagggccaggagatttgttttgtcccttgacttagaaccttccctattggatcatccagtttgagagtcttgtcacttagggaagcctccaggttaagtgggccctcagcgtctaaccttactgacgcagggatgggatgttgcctttccagaatcttggtatataagtacagcgatgaaaaaggagttcagaatatttatcttaagtattttttctaactttcacttcaaaaaattcttcacctccttttaaaaaaattaaaacagatataaaaatttcactaggtgtttaaatgagcctttatcacctgctattggggaataaaacagcatagacggaaatatatatataaatatatacataaaaatatgtgagaaa

SEQ ID NO: 10592 - DNA, 395 bp, Homo sapiens
attcgaattcggcacgaggctactcgaggctgaggcatgagaatcgcttgaacccatggaggtggaggttgcagtgccactgcactccagtctgggtgacagagcaagactccatcccaaaaaataaaaataaaactctaggtggaggcttaatcttttctttaaatcagcttcttagagcactctagaactcatctgtaacatttggttctttaaactcttatttcctacaggtgcttgaatggtgtgacaatttggtacatgtcataatagaaaagctagggggaaatgtatatagcatcttttgtagagacaactgaattgcttgtgctactctattcctccagaagtagttccagtttacattccaagaaataaaagaacccatttcccat

SEQ ID NO: 10593 - DNA, 401 bp, Homo sapiens
  misc_feature 23, 24: n = A,T,C or G
cccatcgattcgaattccgttgnntcggacaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagt

SEQ ID NO: 10594 - DNA, 399 bp, Homo sapiens
attggcacgagcagcctcccaaagtgttgggattacaggtgtgagacactgcgcctggctatattttactatttggaaatcacaatgcatcttaaaattgatggcttcttgcaaccactttcaaccaggtgcctgtcatgatttagtgctagcatcaaggcaggttagttatgaagaaatagagtgtgtgtttatatactcacacagttagaaatcgacccttttaaaaattatttctttttgaaaataatgtcagttccatcagaactaatgcattgataactaaatgtctgtggttccttgtcataggtctacacctgacctctctattttgtgcacataggggattcgtaatatcactgttcagtcagtcattcaccatctagtgatcatcattct

SEQ ID NO: 10595 - DNA, 396 bp, Homo sapiens
ggcacgaggtcagggaaggctcgccgctgggagaccgccaaagtgacccgagatggagtctgggtggcctgcttattaggggggcacacctgtgcgaggacgggaggggagggagcagcaggactgggcaaagggagaagctgagccacagtgcgagccggacgcacgggccacgttgcgagggcatgacctggggcgaggcagccctggaggagggggcagctgaaggtgtctgctgaccccacacccaacagctcgggtaacaggccttactgtcagagcgatctggttgccacgtctctgtggccctcagagagacatcatgttttcttttttccctgcacctttttgttttgaaaaatgttcagcatacaaacaagttgaacgtaaagtgag

SEQ ID NO: 10596 - DNA, 399 bp, Homo sapiens
  misc_feature 380, 399: n = A,T,C or G
ggcacgaggttaccttttgatcttaaggaactgttttgattgggtcacttccttgcctaaaattccattgattgttcattgttaattctaaaatagagttcaaatttaaaggcatgtaagttcccctgtaacggatttcctctactcccccttccgctgtaatctcccatttttttactgaaatgcttcagtgagcatgggtctttagaggtcttgatatacaattttcctgaagcaggaataccttgctttcctctactagtttaccacaattacagctctcttttaagcctcagaaaaaaatctcacttccgtcttgaagtcttaatccacgctttttatatccatgtgcctactccttctctgaaatctcctatggnttatctttttattcatttn

SEQ ID NO: 10597 - DNA, 397 bp, Homo sapiens
ggcacgaggttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggg

SEQ ID NO: 10598 - DNA, 397 bp, Homo sapiens
  misc_feature 154: n = A,T,C or G
ggcacgagctgagcccttttatatacttagccactacttctgtctgtctgtctgtctctctctcttcctctccctctctctctttctctctctccctctctctctctttctttctctctccccccctccctctctcttcctttcctctctcttngttgaactgggagtggaggcccagtggctggggagacattaggtggtggggcccagcccgacctccaggttcttccttctccctagctgttgctttggtctggccactcccagcccccttgtccccttggaagcttgccctgccctcatcttgcccatgccttctactgccaggagacttgcacccatttcaaccctagggcgggggcaagtggggcaaggatggaccagcaaaaggggggta

SEQ ID NO: 10599 - DNA, 399 bp, Homo sapiens
ggcacgaggaggagtcttggagagctctatttcttgcctcgattctatggacattcatgcccttttgaagggaggaggctggcacctgaaactgggcttttgtttccaagactagaccagtccaggacttggctggtgaaagcccaccggacctagaaactcagttcttaccggcttgtggtaaaaaagcaaacgagttatctttttattcttgattttcaggaaagttatactagtattttcttaagtgtggaatcacatgagcacataagctgtgcccctgtgaaaagaggttctgagcctttcaggtgcctgctcctattcatttctctgcgaccaatgatcactgtcctttgtgcattgtgtgtctaagatgtcttcaagggaaagatgggtaag

SEQ ID NO: 10600 - DNA, 398 bp, Homo sapiens
ggcacgagggggcgagccgctgcctgggcgagggtcggggtgatctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttgctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaag

SEQ ID NO: 10601 - DNA, 399 bp, Homo sapiens
ggcacgagatgcactcagcggccctgactgggagagtgactggattgatacaaccatcagttctattcagagtatggaaatccagcaaataatagatcatcagtattgcattcaaagcctccagtgcggatctggaaattataattaccatattcctgaggagaaacccccccccaacaatggcaagggtcttttgagcttaaacacaacagagccattgatagtcttccagtgcaaattcacccttgggaatatatggttccatagtataagggggaaccgaagggctctaaggcgcctgaagaactctcgcggacaaaacaaaagtgatatgacgcgtatgaaactgaatgtagcccacttgaccgactgatgaaccgtattccaggtagctgcgcg

SEQ ID NO: 10602 - DNA, 396 bp, Homo sapiens
  misc_feature 396: n = A,T,C or G
cggcacgagcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggccccttgtggggggttgctcagtctggccttccn

SEQ ID NO: 10603 - DNA, 396 bp, Homo sapiens
ggcacgagggcgcctcagcccggcctgggcgagccctgggtgctccgccgggcagctcacggcgccccgtatggcctggggatcctaagaggccctgtgacccccctcgcctggtctccctctcacccctggagggttgccgcagctccggggcccccgggcaggaagggcgcactggtcgtcccgggagaggggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggg

SEQ ID NO: 10604 - DNA, 397 bp, Homo sapiens
  misc_feature 397: n = A,T,C or G
catcgattcgaattcggcacgagggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcgggtcacacactttctgatcctgagcaaaacagagaccaatggctactttaagctgatgcgcctcccaggaggccgcaccttgaccttcaggtgaaan

SEQ ID NO: 10605 - DNA, 399 bp, Homo sapiens
ggcacgagccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagg

SEQ ID NO: 10606 - DNA, 399 bp, Homo sapiens
ggcacgaggcaatgcccattcatcgattctcagtcctggccctgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatg

SEQ ID NO: 10607 - DNA, 393 bp, Homo sapiens
attcggcacgaggcgccttctgtgtgttccagaaagggtgcctcccactgcatgcttgcttatctgagttagaagaatgctgtggtggagtttagtgtaaatttttaaaatattttttgagccttatgattatatagtttttgtgtttctgaagtaggaattaaagtgggcattaacaaaatatttaactttggacttaagttataattcaggttctgaagaataaaagtaaggttagtttgttttgatgcctaaaaagtcctcttagggaatattattttgaagccctttactatgctgttaatagtgcttggcttttaacttggtaccagggaattggaagggttctgtcattttgtgacgatatttttaaatttcttttgaaggtagaag

SEQ ID NO: 10608 - DNA, 390 bp, Homo sapiens
ggcacgaggagagagagagagttagagagtgagagagagagagagagagagagagagagagagagagagagagagagagagagagagagagagagagagagagagagagagagagagagagagagagagagagagagagagagagagagagagagagagagagagagagagagtggttctctctctcccccccccccctcttttttttttttctctctctagaattcatgtgtgtgtgtctctctctctctctctctcgtgtgtgtgcgcacacacaccccacatctttttctctctttccctctcgctgtgtgtatgctctttgtttcttctctctctcccccctctcacagagagagtacgcactctctctctcttttctctctcacg

SEQ ID NO: 10609 - DNA, 390 bp, Homo sapiens
  misc_feature 390: n = A,T,C or G
ggcacgaggtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgagaggcttttggtgcaggcagccgttaacctcctgcttcctttgttacctctggattactttgcagtaaattgcaggtcttttaagagatttaagcttcagttttctcaaaacaaaacaattatcctgtcttatctgaagatgcagggttgtgggcaaaagaggctggttataataatgccctn

SEQ ID NO: 10610 - DNA, 392 bp, Homo sapiens
  misc_feature 392: n = A,T,C or G
cgttgctgtcgaaaccaccgtggcacatgtatacctatgtaacaaacctgcacgtcctccacatgtatctcagcacttaaagtattaaaaaaaaagaaaagaaaaaaaaatctggtgcctctgtgaggaagaaggaaaaatacagccccatgtccttgcaaaatttataggctttttgtgagtttagatatttgctgaagtcctaaatggagaacatgagaggcttgcaaaatccttaagattcctctgctttgtttttgctgtctttattgaaggaaaagggaatatagaatataattttgccgttttctttattgtatttgataacaagagacaagttccagaatcttcatttttaaaaaacctcagtcacataatttttgacaccaaan

SEQ ID NO: 10611 - DNA, 392 bp, Homo sapiens
  misc_feature 392: n = A,T,C or G
ttggcacgagcctatctccaactttatgggcttttgtttttagctataccatagctgtctcaaattaaacttgttaaactgaatgcatcattttcattactaccaccatcctctaattctctgcccctctaaaagctgtctcttcctgctgtattttctgactttgtgaatggcacgactgtctagcaatttaggtcaaaaccatgactaatattagatactttcctctccatcaaatctttttcaatcccgttaccctactgctactgactaggcctggataatgtcaatgcttatatgataaaggctggataccttaacctggatttcaagcttgtgggcaagaacaaatgaaactatgaaaaaatgggctgtataaagggtattaagtn

SEQ ID NO: 10612 - DNA, 390 bp, Homo sapiens
  misc_feature 390: n = A,T,C or G
ggcacgaggtaggctgttacctcaagtgagtcactcagggaacaatgagcacttgaagatttttttatacaaaaggccacagtgaggccaccttgagtcaagccgactaaggcccctcaaccctgtcactaagcagcacgtgacactggcaggaccttcatctccagcatcccacccctgggtgtgggactttggggcagccgtgtgtgcaggtgtcggcacaggctagctcctcctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggn

SEQ ID NO: 10613 - DNA, 394 bp, Homo sapiens
tcggcacgagatcaaaaaggaaaatactttaacgttgaaagagttggtcagtacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagatgtaattggaaaatcgatgaatcaagcaatctgtattccattgtatagagataccagaagtgaggattctacacgtagattgttcaaatttccttttctgtggaataataaaacttcaaatctacattatcttctttttactattctag

SEQ ID NO: 10614 - DNA, 392 bp, Homo sapiens
  misc_feature 219: n = A,T,C or G
cgttgctgtcgggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtaagtgaagacttgggaatcctgtgagaaatgatgtanagcgagaggaagacagcggagccgcggctgccgcgttctctcaaaatggcccgagtgacgcgtcgtggcagaggctcagcgccgcctccggaccccaggcccgttgctgcggggggctccgtggcgtagtcgccgctgccattttagttgagtggtatagtcgacaggctctt

SEQ ID NO: 10615 - DNA, 391 bp, Homo sapiens
ggagggatatcttaaaagctttcattgtggtctgatgggagcagatctggaccaaggcacatggggatcctaagaggactaattcatttggtgacacttctttttctttgaatttattttgcaagagctgaacaacaacaaaaatgatactctcgccaggagtccccggcgtgcagtggagcctcgctgggggaaatgacagcttggaccatgggcgcccgcggtctggacaagcgaggaagtttctttaaggtaaaaggaagccttgattgggatctcaactcgtcggcttgctgcctgagcctgggagctgcggtgctccatggagctgctgagggaagtctgctctctgagccagcacccgctaagggagcttgcccgagcccaactg

SEQ ID NO: 10616 - DNA, 393 bp, Homo sapiens
ggcacgaggagatagagagagagagagatagagagagagagagagagagagagagagagagagagagagagagagagagagagagagagagagagagagagagagagagagagggcactctcttgtataaatctcttttttgtgtttctctcttccccccccctctctttctctctcttatagagcgacaccctctctttttgtcccctctctctcgcgcccccgtgggcgctctctctctctctctccatttttcaccacactccccacacatatatatatatgagcccccccgcgcgcgcgtctctctttttttttgtctctctcgcgcgcctgtgttttgtctcgcatcttttccccactctagagtgagagcgcgcccccacacctctc

SEQ ID NO: 10617 - DNA, 390 bp, Homo sapiens
ggcacgagatcacctcctgctcggtgctgtggctcaacaatgccttccaggcgcgtgcggggctaggggcggggctgccctcctggggcctggcgcccggcgcccacctggcacgtgcccccgcccccaggatgtggagtcagagaacgtcaacgtggtgaagcggctgttcaagatccagaacctcattgccagcaccgttcgcacggtgatggtggccgactgcagccgcttctacagccctgacctgctgctggaagccggtgacccggccacgtccccctgccgcatctttgacctgggcagcgacaacgaggaggtggtggctgctctggcctcctcccacgcacatgacgtctttgaggactattcttacagcgagctggaggg

SEQ ID NO: 10618 - DNA, 393 bp, Homo sapiens
cgttgctgtcgtaagcagtcaccacagaacaagcaccgtatgactccactcgcagcaggtcctagattcaccaaattcataaagacagagagtagaatgggggtgccagggctggggtgggcccagggagtgactgtgcacttggaacctggaagccagaaggtaaaccatctctaagcacaacagcacgggaggcgccttgctgtgggcacggctgggtcactcaccggtcagatgcatggtctccaggagcttggacaccagcgccccgtcttcctccagctccacctgcacgaggcccagcttcctgcgcatcttctgcaggccaccgacgctcctgggaggcagtcagtgccgtctccctgcgtcactggcagaagactgaggctcaga

SEQ ID NO: 10619 - DNA, 392 bp, Homo sapiens
  misc_feature 227: n = A,T,C or G
ggcacgagggcttctgattcagggccggcctggcctgggggttgagggtcagcagtcagtgaggaggccaggagaggcgtcccagccttctcccgcctccagcccacgcggggccttggtgcccatgagctgagcacccccacaaccctagtcaacggccctatcctgtggggcctctgccacatctcagcggccccaggtgaatggctggctgctcagcagctcancacggagagctggggagagaatctctggctggggaggggctgctggagctgctggacccaggggtctcccgaggtggctcaagggagcaggcatcttggggtaccctgggttgaggcagaggctgcacgtggaagatggcccgagtcagtggatggtgccagtca

SEQ ID NO: 10620 - DNA, 391 bp, Homo sapiens
cccatcgattcgaattcggcacgagcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacaagcagcgagccagcggccggactctgtatttcggaccccactccagtgctccctgggtcataccaagatctgcctctgtccacaagatgagggaaaagatgactgggcgggctctttacttcctgcggactggcggatttaaaggtgcactcgaacagcaagccttttgcgggaaag

SEQ ID NO: 10621 - DNA, 391 bp, Homo sapiens
tcccatcgattcgaattcggcacgaggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagac

SEQ ID NO: 10622 - DNA, 393 bp, Homo sapiens
tcccatcgattcgaattcggcacgagccttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagaatgctatgctggactttgtgttcacagtagatgaccctgtcgcatggcattcaaagaacctgaagaaaaattggagtcactt

SEQ ID NO: 10623 - DNA, 390 bp, Homo sapiens
ggcacgagtgtctttacgtttcacaaccatggaaggactgccaacctctactcccttcacaactggctgggcatcaccactgtcttcctcttcgcctgccagaggttcctgggctttgctgtcttcctcctgccctgggcgtccatgtggctgcgcagcctcctaaaacctatccacgtcttttttggagccgccatcctctctctgtccatcgcatccgccatttcgggcattaatgagaagcttttcttcagtttgaaaaacaccaccaggccataccacagcctgcccagtgaggcggtctttgccaacagcaccgggatgctggtggcggcctttgtactgctggtgctctacatacttctggcttcatcttggaagcgcccacag

SEQ ID NO: 10624 - DNA, 387 bp, Homo sapiens
  misc_feature 387: n = A,T,C or G
tcaattcggcacgaggtggtatccagttctgacttgacagacatgagctttttctcagctttctccttcatcttctccagttggtctctggatttgtttagatcttcaatggctttagtctgttccaaagctttaatctacaaagtcaagagaatgctgataactccttttgtatttagttaggaaaactgtctaaacatgacaaatcagaagtcaatggaattcacttcataccctttttatgaataaagaatggagttcatcccatacagctagagattttgctaagcatatgtgctggacaaacatgtcttaatacagttaccgcttcaaaccacaccttagaggacccttatttggaaaattcattgaaaaaaaactgatacn

SEQ ID NO: 10625 - DNA, 384 bp, Homo sapiens
ggcacgaggagagagagagagagagagagagagagagagagagagagagagagagagagagagagagagagagagagagagagagagagagagagagagagagagagagagagagagagagagagagagagagagagagagagagagagagagtgtgttttcccccccacatatttctccttctccgagcgcctctccctgtttcgttctctctctctctctctctccatatgcgtgtgtatatgtacacccctctcttttttttgacaccacctctctctctccctccgtgtgctctcgtgagagagattgtctgtgtctgtgttcttttttctctctcttttttcccacccctctttgtttgtgcctattttctctctttct

SEQ ID NO: 10626 - DNA, 387 bp, Homo sapiens
  misc_feature 329, 358: n = A,T,C or G
tcgattcgaattcggcacgagagattctcctgctcagcctcccaagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagntagaccctcatttttcactgtcagattanatccccatacctgaaataagtttacattt

SEQ ID NO: 10627 - DNA, 384 bp, Homo sapiens
ggcccgggcgagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagcgagagagcgcgccccccccctctttgtttttttgggaggggggagggaaagaacacacactcacgcgcccgtttttttttttttccgcactgcacgaaggagagacccgcgtgtcttttttttatactctctatatatgtacacgcagagagagagacacacacatttatttctcgcactctccctcccct

SEQ ID NO: 10628 - DNA, 384 bp, Homo sapiens
ggcacgagccaccttcaactacaaccctgctcagcaagccttctaaaaaaaaaaaaaaaaaaaaaaaaagccccccctttttttgggggagggggggccccaccaaaatcccaaaaaaaccggaaaaatggggggggccaacccccccgggtttaaatccttggggaatggggaattggtttaccccaaagggccccctttgggggccccccctaaaaaaaaagggcccccccaacaaaaaaattggaaattggttttttttaattgggaccggggccgaaatttttcaaaaaattccttttttgccccccaacaaaattgggttttgaaaaaacacccaaacccccggccaaaggttcccctattttttaaaagggaaaaaaa

SEQ ID NO: 10629 - DNA, 388 bp, Homo sapiens
ggcacgaggccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaaa

SEQ ID NO: 10630 - DNA, 384 bp, Homo sapiens
ggcacgaggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatattcccactccagggcg

SEQ ID NO: 10631 - DNA, 387 bp, Homo sapiens
ggcacgaggcgacacccagaccgagacctcgggaatgctccggccccctgccgccgtctcccggcccggttctctttcactaaaaataggcgattctggcagcgcccctcctatggggccttgggggcaattggggttttgtcttagagcccgtgtggacccggatggcgacggcagcccgaggagagggagggctgactgtatggttggctttccgacgaccagaccctgcaggattcggcctttccctttggagttttcctccatccccctccgtccctcccaggggatgcccgcaggccacagtggtcactgaaggtcaaccctgagccgaaggagaagaggcctcgaccctggggaccccttcaggtgcagcttgaggaggag

SEQ ID NO: 10632 - DNA, 385 bp, Homo sapiens
cgttgctgtcgattttgtgatgagtctctagaatgattaaatgactatttttttatgaaaaattttttgttaataaaatatctgagggtattttgagtatgtggaaggaatgcctgaatagaagctgatctatcttaacatacctcaagaactccagttttaatatggtgagtgaggagttgactgggaaaaggagagatccaattcttgttctagtccttggcacatacactctctgggttttgagaaaaggatggtcctacaacgattctaagttgttttctcattggtcctacaacaattctaagttgttttctcaaaggcaaaagcatgatttcaaaatgacatcacttgtccgattttctgtggatggaaagatttaatt

SEQ ID NO: 10633 - DNA, 389 bp, Homo sapiens
ggcacgagatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttgg

SEQ ID NO: 10634 - DNA, 384 bp, Homo sapiens
ggcacgaggcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaat

SEQ ID NO: 10635 - DNA, 388 bp, Homo sapiens
ggcacgagctccatcgccaagatcttggcccagcagacaggccgtagggtgctgacggtggatgctcgtaaccacggtgacagcccccacagcccagacatgagctacgagatcatgagccaggacctgcaggaccttctgccccagctgggcctggtgccctgcgtcgtcgttggccacagcatgggaggaaagacagccatgctgctggcactacagaggccagagctggtggaacgtctcattgctgtagatatcagcccagtggaaagcacaggtgtctcccactttgcaacctacgtggcagccatgagggccatcaacatcgcagatgagctgccccgctcccgtgcccgaaaactggcggatgaacagctcagttctgtca

SEQ ID NO: 10636 - DNA, 389 bp, Homo sapiens
ttcgaattcggcacgaggccagagtcgccctggttttctatggcgtcttccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcaccgctttcctcttataccgcctgctgctgctgaaggggctggggcgccgccaggcttgtggctactggtgcttttggcttcttaaccacctgcctatggcagtatccagccgcggtaatgcggactctattgtcgcg

SEQ ID NO: 10637 - DNA, 381 bp, Homo sapiens
cgttgctgtcgggtggggcctcgggatgcagccgccggtgcccgggcccctgggcctgctggaccccgcagaagggctttcgaggaggaagaagacgtcgctctggtttgtggggtctctgctgctggtgtccgtcctcatagtcaccgtcgggctggctgccaccaccaggacggagaatgtgaccgttgggggctactacccagggatcattctcggctttggatctttcttaggaattattggcatcaacttggtggagaatagaaggcaaatgctggtggcagcgatcgtgtttatcagttttggcgtggtggccgccttctgctgcgccatcgtggacggcgtatttgcagcacagcacattgaaccgaggcccct

SEQ ID NO: 10638 - DNA, 381 bp, Homo sapiens
ggcacgagataaagttgctaggaaataactaaaattggggaaataatctaataatagcaagatgttaagcatactattattgtattttgggggttggtaataacattcacatggatttatcaatacacactgagaagcaaagcctctcaagctgtcccatatcctccatttcaaaggcacacatacattttaggtaactcataatttagaaaggttatttaatcttttccacatgtaaatatttgaatatgtacaaagacttgatttgactcttgtctgtttttgttttgttttgtttgtttgagacagaggctccgtcgcccaggctggagtaaaatggcatggtctcagctcactgcaagttccgcctcccgggttcac

SEQ ID NO: 10639 - DNA, 382 bp, Homo sapiens
ggcacgagcctatctccaactttatgggcttttgtttttagctataccatagctgtctcaaattaaacttgttaaactgaatgcatcattttcattactaccaccatcctctaattctctgcccctctaaaagctgtctcttcctgctgtattttctgactttgtgaatggcacgactgtctagcaatttaggtcaaaaccatgactaatattagatactttcctctccatcaaatctttttcaatcccgttaccctactgctactgactaggcctggataatgtcaatgcttatatgataaaggctggataccttaacctggatttcaagcttgtgggcaagaacaaatgaaactatgaaaaaatgggctgtataaagggt

SEQ ID NO: 10640 - DNA, 383 bp, Homo sapiens
cgcaccagcatatggactccctgccgtggattgatcggaattcagcatgctgcgaaggaaggtagaagtggtaacacgggttttcgaggattatcgtcacgaggagcatgcacacaatgtcaacactgctttttagtgaatgaccatatcttcagcatgtcgtttctggattattacctacaaaatctgatgttaaatagagtagtatttatacttaatatttcatcttgatcataatgaattgtgcatcctttttttcatttaagtattgtactgttgaaaattataccttagttctgtttttagtattagaaaatcaaaattatactagcccctttgtccagacagcaacctcttagatgctgactctatatgtgtaattt

SEQ ID NO: 10641 - DNA, 382 bp, Homo sapiens
ccatcgattcgaattcggcacgagctgtgaagaaggcccagtgcatataaagtacacaaatttctttgaaaaggccccgtcaccgtagtgtgggtattcaagccaaagtgaaagcgtttggaaaaagactgtgtaatgcaactactcagacagaggaattgtggtctagaacttcctctctctttgacatttactccagtgattcagaaacagatacagactgggatatcaagagtgaacagagtgatttgtcttatatggctgtacaggtgaaagaagaaacatgttaaaaactcaacatcaaatgctctgatgtgctatagattttcaaatctttactcacataattatctctttgctattggagaaccttcacttcaag

SEQ ID NO: 10642 - DNA, 382 bp, Homo sapiens
cccatcgattcgaattcggcacgaggagaggaacgggaaggcagaaagggggagtagcagacaaaggccaagtggggatacgcagcctttgggaggcaaggaatcataaaaccatttcacataaaagctgaagaggatctccaaaacctagcccaatcttctccttttatgggtggaaaaagagaacccgagttgacacattgttaccgtgagagccgggcctggaatgcagatagatgcacaaagatagctagaagtgagaggcggaagcgcgatggcccagggctgtgatggcaggaggaggtgaggcgggcaggctggccccaaagagtccttgggtcctcagctccatggggctgtgactgctcctctggggcccttc

SEQ ID NO: 10643 - DNA, 383 bp, Homo sapiens
  misc_feature 382: n = A,T,C or G
ggcacgaggtactcccctgtctcacctggggcaacctcagagccccactaagctgaaggccccctgggggaggggggggaggggtccttatcatctgccctatcttgccccttcctgtggagtgggcagaagggctcccgggatcctcagagctcccaggtctgagcagccaaaggcccagctgggcctccaggaccagcgcgagcccctgccccaccctcccctgccacatgtgccctgctttgtgacctctgttgaccttcctggaagcagccccattaccctgagaatgcggagcgccctggcccacctcgccctgtgtttccaggcctgcacgtctggtccttcagctgcacatggaactgcagggcaggctggcggng

SEQ ID NO: 10644 - DNA, 381 bp, Homo sapiens
cgttgctgtcgcaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcct

SEQ ID NO: 10645 - DNA, 383 bp, Homo sapiens
tcgattcgaactcggcacgagaagcaatggggaattcattactttatagaggcatacaagtgccagaccgtgatagcccaatcattcttgcgagcattccaggcccacaaagaagaaaactgggctctgcctgtcatgtatgcagtagcgcttgaccttcgagtgtttgccaataatgcagatcaacagttggtaaataaaggaaaaagcaaagttggggacatgttgtgaaaaagcagcagagttactgatgagctgtttccgggtctgtgccagcgacacccgtgctggtatagaggactctaagaagaggcgcatgctgcttctggtgaaccagctgtttaatatctacttcaagatcaacaaactccatttatgtaaag

SEQ ID NO: 10646 - DNA, 381 bp, Homo sapiens
  misc_feature 277, 379: n = A,T,C or G
ggcacgaggaggtgatgagcctcaacgagcactccatgcaggcgctgtcctggcgcaagctctacttgagccgcgccaagcttaaagcctccagccggacctcggctctgctctccggcttcgccatggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggngagcaacgtgcacaatctcaactcggtcaaggagtcccccatgagcgcatgcaccgcacatcgagctggcctggccttctcaccgcatcgcacgctgtcttnct

SEQ ID NO: 10647 - DNA, 382 bp, Homo sapiens
  misc_feature 382: n = A,T,C or G
cgttgctgtcgacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtn

SEQ ID NO: 10648 - DNA, 374 bp, Homo sapiens
  misc_feature 22, 25, 27, 28: n = A,T,C or G
tacggctgcgagaagactacanaangnnaaaaattcatttcatggacatcttgttgccaggagatcagtgtgattcacttttcatttcaggatgatgttgagtcctctgtgttattcccagtgtggacgtggagtagtgactgatgtctaattatttggaagggagagagcttctctaagaaggacatgcaatgtcagaagcttccgttgcttggcaacacgtaactttacctatgtttcaccaaaggcagtttaaagggctaaagatgcccattcaggcaatagtagattacaaggaagatctcgaaagctggcccgtcaaaatcgctttccaccatagaaataaacacctaagagagggtttgggacgtgag

SEQ ID NO: 10649 - DNA, 376 bp, Homo sapiens
actacagctgcgagaggacgacagaagggcagagcatcctttgtaaactcagacttctctcaggaaagcctttcttattataactgatattccttgggctgaaactcacacctgttcctccacttctgatgcagagacaaagaggattcttgaccccaaaggacctcctagatcattgcttcaacctttccattttacagatgagacaactgaggactataccaaatgtggggagaaatggtgccaaaacccacttcccctacttgctaatcagtgcgttttctgttgctctagtagtacctttctttctcacataccaacatacgcgagtcggttctacaacagggcctttcacccggtaagccagagtctgttg

SEQ ID NO: 10650 - DNA, 373 bp, Homo sapiens
  misc_feature 373: n = A,T,C or G
cgttgctgtcggtgaagtcccctccctttggcgtgagccgagctagcaacttgcttctaaccagtaggatgcatccaagttgatgctgtgccttcctcccgtgattacattatgtgggcttagaacttcttccttgacaacagatggtctcccctgctggctgtggtggagcaggctgccatatagagaggccatgtggcaaggaactgagggtggcctcccccggcagccagcatgcagttgaagcctcagtcccatggccacaagtaactggatgctacaacaagcagatgaccctggaggacccctcccccagatgaccctggaggacccctccccagtctagccttgagatgacaccccagcctgggcn

SEQ ID NO: 10651 - DNA, 373 bp, Homo sapiens
  misc_feature 301, 348: n = A,T,C or G
ccatcgattcgaattcggcacgagctggacttctgggttaagagacttaggttttggaaaggctggtgcaatcagatcagaaaatgactacacttaaaaacaaacaaaaaatatagcttgcaaaggagtaagcaaggctgtgctgtggagatcaaagtcagccaatggtaaaactctaaatgacaaagccactgaactcccagggctttccttggttacaaaattgtcaatggaaagtgatttgtaattgtgcacaatcaagagtgtttttctctttaaagtccttccttaggagaagcangttgtgtgtgtgtgtgtgtgtgtgtcaaggtatgtgtgtgtgtcggngtgtgtgtggtgtggtgtacatgtg

SEQ ID NO: 10652 - DNA, 376 bp, Homo sapiens
tacggctgcgagaatgacgacagaaggggtctttaaatgggggctgatttcaagtaacctaaaagactgtgttatcagaggaagaggtcccaaatttggagtaaagatgggagaaaataaatatgtgctatttccttggcgagttgggggaatttgccaccttacagagtttgtatcactgaattagctgcttttgttttttttttttttttttttttgcccggcctttgggggggggggtgttttgcaacctggttttcaataaggggataaatttttttaacaatgaaagggcccgaaaaggggaaatttttatggggtggggaatgccaaaaaaacaaaatgggggggaaaaaaatatttgggtacaaagggg

SEQ ID NO: 10653 - DNA, 376 bp, Homo sapiens
  misc_feature 350: n = A,T,C or G
tacgtttgcgagaagacgacagaagggagggcttgcacgataccctcagatgtttctgttctaacctacctgggctttaggctgagtacataagcaagtgagggttttctaacgatagaagatatgtctctgccacttggaagtcccaggcttagtgagaagcatctaccatagaggacaggaggaacacatttcccactgtgccccgggaggaagtgtcgcctcagcagcacacagtggctacagagctgcacacctggataaacccaggataagacaacgtttgccagacaaattctgtcgctggctctcccaccccgtctaagaatgtgtcctgttacattacgaanagcaacacatcacaactgagattctg

SEQ ID NO: 10654 - DNA, 373 bp, Homo sapiens
  misc_feature 321, 373: n = A,T,C or G
cccatcgattcgaattcggcacgaggcaggactgggtcacatcattggacctataaaagaagatcacgtccggtattcccaaggactccaggtggaaaagttcagctggggaggtgattccatccagagtcatatctgttgtcaccccaataagtcgatcagcaaggctgacaggctgtgaggaaaccccggccttgtagcctgtcacctctggggggatgatgactgcctggcagacgtaggctgtgatagatttggagaaccctgactcaccctcaggaatccggaggtcagtgacattgtcggtgcacacagacattntcctaccctggtttccacagagactgagggtaaagtgatggaagtatttcan

SEQ ID NO: 10655 - DNA, 373 bp, Homo sapiens
tactgctgcgagaagacgacagatgggatttcccccttgggccaccggctttagggtgccccaaaacccccactctgccccacagggctgccaaagccagcctccttgacaacatctggctgacggggaggggagggcagtaagagccgccacagaaaacaggaattcatggggggagtggggttgaggattaacgttgagtttcaagacatccctcgctccagcccactctgtgagctgtctgtggctccgcctacacacagctcctcaccctgaagctgctgggttcccctgcatcacacgcccaccttccccagtgaacccagccaccagatttgacacaggatccggtgactgctcaggcctcaggagg

SEQ ID NO: 10656 - DNA, 374 bp, Homo sapiens
  misc_feature 374: n = A,T,C or G
ggcacgagggcaggagcaggacaggacggtcgttcgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtn

SEQ ID NO: 10657 - DNA, 377 bp, Homo sapiens
ggcacgaggcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgg

SEQ ID NO: 10658 - DNA, 373 bp, Homo sapiens
  misc_feature 348, 373: n = A,T,C or G
cccatcgattcgaattcggcacgagcacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggnctcagaggatggtcatcactgctcn

SEQ ID NO: 10659 - DNA, 368 bp, Homo sapiens
ggcacgagagtagagacggggtttcgcagtgttagccaggaaggtctcaatctcctgacctcctgatccgcccgcctcggcctcccaaagtgctgggattacaggcgtgagccaccgcgcccagttgtgcatttctggtttctaagaatcaaaccacttggctgtttttaggagttacttcccatgttataaagctgaggaagctttttttttttttttttgaaaaaaagtttttgccccccgggggggggggcgggggggaattttaacttccggggttaaagaaattttcctgcctaaccctttggagaacaaaaaataaagggggggccccaacccggggggtttatttttttggttttttaaga

SEQ ID NO: 10660 - DNA, 370 bp, Homo sapiens
  misc_feature 21, 22, 23, 24, 93: n = A,T,C or G
tacggctgcgagaagacgacnnnngggacttcttcacaagccacttataccctttggcattgttttctttgagcacatggcttcttttgcagnttttccccctttgattcagaagcagagggttcatggtcttcaaacatgaaaatagagatctcctctgcagtgtagagaccagagctgggcagtgcagggcatggagacctgcaagacacatggccttgaggcctttgcacagacccacctaagataaggatggagtgatgttttaatgagactgttcagctttgtggaaagtttgagctaaggtcattttttttttttctcactgaaagggtgtgaaggcctaaagactttccttatgtaaaattgt

SEQ ID NO: 10661 - DNA, 371 bp, Homo sapiens
  misc_feature 21, 24, 27, 186: n = A,T,C or G
tacggctgcgagaagacgacnganggncaagatcaagatttttttcctaaagagccatttggcttattttagcttcaagccaagccagggcatctgagaaataccaagcctccgttgtgatgtgtcgccatgaaaatgttggctgccctctggatgcaagtctgcttgtgctgtgctgtggctcanagttaaatttagataaaaatcagttaggagctaaaaatattcccagctttcctgacaggttgtatccatcatcatgggaggaaaaacaaggaactggctgcctggcgacagggagcgggccaggctgagtgtgaggtcaggcctcggctggaatctcacggacttgaaaggacagagacgtttcc

SEQ ID NO: 10662 - DNA, 368 bp, Homo sapiens
  misc_feature 325: n = A,T,C or G
ggcacgaggccagtgtggctggggtggagtgaacaaaagagggtgagaggaggtgagtgcagagatgatggggcaggttcacataggcccttgtgggccatggctgagagccttggcttctacctggagtgaggtgcagcaggcagacccctctgagggaaagagggctccaaagtgacaggtgttcatgggtccctgtggctgcatgttggaggaggacggggacagcaggtaagaggctgctgccgtagtgctggtggcagaagaagaaggatggaccaagatgagggcccagggtagcggtggggagagtgagatcctgganatcttttggagatggagctactggactgtgcatacaaagatga

SEQ ID NO: 10663 - DNA, 363 bp, Homo sapiens
ggcacgaggagcatatgaaaccaaaattatatggaacattttctgtgggtacatgtacatgcatttttctagggagagagtccgtaagtttatcagaatatttaggaaaactgtgacccaaagaagtttaagaatcacatacagtgctgctggctttttgtgcttggcaaatgagtgacaatagaagaaataatttttcttacacattttaaaacgttttctcttccttgtgattgaagatgaaaggagtaagaaattaacgcatttgtttaatttatactggtaacttatttacgggggaggggacatgaaggtaggtaaataggtacgcctctaattgacccactctctaggtatgtacgc

SEQ ID NO: 10664 - DNA, 362 bp, Homo sapiens
tacggctggaagacgacagaagggaccattcttttactctgagttcttccattgtgatcatctagtcagatgggtagatccttataaggctgagcataataagcttcctgatagctctacactggtatgttttggggttcatggctgagctacttttgtgttttatttatcttcctgatctctttttcactgtaagaaacatccagcacccagggaaatttgctgtctaattcatactccactcttcagactagtcctagtgttcagttttgttttgttttttttctgtgtctggaattctattaaaatgtgtcaggctgttttaatttttgttggttaattttctttcacatgattatatg

SEQ ID NO: 10665 - DNA, 367 bp, Homo sapiens
  misc_feature 18, 20, 21: n = A,T,C or G
tacggctgcgagaagacnannaaagggggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacgagtccattcaaatgacaaatcagacattttccacagtagaaaatctgaaaccaaacacgagttatgaattccaggtgaaac

SEQ ID NO: 10666 - DNA, 361 bp, Homo sapiens
tacggctgcgagaagacgacagaggggcagtttgaaaaaggacctggttgccaaagtaccatattacccatcaatgtcctctcctacccatttccctttttcacaccctctaaatctctataagcaaatgcggaaaatgcaaactaagctttgaacagaatcaaatgagtccctctgggacacttgcaggggacttatttcttccgaaggatgtgacagcagcttctcccaatagtggcagcgtttgtttcactgttagactggaggagcacaaggagcatacaacatgtggctctgtccacaccactgtgaagttgttggttctgagaaattactggggggagtgttaaaacaagattgg

SEQ ID NO: 10667 - DNA, 351 bp, Homo sapiens
tacggttgcgataagacgacagaagggggaatttaggtagaatcaaggctcataacctttatgaaaataccctaagcagggaacctttaatttattttgaagtgtttgagttttactaaaagcccatcattgccagtgtggttttttaaaatggacagccatagtggctaaggagaccagtaagacctggagttggcagcagagtgagccttctgaggaaaaaaggaagaggaatattggtgtgggaaagaggtgcagctgtgccactggatccctgtcccttcattattctttactggccctggcagctgtcaaagtttgcttaatagagttgtgggctggagattgttt

SEQ ID NO: 10668 - DNA, 351 bp, Homo sapiens
tacggctgcgagaagacgacagaagggcgggaggtgtaggttgcagtgagccaagattgcgccactgtactccagcctgggccacagagtgagactctctccccaccactcccccacccaaaaatgcagaaggataaagagatcaagagagaagacaacagaaaacaagtaaattcgtcaaaaattcagaggctggaacacaatatatgagatgagtgctaaaccagcataattggagaaagctgaaacctgaggctggtggtgatgggctcagttcttagaggtactgtatacttctgaggtacagggtaaatggaaagctgaaaaaaggaaaattgattgaaagtccaa

SEQ ID NO: 10669 - DNA, 350 bp, Homo sapiens
  misc_feature 6, 8: n = A,T,C or G
taaaantncgagaagacgacagaaggggtactcagataggtaaagaacaagtccagtggtgctgacagcaatggaatttaaaacttgattctaataatctctgagtcccgaaggaatgccacgcagacatccgtttgagtcacgagcttgtaactgaggatttgacaaagattgagtcctcactgtgtgccaggcaccatgctaaattttgtgctaggcacttgggatactctttcagacaagactttgtccctgctcacagagaaatctgataggttggcctatagtcactcttttctaaacttgacctatctacctgaattaaccgaaggagctggttagaaatacag

SEQ ID NO: 10670 - DNA, 349 bp, Homo sapiens
tacggctgcgagaagacgacaagaagggccaaggtggggccaggctctgagagaatcttcattagagaacggcgctcctggagacgctggacatagcttcggagctggaaagccacttcctgtggggtgggcttatccacactgctgccttcagggctatagaaaacagaaaaggtgcctatgtcaacactggcaggcataggtgggttaagttcatgccaatcctggtagggtccatcaccttccatctcactggccacgatggaatctatgccatctttggtggtccctgtcacaccaacataccccactaggcaccaccttccatcaagaccacatggtggccagg

SEQ ID NO: 10671 - DNA, 634 bp, Homo sapiens
tactgttgcgataagacgacagaaggggctcggctcactgcaacctccgcctcccgggttcaagtgattctcctgcctcagcctcctgagtagctgggattacaggcattcaccaccacgcccggctaattttgtctttttagtagagatggggtttcaccatgttggccagcctggtcttgaagtcgtgacctcaagtgatccacctgccttggcctggaagcacgtacattattgcgaagttttgacaaagtctcaaaagtcttttttattttgtttttgagatggagtttcgctcttgccacccaggcaggagtgcaatggcgtgatcttggctcactgcaacctctgcctcctaggttcaagcaattctcctgcctcaccctcccaagtaactgggattacaagcgcccccccccagccccgcttaattttgtatttttagtggaaactgggtttacggccgggggcgggtatgatatatgacaccatgcctctgtcaattgctcgccaaagcataccaagtggcgtgatttggccggcgccaaaaaaccatgcgcgaactcatgaaacacggtagataatcagtgtaactactagcacactagactttccgctgcgtggttgcacgcca

SEQ ID NO: 10672 - DNA, 605 bp, Homo sapiens
tacggttgcgagaagacgacagaagggattctattttagaaaaaattatctatctatctatctatctatctatctatctatctatctatctaatatatatttaacctaaatagtacatactttcccccaacctttctgtatctccagagcaatagaagagatgtagtggaatcgaccagttgcctagcaacctgaaattagtgagacatcccccctttcactgatttgattttaaatcatgcttttctttcttttttttttttgaaacaaagtctcgttttgttgcccaggctggagtgcaagggcccaatctcggttaactgaaagctccgcctcccgggttcacgccattttcctgcctaagcctcctgagaagctggaactacaggcgcccgccacccgcccggtaaatttttgtattttagaaagagggggtcaaccggtaaccaggatggctaatctcctgacctaggatttgccgctcacctcccaagtgctggatacaggcggagcccagggctgcctaaatattgtttttagggcactataaataatgacaaatgtaaagctcgatgcagctggacaatggatcaggacagctcaat

SEQ ID NO: 10673 - DNA, 224 bp, Homo sapiens
  misc_feature 27: n = A,T,C or G
ggcacgatggcggacgcaggaggcctnctggaggacacagcagcatgggacaggcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagc

SEQ ID NO: 10674 - DNA, 491 bp, Homo sapiens
  misc_feature 41, 49, 50: n = A,T,C or G
agtttaaaccttgaaacagcccctgatatctctgcaaaacnccaccganncgaattcggcacgaggaggcttacagccctgcaggcccatctgggcagcatagccccctttcttgttctgggtgagtcccttccgggggcgacgacacgacaggaccaggtggagcagttcctggcccggcacaaggggccaggcctgcagcacgtggggctgtatacgcctaacattgtggaggccactgagggggtggcaactgctggaggccagttcctggctccccctggggcatactaccagcagccaggaaaggagaggcagatccgagctgcagggcacgagcctcatctgcttgctcgacaggggatcctgctagatggtgataaaggcaaagttctgcttcaggtcttcaccaaagccctttttactgaggacactttcttcctggagctgattcagaggcagggggccacttgctttggtcagggccacat

SEQ ID NO: 10675 - DNA, 458 bp, Homo sapiens
  misc_feature 458: n = A,T,C or G
cttttggccgaagcggcctacggctgcgagaagactacagaagggatatttgtattacacgttaatgccttggagttagctaggccagtgaagtgatggtggaggcgatattccagctaagaggaccaacatgtgtgaaagccacagagacatgaaacaatatggcacagaaggataacttgactaatttggctacagtgtacagtacatgtgtggagctgcaagagggggaagtaggctaaggccatggcggctcctgtatgctgtgctaagaagttttaataccggcttgaggccatgatagcacaaaggtgtgataatctacctacccagagagatcaaagttagctttccacagaagttaacgttgaacagtaagtataggttgggccagcggatgacagtggaggagtacaccaagaagaacaacggaggtatatataaacagcacgttatgn

SEQ ID NO: 10676 - DNA, 459 bp, Homo sapiens
  misc_feature 459: n = A,T,C or G
ggcacgagcagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacagcagtgctcctgaattcagaccacagattcacaagcacagtccagatatgtagcgcttn

SEQ ID NO: 10677 - DNA, 439 bp, Homo sapiens
ggcactgaggcccagcgaagagcaacaaccccaagactgtgaaagactaacatccattctgaaataggagataacaaggctgccatggatctgaacaccaccttccttgagaacagccaggagcccacttggattcaagagtgactttgaacttgttttcacacctccaacagactctcattaagattcagttatttccgctgcccagccccacactcctttcagattatcgttcatgggcgtaagtctcttctcagagttaacaagcctttgggagtcatcctctggccaaatattggatattattaaaaggcatttttaataattaccagaattagctcaaacctttagggatctttcagccatgagtattaaggatatggatgtgagttttgggaaacctctcgtgctggatgccagctacagcaggtccatggtg

SEQ ID NO: 10678 - DNA, 441 bp, Homo sapiens
atacgcacgactccgctcgatttgcaagatcccatcgaggcaaattcggcacgagggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcacagcatggtattagtgaaaaaggttcaaaaatacacatgtaacatacactctgagag

SEQ ID NO: 10679 - DNA, 444 bp, Homo sapiens
  misc_feature 267, 401: n = A,T,C or G
ggcacgagctgtttccttcggctttcctcctcctgctccaccatgtggagccgacggcagggccgcctcaggcccacggtctgcggggtggaggagctacggcgccgccggcgggagcgggagcactgcggaaggcgcggagggagcagcagctggtcagcaagaggctgctgagaaacgacgccccaaaagaagctggagagggatgtgtggctgcgatcctcggggaaaccgaggtgcagcagttcctgcggcaagcccagcggnggacagaggaaaaggagagagagggggctctggtcagccttcgtcgaggcttgcagcaccctgaaacacagcaaaccttcatccggcttgagggcagcatgcggaccctgggtcggctcctgaccagcaaccangccctgctgcagcttgaggcggctcggtgcctgcatgagctct

SEQ ID NO: 10680 - DNA, 432 bp, Homo sapiens
ggcacgaggcgcgctgcacaatggcggctctgaagagttggctgtcgcgcagcgtaacttcattcttcaggtacagacagtgtttgtgagttcctgtcgagagtaactttataaaactgtgtttctcacagttgataatatcatagcataagactgtgacgattggctgtggagtatccctgtgagcagttcctattgcacagaaatcagagcctgattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcacaggaggaagatgaagtgtggcaggtgatcatag

SEQ ID NO: 10681 - DNA, 429 bp, Homo sapiens
ggcacgaggtgagggtgtatgagattcttcagggagaggttcaaagggtgctggtggccatgtcgtaagtgctgagaatgcctggctgccgttggcaccatcatcaactggggtcaggcaggggtggcaggaaggcctgggggcctttccttggggaagggcacgcatcccctgtcataaaacctcccatggctcccaagagtacatggaataaaatcctcaactccaacaaagctttcctggactctctggggctccctgcagcctccctctcagatgaattcactgcctcccgcgcccctcctactggttccaaactctaccattcaaaaaatgcgtacgagggctggggggcgacgtgccacgtgccagccctatgcaagggccaggagtcctgtggccgcagcagttctagggacgggacacgcg

SEQ ID NO: 10682 - DNA, 426 bp, Homo sapiens
ggcacgaggagagaactagtctcgagactagttctctcctagtctcgagagcagttttttttttttttttttttttaaaggggccccccccccgagaaaagggcgcgccccttaagggagggccccccccccttttcccccttaaaaaaaaccccaaaatttggatttaaccgggggggcccccggcccatggggggaaaagccccccccccccacaaaaggggccccccattttttaaacccaaaagacccccccctttttaaattggccggggaacaaagggggggaaactaaaacccccgggaaaagggggggctttggaccgaaatcccaaaaagacccccccggggggggggggggcgagggcccaattggggggggggcctccggaaaatgggcccctggggggggggccccccccgggc

SEQ ID NO: 10683 - DNA, 402 bp, Homo sapiens
  misc_feature 163, 169, 170, 240: n = A,T,C or G
cgttgctgtcgcagagatgcagccagtgtctgggctcccccagtggtgaaatgatctggaagctagatgctagtaacaggtagtgattgggttttttgagtatttttccggggaatgtggtacccctgactgtaagtggtgggggaggtgtgggatgttttgnaactgnntctgggattattttaaaattatatatatatatataaagaaaaattcttacatttttattttgccctctgngctttgagagcactggatatattgatcggatttgctttcttctcttctcacaaattggaagctttttttaaaaatgttttccacacaagtcatcttgccttgtggcatgtatgtctagcctcttcctccctccctcatgatgaagtgccatttctgttacat

SEQ ID NO: 10684 - DNA, 405 bp, Homo sapiens
ggcacgagctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaaatccttacagagaattgtttcacaaaacttatatttcatgtcaattgtatttattttaataatagctcacaatgcctttagtaagtaataaagtctcttattagaatcttgtattttttaattgagctaatcaaaataattcagccaagtctatttgaaatagaaaactgtctatttaatatagtaaaatcaatgctcccttaatgttgttacaaagatatggtaactgtaatatgggtaaaagtt

SEQ ID NO: 10685 - DNA, 410 bp, Homo sapiens
  misc_feature 410: n = A,T,C or G
aatgatgtaaaataagacttatcttccttccccatggtccttcattatttaaaaatagccattatgtcattcctaaacattctgttttccacctttaaaagctcctagttcctccatgtgtttacactaatgatgtttttcttgtaagcatctcaaagagtcttccaaacatattatatctttgtgacagatgaagaaattggagtacagagatgtggagtaacttttgagatgttgaagagcatgtcagggttcggttttagagtgttaggtctacatatactgtttccagattgttctttgccctggtcacggtgctctgcctatggtcccatttggacacacctctattaatgcagcaaccagaatgaaacacgttgttcacaggcttttctaaccatccgaagagn

SEQ ID NO: 10686 - DNA, 407 bp, Homo sapiens
ggcacgaggagagaactagtctcgagactagttctctcgagagagagagtgagagaactgctctcgagagcagttttttttttttttttttgaaaaaagggttttttttttggcccggtaaaaaggttttccttaaaaccttataatccggtttggaaaggctgaaaaaccggccggaaaaaggggggggggaaccttttttggatggacctttagggaggttgggggaataaacccccggcaaggggtttaaacctttagggacctttttccgggtttaatttttataaaaccaaaacaattccccaaatacctctcaatcctaaaaaaatttctagttaaaaacctgggacttaatcccggcggccagcatgggaacagcctttaagggttataaaaggggatct

SEQ ID NO: 10687 - DNA, 410 bp, Homo sapiens
ggcacgaggagagagagagagagagagagagagagagagagagagagagagagagagagagagagagagagagagagagagagagagagagagagagagagagagagagagagagagagagagagagagagagagagagagagagagagagagagagagagagagagagagagacactcacctctctctctctctcctctctctgcgctctctttttttctctctctcttgcgtctctccttttttttatatatactctctcacatatatatctctctttctctctatatacactctctctctctctttttttttgcgcacactctcttttgtgagagactctctcacgcgccgccagagtgtggctctctctctactctctctctctctctcgcgcagtgcacatctct

SEQ ID NO: 10688 - DNA, 411 bp, Homo sapiens
ggcacgagctctctctctctctctctctctctctctctctctctctctctgtctctcgcacgctcacactcacacacacacacacacacacacacacgaaaagaaaaacaaagaaaagagagggagagagagagagagagatacagagagagagagagagagagagagagagagagagagagagtgaaaggccaaagagggagatcaatctataaatatacacggacacgaagagggaaaaaaagagacgcagagagagagacagtctgagagtgagagtgggagggagagacaaaaaaagagagagagcgtgcgcgggggtgtgtgcgtgggcccttgaaaaagagagatactgacgggcaaacacacaaacatagatgaagacatagagggggagggatataggtctgg

SEQ ID NO: 10689 - DNA, 413 bp, Homo sapiens
  misc_feature 413: n = A,T,C or G
ggcacgagatttatgcctgtaaagttggaaaaaacattgtattttacaaccattgccacattggtgtctttaccttcaaaagtagtttttaaaatagtaatatcttggcggaagtcaatatctgatttttctgtggttcttataaattatgtaacatggttatcatcaattattttccttcctttctctcagtttatttccagagtcctaaaaatgccatattttccctccaaaaagttgctacagcctttgttttaaaatctttcctctagtttttgtttgttggttggtggtttgctaaacagtagaaaaacatgtaaggtcagaagtataattcaggatctaggttctttagcctggttatcctattggccttcaagtattagaaagctttaataaccagtttttatttn

SEQ ID NO: 10690 - DNA, 414 bp, Homo sapiens
tcccatcgattcgaattcggcacgagggaaaacccaagaggaaaagcaagtacaagatcctggatgccacggatcaggaaagcctggagctgaagccaacctcccgagcaggcatcaaacagaaaggccttttgctaagtagcagcctgatgcactccgtcaaaaaaaaaaaaaaaaaaaaaaaggggttttgggcccccctttaaaaagggagccccatttctttttccaattcggcccaaaaaaaggggggaataaatggttaagggaagggggggggccttttttgtttgcagggcctttggaaaaaaaaccagggtggaaaaaagggcttcttttttttaatttaaacggaacctggtgttttggggttaaagccaccgttcctttgcccaaaaagaaaaacccccaaag

SEQ ID NO: 10691 - DNA, 408 bp, Homo sapiens
atcccatcgattcgaattcggcacgaggtggggagtgcaggtggtttcggttgcggcagtcgcgtcccgggagcgtcgctgcctggtgaacggcgaaggagggctcgacgtcgcgggagtcctttcaacctgaccgcggcttacggtcttcggagctaatgttcattggtcccacaaaggggtcccacgtcgcgtccaggacatagaggccgtgaggcagggagccagaggtcgtctggactcttccgtactagtcagttttcgaactagagggggctttgggatcaccagtcggagcccttcgtgttacagtagtgactgaagatagacccacatatgaagattcagctgccctctgacttccagccattaccatcaccaaccaccgccatttcctggatacctact

SEQ ID NO: 10692 - DNA, 415 bp, Homo sapiens
ggcacgaggagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggagaccaaccagggtcaaggagggccagggaattgggttctggattctcaagaccttgtagactccaaagagatgg

SEQ ID NO: 10693 - DNA, 406 bp, Homo sapiens
ggcacgaggcagccttctaggtcagttggtaaatggggtagaacaagatgccccaaagtggcataaattgcatggaattaggccttagtggtgagggattcgacatacagtcatttgtcctacattgtgaaggaaacattctgacctcaaacagatccctcaaccccagaactttatagaaggggcagaccttggcattttcacatgatttatctcccactctgattcacatatgtttgaccaaggcactgggcagctgccaatttcccgtcccttctgtagtcccagatgaatggatacagacctcttttgggaaggctgcaagggagggtcacaacatgcatctaaagtgtaaaaattaaagttttcctttcaaaatacatttgacttcctcttcatgtaaggg

SEQ ID NO: 10694 - DNA, 402 bp, Homo sapiens
ggcacgaggagagagagagagagagagtgttgtagtgagagagagagagagagagagagagagagagagagagagagagagagagagagagagagagagtgagagagagagagagacagagagagagagagagagagagagagagagagagagagagagagagagagagagagtgttttttttttttctctcacacacccttttttctctctctgtgtgtgtttttttttgtcagactcttttttcttccctcccccgcccgcgagattcttttttttagcactctctctctcttccctctttttgtgtcccacatattttttctcgcgcgcttccccccccttgtgcgtgtgtttttttctctcacgcgcgcgtgttttttattttgtctctctctccccg

SEQ ID NO: 10695 - DNA, 407 bp, Homo sapiens
tcgattcgaattcggcacgagaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtata

SEQ ID NO: 10696 - DNA, 405 bp, Homo sapiens
attcggcacgagaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcatatg

SEQ ID NO: 10697 - DNA, 393 bp, Homo sapiens
ggcaccagagccaccacacctggctaggtttacatttttagaatatcccttggaaagtggttggagagtagcaaaagtgtgttgtttggtaaaatatctctggaaggaaacttcagacaatagtaacagcagtcttcttggcaggcaacctgggagacagggataaatgggagactccctgtttataacatacccctttgtactttctaagttttatactatgtacatgtattcattgactgaataaatagctttataaagtcgtttttataaaagagaaggttgggaggagctatcaggtagcaactgcagatgtctaaggaagaggtcatggtggtcatttggactgggtgctggtggtggagtcaaagtggaccaagtcaagagactttt

SEQ ID NO: 10698 - DNA, 387 bp, Homo sapiens
  misc_feature 352, 383: n = A,T,C or G
agatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttggtaatgtctctcacattgacacagtataaaaattatatgcaccaagatgtccaagtgacatacttttagagccaattatanacactttaaagttggggaaagattgcaactntttt

SEQ ID NO: 10699 - DNA, 386 bp, Homo sapiens
  misc_feature 386: n = A,T,C or G
ggcacgagccatcccttatagaagaggtcattcctgctcttccttctccatggctagaggatctacatgaactatttagattttttctacctgggagatttaactcctctctcctatttatttatttatatatcagcatggacttgcaggccaacagagattttgagaaacacattgaaggatctgttaacacttgatatacccaataaaagcagtggttgtgccagtgctgatctgtcttgatgtgaatgtgaacaatgggaacctgagctgagcagttaaatgtagggtgacagaaactggacctcttccaaaacatgtgacagagtaataccagagccaacttcttcgccaaattaaagtttacaagaattaacctgtcatcn

SEQ ID NO: 10700 - DNA, 392 bp, Homo sapiens
  misc_feature 355, 392: n = A,T,C or G
attcggcacgaggaaaatcagaagccctattgtatctggtatttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactggtaaagttcaggctggatttcncaatgtccagacattcaagtcttagcagcacctcagn

SEQ ID NO: 10701 - DNA, 396 bp, Homo sapiens
atcccatcgattcgaattcggcacgagcctactcccagctcccatggagactgagatgggaggatccctggagccctgaagcttgaggctacagtgagccttgattgtgtcactgcactccagcttgggtgacagagaccctgtctcgagaaattaaaaaaaaacaaaaacctttttttcttactaaaaacccccggaaaactaaaatccaggcccttcttactttcacacataacccaaaagtgcccctttgtttttttttgaaacttttttaaaatttttaactggcgataaaaaccacataaagtatcccttcttattattggctaacggaaaaatctgacggggtcccttcgctttcgccttctatagcttaaaacggaattatgaacacac

SEQ ID NO: 10702 - DNA, 397 bp, Homo sapiens
ggcacgaggaggaactagtctcgagagcagttttttttaatgaaaattttattgagatgaatatagattcacatgtagttctaaaaaagtaattcagagataattcaaataattctgtataccttaccctgtttctcctaaaagtaagattttgtaaaactatagtataacaaccaggacattgactttgatataatccaccaatcatatacagactccaaatccaccaatcatattcagacttcctagtttcactgtattaatgaatatttgtatgatgtattctatataatttataattctatagtggaatcacctaggtaagtttatgtatcctataagatattgaacagtttcaacaccacaagatctctcgtgttgcccttttataatcaca

SEQ ID NO: 10703 - DNA, 400 bp, Homo sapiens
ggcacgagctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattact

SEQ ID NO: 10704 - DNA, 397 bp, Homo sapiens
ggcacgagaaatgatgattcttataggggggtgtgtgtgtgtctgtgtgtgcatgcacgtgtgtgtgtgtgtgtgtgtgtgtgtgtttgtgtgtgtgagagagagagagagacagagactgaattgcttgagaaaatttgcatttgagttcagaagtatgagcccacatctgtgaaagcagtaggtaagagactagtgaatgcagatgactcatatatgcacacacacctgtggatttacggttttagaaaatacaaatatacattgcgctaaatttgaataatttgaagtgaggtacaattccaaagagcaagttgtgatctaggacaaaggaacctctgggatgagtgacagctcggagagccagaggtggaaggaggaatgacacacagcttct

SEQ ID NO: 10705 - DNA, 395 bp, Homo sapiens
  misc_feature 15, 16, 17: n = A,T,C or G
aatcccgtggtggcnnncccactgcccccccactccccaccccttcacaagccattggattcattcatccagttcaataaatcttggctaagcacctccagtgtgcagtaaggctcttccaagccaggactctgactccctctttcctacctcaagagatgtttttgagggctttcccaggtaagagtcacatctcttatacaataacttatagtgagatacccagaatgtcagacttgtaagggaagactgcccaaaccccttctgaggtcctcagaggggaattaacttcctaaggtccgactgctaggaagtgttggagccagaaatggaacctaagtttcctttctatgtcatctctggagtcttgatcttgatctatcccattgtagata

SEQ ID NO: 10706 - DNA, 393 bp, Homo sapiens
catcgattcgaattcggcacgagccatcccctaagaagagggcattcctgctcttccttctccatggctagaggatctacatgaactatttagattttttctacctgggagatttaactcctctctcctatttatttatttatatatcagcatggacttgcaggccaacagagattttgagaaacacattgaaggatctgttaacacttgatatacccaataaaagcagtggttgtgccagtgctgatctgtcttgatgtgaatgtgaacaatgggaacctgagctgagcagttaatgttagggtgacagaaactggacctctcccaagacatgtgacagagtaatacagcagccaacttcttcgccaaattaaagttttacaagatttaacc

SEQ ID NO: 10707 - DNA, 394 bp, Homo sapiens
cgaattcggcacgaggagagagagagagagagagagagagagagagagagagagagagagagagagagagagagagagagagagagagagagagagagagagagagagagagagagagagagagagagagagagagagagagagagagagagagagagagagagagcccccccctctctttatatatacaccccccctctgagtgagcgttctctctctctcttgtccccccccccccccttttctctctctctctctgtgtgcgggtgtgtgtcctccctatatctctcccccacactccccctttttttcttttttttttttttttttgtgggggaaaacacactcacactctgtgttgttgtatgttctccacccaagagcggcgcgcgcg

SEQ ID NO: 10708 - DNA, 393 bp, Homo sapiens
  misc_feature 51, 53, 54, 57, 58: n = A,T,C or G
ggcacgagataccatagtcccagctacttgggaggctgaggtgagaggatngnntgnncccaggagacggaggttgcagtgggctgagattgtgccactgtactccagtctgggtgacagagccagaccctgtctcaaaaataaagaggattctgagtttgtatagtgagggcttgcagaaattttgaaacttattttgtaagtttacaatgaatttgtacatgatgtgctcatgtcttgggttgagtatcctagacatgattttttcatttgctgcatattaaacatttgttggttgtagtcggtatttcttaaatagaagtttgtcaatattagattagtttcaagaaggacttagctcaggaaaaggatagttatttctgtggttctcaa

SEQ ID NO: 10709 - DNA, 389 bp, Homo sapiens
cgttgctgtcgtaggtctagatgtttggcatgcccagtggcatattatctgttttaacttagactaaattagaaagttgtctttaatttgctttgttctgggttattcaggacatctggaatttatgaagatgcttcccagtgttgggggatatgttagcatactggtggcagttgaagattaaatgttcttttttgttatttattgtggctgaaataaaaggaatggtggtcgacagagcatcccttgcagcattgctaggaaatgagtcttcaaaggaagcagcttggattctgataaagcacttttgtttcttcctattagaagatgcagataaatagttctttatgatctttggcctgggagtcctgattaaattttaaacatag

SEQ ID NO: 10710 - DNA, 398 bp, Homo sapiens
aattcggcacgagccccaatccatgcttggccattgcctgagtattagctgccccagggggatcacggtccccatatatttgcttgccatggaccctgggcagcagggagagagtagagatttgtcaagagcccatggtggaggctgaggccctgaggccatgagatgcaggcatggggtgagaaacaggccccttggaattgggctgggccttggcccagcttagtcaaatcaaaaggcttctatttggagagctgaagagggtgtacagaggaaggggctaggtctgcaaggagtgcctcatctccctgaagagctctcagtggaacatacttcacccatccatgtacccacatctttccttgcccagaaggcgagagccagctataacagaccct

SEQ ID NO: 10711 - DNA, 157 bp, Homo sapiens
tttctccccaaacccgataaaagggggatttttttttaaacccccccccgggggggccccccccaacttaaaaatggggggtttttttttccttttttgggggcctttaaagattccccccccccacatttttattatggggggggggtttttttta

SEQ ID NO: 10712 - DNA, 394 bp, Homo sapiens
attccgaattcggcacgagcccacttctgtttactttttcctctccagtaaaaagtaaaagatttctttcaattggtgttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacat

SEQ ID NO: 10713 - DNA, 396 bp, Homo sapiens
cgattcgaattcggcacgagcagaggagccccatctccttcagccccctcctgcctttggggtgcaagtttcctgaaggacttgagtgagatgtcaccaagcaacaggctgtcaggctcttggcagcaagtactggcccagcgactcgcggcagagtctctccttggggcgtctgtccttatcaggggtggatgctgtcagacttgctaatggtggaatttctggcatgtggcagggccaagtgcagtggctcacacctataatcccagcactttgggaggctgaggcacgaggattgcttgagcccaggagttcatcaccagcctgggcaatatagccagacccggtctccacaaaaaaatttttaaaaattagctgggcatggtggcctgtgcc

SEQ ID NO: 10714 - DNA, 394 bp, Homo sapiens
gattcgaattcggcacgagcggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcc

SEQ ID NO: 10715 - DNA, 397 bp, Homo sapiens
  misc_feature 375: n = A,T,C or G
tcccatcgattcgaattcggcacgagcagtcctctccttaaaagcttggtctttgtttttcctatagggaaaaaagtcaaaataagttccaaaaactatcctcaaagtagtattgtgcttgtagtaaatgaaggttggatggatggatactgacaatggtggcaggcatttcaagccttttaaattagtactttttgtcgtcttgcttattaaaattttgttaattttagcaaagaccaattgttgtgataaactggtgttttttggatgcttcaagcacacgttaaccaattttttaattccccttttggttcctcccattgttctaaaataggactttcatattattaaaacctcaaaagatgatccacccangatgaacaaagatcaccaaggg

SEQ ID NO: 10716 - DNA, 397 bp, Homo sapiens
  misc_feature 397: n = A,T,C or G
cgaattcggcacgaggagagagagagagagagagagagagagagagagagagagagagagagagagagagagagagagagagagagagagagagagagagagagagagagagagagagagagaggagaatattctcttttctcgccccctgtgagagagagacacccccccccttttttctctctgtctctcgatgcgcgctctctctccacacacacacactcctctgtgcatagagatagagagcgctctctctctgtgtgagtgtgtggacacacatatctccccttctctctgtgtccgcccccgtgtgtgttttttttgagagagagaccccccccgcacacaaaaagaaaagaaagcgtcccctctctcgccccgctcctcgtgtggcacn

SEQ ID NO: 10717 - DNA, 397 bp, Homo sapiens
ggcacgaggtgatttcctagtagtgggtagcattagaaaactggcatcagcctccctcttggacacggacaaaaggtattgcggcaaaaccacctctagaaaagcatggaatgaacaccattgggagcagactctgccaggatcgactgatgaggaaatatctgatgaggaagggtctggagatgaaaattcacagggactggggctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcattgaggaggaggaagactaatag

SEQ ID NO: 10718 - DNA, 397 bp, Homo sapiens
gcacgagcggagctgcttcttaccctgcccctgcacctcatggctctgctgggctgctggcagcccctgagcaaaagctacttcccctacctgatggccgtgctgacttccaagagcaaccggaagatggagagcaagaaacgggagctcttcatccatataaaggggcttacaggagccttcgggaaagaggccctactggagctgggctgagaaaccggagccaactttcagttctacccaccgggctgcagggtcacctgcctacacccagatccccactttgagaagttcctgacaaagagcatggctgacaacaggcacctccaatatgagcggcttgtggtggctcctggagaggacatgatacagctggctgatggctccatggatgtgg

SEQ ID NO: 10719 - DNA, 396 bp, Homo sapiens
  misc_feature 396: n = A,T,C or G
cggcacgaggagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggagaccaaccagggtcaaggagggccagggaattgggttctggattctcaagaccn

SEQ ID NO: 10720 - DNA, 390 bp, Homo sapiens
atcgattcgaattcggcacgaggtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagaccccgcctccatccccgcctctgtcccctggccttggcggctatttttgccacctgccttgggtgcccaggagtcccctactgctgtgggctggggttgggggcacagcagcctcaagcctgagaggctggag

SEQ ID NO: 10721 - DNA, 395 bp, Homo sapiens
ttcgaattcggcacgagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacaggctacagggagaccgggaggatcacagagccagcatgttacaggatcctgacagtgatcaacctctgaaca

SEQ ID NO: 10722 - DNA, 396 bp, Homo sapiens
atcgattcgaattcggcacgagaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaa

SEQ ID NO: 10723 - DNA, 388 bp, Homo sapiens
  misc_feature 388: n = A,T,C or G
ggcacgaggcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggan

SEQ ID NO: 10724 - DNA, 391 bp, Homo sapiens
atcccatcgattcgaattcggcacgagatccaatgccatctgcatcttagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgttgccaagagggtgatcctgttgtcgggcacaccagccatgtcccggcccgcagagctctacacgcagatcatcgcagtcaagccaactttcttcccccagtttcatgccttg

SEQ ID NO: 10725 - DNA, 388 bp, Homo sapiens
  misc_feature 51, 52, 53: n = A,T,C or G
ggcacgagccggccaacagcttgcaagcatgctccgctggacccgagcctnnncgctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaagatcttggcccagcagacaggccgtagggtgctgacggtggatgctcgtaaccacggtgacagcccccacagcccagacatgagctacgagatcatgagccaggacctgcaggaccttctgccccac

SEQ ID NO: 10726 - DNA, 384 bp, Homo sapiens
ggcacgaggagagaactagtctcgagagcagttctctcccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtct

SEQ ID NO: 10727 - DNA, 369 bp, Homo sapiens
  misc_feature 25, 26: n = A,T,C or G
tacggctgcgataagacgacagaannggcttatcctagagaataactctgtatgaataaaattgcttaattgagtctcttactaaataagtaactagtgccatgcttttgtgagctcttggtatggcccatattaccttgttttttgtttttgttattgttgttttgtgatagtcttgctctgtcgcccaggctgcagtacaatggcacaatctcagctcactgcaacctctgcctcctgggttcaagcaattctcctgtctcagcctcctgggtagctgggactacaggtgcatgccaccatgcctggctaacttttgtatttttagtagagacagggtttcaccacgttggtcaggctggtctcgaa

SEQ ID NO: 10728 - DNA, 372 bp, Homo sapiens
ggcacgaggagagagagagagagagagaagagagaggagcaagcaagggaaatgccagatagctataaaactatgagatcccatgagaactcactcagtatgatgaaaacagcatggggaaactgcccccgtgatccaatcacctcccaccaggtcctttcctcaacatatggggattaagaggattgcaattcaggatgagatttgggtggggacacagccaaaccgtatcagcatacctaggttactagctcatatctggagccagcaatggggtttgtcccaccagaatcactcaagcgtagagtgatatggttccccaaaggaaaactaaggtgttatttctagacaaaaagggtttcaatgctggga

SEQ ID NO: 10729 - DNA, 374 bp, Homo sapiens
tacggttgcgagaagacgacagaagggcagaacttggctcctctcacccaccccgcccagtttccactctaaaggacggagctaaaataaacagttatttaaaggttggggcatacagggttccaaagcagatttttagttctatcctcagaagacttgccccatatagaaaatattgtctggagacttctcaatcttatcttaagtaattagaaatcaaatcctaccccatgtgacagcagtttatccttatagtttaaagttcagaataatcatgtcaacttcatgtaacactttgttttgtagctattaagagctatggaagctcatttaagatataacggatttttttttaaagacctacagaaaaagga

SEQ ID NO: 10730 - DNA, 376 bp, Homo sapiens
cgttgctgtcgaagagattaagctccctccactgatattctagcatttatgggtttacttttgtttaccttttggaatcatgagagttttgttctagaacagtttttgttctttcatttgagataatttgaataagaaggatcaaaggattgggaaaggaaaagtaaaatatttggcagaataaaaatgttttttttggtaatgaagcctttagaaaactaaagttaaatgaaaaaactgaagtagaactaaactcttacgtcttaggagaacttagatacatatgtgtcagagtctgactgtatttatattctaaacacacatatgatcacacaacatacatacagagactattttgtataactggtaatagatg

SEQ ID NO: 10731 - DNA, 151 bp, Homo sapiens
  misc_feature 13: n = A,T,C or G
cttatgggtctgnggctgggtgcaggccatcaaaatggacaccacgagacagaagtggggactgcctggccacctagcgccttcccactccttaagcaagcacaaagaagatgaggcagagaattgccagagctgaaagtaactttggttg

SEQ ID NO: 10732 - DNA, 381 bp, Homo sapiens
  misc_feature 381: n = A,T,C or G
ggcacgaggaaaatcagaagccctattgtatctggtatttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactggaaaagttcaggctggatttccaaatgtccagacattcaagtcttagcagcn

SEQ ID NO: 10733 - DNA, 378 bp, Homo sapiens
tactgctgcgagatgacgacagaagggatatttaaaataaaaccaccaggtataatgatttctggcttagtataaaaaagcttttacccagttagtgttatttacacaggtggatgtggctctacaacatttagagaagaagaataaattcagctgtcatatgttgccatgactctgcctctgaagagattatgaaaaaatccaaatttcagcaaaattatatggttgttttcagtacctctgaaggtgctatatcaagaattctcatgctactctttgagaaaacagattgcgtttttacctagaaaatcaactgcaaggcatttttataaccttaccccacgtagaaaaaatacattgaaatatactaataaatgc

SEQ ID NO: 10734 - DNA, 370 bp, Homo sapiens
  misc_feature 21, 22, 23: n = A,T,C or G
tacggctgcgagaagacgacnnnagggggaaaattcatttcatggacatcttgttgcgcaggaatcagtgtgattcacttttcatttcaggatgatgttgagtcctctgtgttattcccagtgtggacgtggagtagtgactgatgtctaattatttggaagggagagagcttctctaagaaggacatgcaatgtcagaagcttccgttgcttggcaacacgtaactttacctatgtttcaccaaaggcagtttaaagggctaaagatgcccattcaggcaatagtagattacaaggaagatctcgaaagctggcccgtcaaaatcgctttccaccatagaaataaacacctaagagagggtttgggacg

SEQ ID NO: 10735 - DNA, 377 bp, Homo sapiens
  misc_feature 377: n = A,T,C or G
ggcacgaggggagacaggaaggagaagaaaaacaaaagtgagaaaaagagctgaaaatgggacaacaagaaagattcctttttaaggaaaatgaataaactacctgtcaaaataagtataacatccttttcattctggaattttaggaatggttgccttcccttccaaaaattccccatccagttatcataaagcgaattatctgacacctatacacattacatactaaagtatttattgaatgagcaaggaccaccagtcaacaagctctacctatatacaacatttccaatcagtctatctattctctcacattaaaatacgtctagacaggccaggtggtgttggctcatgcctgtctgtaatcccagcacttn

SEQ ID NO: 10736 - DNA, 369 bp, Homo sapiens
  misc_feature 369: n = A,T,C or G
tacggttgcgagaagacgacagaagggacgtgagtgtatctggaaaaaaggagggagaagagaggtttccttcatcagcctgagggccgaggctgctgctggtctcaccttccatcccagttcctatacccaatctaccaagtgttgttgctagatgtcatagtggccacatgagggcagcagagtgacatgttctttgcatgaggatgggctataaagctggcaaaatttgctctctgaaggtttaccttttgatccctccaccagggattacaattctgctccccaagaggccccctaagaccacagaagataaggaggaaacaatacagaaactagaggtgaggaggaagtgtgcatagagacctn

SEQ ID NO: 10737 - DNA, 380 bp, Homo sapiens
ggcacgagggaacctgaagttcccatcagccagtacacctgtgaaccagtggaggacctgaagtacctgtttaaaagatagccaaaagataagtaaatgcctaccaactttctttggtgtctttgttgcatagttactgtgggctggaaaatagtagccatttttatctttgcagtttaattgccttcttccaaatagataaaaatcacttcctttgtaataattaaacagaatttaaaaaatacatttctatgacaaatattcctgatggcataagtatccaccccaaggttcccattaaatcttttaacctaaagtatttcctctcacctagagatcatcgagctgtgtgacaagggtgccagccactccaggtgaag

SEQ ID NO: 10738 - DNA, 381 bp, Homo sapiens
  misc_feature 232, 381: n = A,T,C or G
ggcacgaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttccttgaactcggagaggaaagtccggcccttcggaagccttggacagaaccctcccaccccgagaccangcgccgtgtgtgtgggggaaaaaaagaagccccgggttgagctcaaggaagacccggtggtgtccgtctttaaccatattacctaaccaaagggtggcgagacaagctttgtggggaagggctcttgcttggccaatgctcggcttgcn

SEQ ID NO: 10739 - DNA, 369 bp, Homo sapiens
tacggatgacagaagacgacagaagggctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcagggtgaaagattcatgaaattttc

SEQ ID NO: 10740 - DNA, 373 bp, Homo sapiens
  misc_feature 233, 356, 373: n = A,T,C or G
ggcacgaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcggagaggaaggtccgggccctcgggaagccttggacagaaccctccaccccgcagaccangcgccgtgtgtgtgtgggagagaaggagcccgtgttgagcttcaggagaccccgtgtgtccgtctttagcatataacctaccagtgcgtgccgagcagccttgtgggaagggacttgacttgncaggtcttgcctgaccn

SEQ ID NO: 10741 - DNA, 381 bp, Homo sapiens
ggcacgaggagagagagagagagatagagagagtgagagagagagagagagagagagagagagagagagagagagagagagagagagagagcgagagacagagagagagagagagagcgagagagagagagagtgagagagagagagagagacagagagagagagacaggggagagcctgtccgacctctctctttcttctctttctactttacatatgtttgtatgtttgtgtgtctgtctggggcatacacaaaaaagaattgatggccatgtgtctctatctctctgtctctctttctctctttccccccacgggcccggaggtctatatatctcttttctatatatatctacatatatccctctcgtgctctctccg

SEQ ID NO: 10742 - DNA, 381 bp, Homo sapiens
ggcacgaggggagacaggaaggagaagaaaaacaaaagtgagaaaaagagctgaaaatgggacaacaagaaagattcctttttaaggaaaatgaataaactacctgtcaaaataagtataacatccttttcattctggaattttaagaatggttgccttcccttccaaaaattccccatccagttatcataaagcgaattatctgacacctatacacattacatactaaagtatttattgaatgagcaaggaccaccagtcaacaagctctacctatatacaacatttccaatcagtctatctattctctcacattaaaatacgtctagacagggccaagtgtggtggctcatgcctggctgtaatcccagcactttgggg

SEQ ID NO: 10743 - DNA, 382 bp, Homo sapiens
  misc_feature 51: n = A,T,C or G
ggcacgaggagagaactagtctcgagactagagaactagtctcgagagcangggtttttttttttttttttttttttttttttttttcccccaaaaaggggaaaacttttttttttccaaaaaaagggggggcaaaggggttcttttcccccccaagggggggaaaggggttcctaaaaaacccctttgggttttcccggggcccccaaaaaaggggccccctttaaaaaccaaaaaaaaacccctttttttttttttccaaaaaaaggcttttcctttggaaaaaaaaattttcttaggggggccaaaaatttttccggggggaacccttttaaaaacccctggaaagggccttttttgttaaaaaaacccccaatttctt

SEQ ID NO: 10744 - DNA, 380 bp, Homo sapiens
ttcgaattcggcacgaggtttggaagatcactgttttgtagttcgggtgtgttatggggccacagggaaggtaaatggtctcaattttcaggaagttgacatttgccttttctacttcatttccttaaacaaaaattgaaatatcagatgacaaatttaaagagatatatcccatataaaacctaaagttctatgaggctgtattgaacgatagagttaatttgcatcatcagatgttgtggccgctttgtagcatttgctaatctggaacgcttggttttctcccccagatgagcaccatgccaggacctgccaccccggcctgcttttatgacatagaacttgatacccgaacagaaccaggtaaaagcttggtctat

SEQ ID NO: 10745 - DNA, 375 bp, Homo sapiens
ggcacgagaagaactagaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacag

SEQ ID NO: 10746 - DNA, 367 bp, Homo sapiens
  misc_feature 367: n = A,T,C or G
cgttgctgtcgtatcagtcaatttacctttgccttagcatcacacccttttctagcctccaccctgaattagggtttaatagtaataattataagaaatgatagtaattggagattatttactaaacactagtgtatgcttaactctatgctagttgctatagggaaaatggagatacaataatcactaatcccttacatttcatttcaactattcagtatttagcactcaccatgtgttagatacaggggataaagaaataaacatgaagcagcattaccctttaaggctcataatctagtagaggaatcagacacaaataaattataatacagtatagcacaataatataaatgtatacacttcn

SEQ ID NO: 10747 - DNA, 351 bp, Homo sapiens
tacggctccgtgaagacgacagaaggggttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtga

SEQ ID NO: 10748 - DNA, 367 bp, Homo sapiens
tacttctgcgagaagacgacagaagggggtgctcagatcacatctcctcatgataaagaaattctaaaatgtatagaagaatgtgtggaaccctggaatggttcctggaatgataatttagtggataccagcccgctgaagagagaccctctgcaggacatttgcaggagatacatggaagatctgaaaaagatctgtttttacagggagttaaactcgaagaccaccttgaaatttgtgcacacatcttttcatggggtcggacatgactatgtgcaggtggcttttaaagtgtatgggtttaagcctccaattccagtaccagaacaaaaagatcctgatccagacttttctaccggtaaatgtg

SEQ ID NO: 10749 - DNA, 336 bp, Homo sapiens
tacggctgcgagaagacgacagaagagtctctccatgtaattataactatttacagtcaagtgctgaacatctcaaactaatgatactgtttattacagaaagtcatgtaatgagtaagtgttaaatgtgtccctgaaacaaaagacttcacatgaaagtattattcttcctctgtctttaaccattgaaatgttttttgtccaagtgattaacatgactctatccaaataaaggtggtctactcaagaaatttacattctactgatgaatagaaattctgcattacttaatacgtagaatgtcacacatacgttgtttttgttttagttgaagtt

SEQ ID NO: 10750 - DNA, 702 bp, Homo sapiens
  misc_feature 541, 677, 702: n = A,T,C or G
ttcgaattcggcacgagggccgtcccagccaagaaaaggaagatgaacttctcagagcgggaggtggagatcatcgtggaggagctggagctgaagaagcacctgctggtgaaccacttcaacgccggggtacccctggccgccaagagtgcggcctggcacggcatcctgagaagggtcaacgccgtggccacctgccgcagagagctgcctgaggtcaagaagaagtggtctgacctcaagaccgaggtccgtcgcaaggttgcccaggtccgggccgccgtggagggtggtgaggcgccggggcccactgaggaggacggagctggggggcctgggacaggcggtggcagtggcggcggtggcccagctgtagccccagtgctgctgacccccatgcaacaacgtatctgcaacctgctgggcgaggccaccatcatcagcctgcccagcaccacagagatccaccctgtggcctctcgacccttcgccaccgcagccgcagccacggtcaccctgacacagatcccacagagaccanctattcactcttgaagaaggcgttgtgaatacttgccggttgaagggctctaccttgccccagagacctctgtgacatgatggcctacatgcaaacctttggtcaaccgaagcgcttaaaaccgattgcttcactntcgcagctgatacagagcagcgtcn

SEQ ID NO: 10751 - DNA, 604 bp, Homo sapiens
  misc_feature 400, 498: n = A,T,C or G
tactgctgcgagaagacgacagaagggcaacattcattcttctggtttcgacccacaggactaaaagtagcagcagagaagtgacaatgccagaggctcccttctcaacactctccaccagtgaggatacctcttgatagtactacattctctttcttgggccccattttcccaagagctaatctatgaagcaaatcttatttattaaataataataattatctgtgcaggcgcggtggctcacatctgtaatcccagcactttgggaggctgaggtgggaggatcacttgaggtcaggagttcaagaccagcctggccaaaatggtgaaacccagtctctactaaaaatacaaaaattagccaggtgtggtgtggcacacctataatcccagctactanggagggtgagcaggagaaatgcttaaatccaggagcagaggttgagtgagccaatattgacgactgcactcagctcagaacacaggagacctgttcanaatatatagggcagcacgtgctacactgtatctacatttggagctgaggggtgatactgaggcagagtgaacagctggcacagtgactctcttacaaaacaaaatg

SEQ ID NO: 10752 - DNA, 222 bp, Homo sapiens
  misc_feature 222: n = A,T,C or G
ggcacgagagggggagagcagacggggcgcggggaccggccaggccgcggcgggtgctgtttctgtttcactttccttcactctgaggccggcgcgctggcgggcgaggagcggcggcggtggcggccgctggacatgggaaagcggaaccaccaaaaggagtgatgatcaacgatctcatgataaatctggatgctagttctcatgcctcaggacatcctn

SEQ ID NO: 10753 - DNA, 224 bp, Homo sapiens
  misc_feature 26: n = A,T,C or G
ggcacgttaattaacagtgaacaggnccgatgttgactgtgcaactcacacgtcctgcaaaaaagacatatgtcgctttacaagaaggccaaagaactatggggccttcccagcatttgaccgttcattgcatacaatgaattaaatatacagttacttgaatgggtataacgcatgaatatttgtgagaatgcgtgtgtgtctgacatgtgtgaatttattag

SEQ ID NO: 10754 - DNA, 211 bp, Homo sapiens
ggcacgaggtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagct

SEQ ID NO: 10755 - DNA, 419 bp, Homo sapiens
ggcacgagctctctctctctctctctctctctctctctctctctctctctctctctctctctctctctctgtgggtgtctctctatctatcggggggtgtgtcacacacacagagtgacacagacacagagagagagagagagagagagagagagagaagatctgcacgctcacagagagaaaaagggacagagagagcacactctctcgatagagcgaaaaaactctataacgcgagacaagagcgcgctcacgcgagagagcgcgcgcgcgagcgagagcgcgcgctctatgcaggccacaaagagagagagagatagagagatgggcacacatatatagagagagagacagatatagagagaggaacccccctcccatataaaaaagacaattatttccagagaaaaacgccaaat

SEQ ID NO: 10756 - DNA, 172 bp, Homo sapiens
  misc_feature 9: n = A,T,C or G
attcaacanagaaggtaaaatactaactcaattcatcaatttaagcaatactcattaagagccaagtatgtgcttactgaataagctgctaaggtttggtggttacagagtgtgcggtgaaatgatgtctacatcacagtccaacattcacagagtttataagcctaccaag

SEQ ID NO: 10757 - DNA, 429 bp, Homo sapiens
  misc_feature 369: n = A,T,C or G
tacggctgcgagaagacgacagaagggctatgggaacttcccacccaattcagtgcttgcagaataagaaagcgctagcaaaaacatttaatatcttgtatttaaggtgagtcatagtccagacaggacaggcccatgagatgtggaaaaaatgtgtttccaaggctatgttaacatcactagggagtttcgtctcgggaaagcactctctataaagtcagttcttccaggtcctcaaaccaattcaaaacctagcctgctgattcaacttgtgtggacctcagccagtcttgtattaagatgataggggagggatttcagcttcctaggggagctctgctgaatacggtagctcaatcctgggcaatngtgtcgcacaggcccatgttactcatctatcacatggtaccagagcgagctcaccatctt

SEQ ID NO: 10758 - DNA, 457 bp, Homo sapiens
  misc_feature 325, 411, 421, 423, 426: n = A,T,C or G
cttttggccgaagcggcctacggctgcgagaagacgacagaagggggggaactaatttaattcagctaaattgtttacaaaataacagctcacacaaagatacacatataccgctgttgaaaagagacttatttggctacgaggcaaagatttaacattaaaaatcccgttttcttgtaaagagtaaacaagtgttagctcatgtatgtctccagctttggtaggaatacagctgtatgcatttgacctgaatcactaccatgtaaaagtgtcatacttgtgatttttagtaccttgtcattcattaatattcagagtatagaanaaggcagaccaacagattgctgctattttttttttcaagcccacagctaacatcatcgattgctgtatttgaaacaaagtcaacangaccccaatnanggnatttgctattggttttctctatcaaggatat

SEQ ID NO: 10759 - DNA, 437 bp, Homo sapiens
ttttggccgaagcggcctacggctgctagaagacgacagaagggcaacaattcctgccaacacaggaacccacacagtgatgtggaaaaaaacttccaaatactcagtggtagccacacttaccacatcccgatataaggtccaccatatgcacacacaattgcagaaatctgtcctcgtttctgcactataaataaaaatcctgaaggaaatccagcccacccagacattagatgggaatcacaacaaccaaagcccctggtaaaaagtcacttcaaagttgaatccactgcatacgcagcagccttgtgacacagttataaactcttccctactacaagctcatagggcgtgccattaccctgtggacccattaccctggggacccaacaaaaggagatctgtacctcctgaaaccagtttataaaaaattaaag

SEQ ID NO: 10760 - DNA, 447 bp, Homo sapiens
  misc_feature 435, 441: n = A,T,C or G
tacggctgcgagaagacgacagaagggagtaggagaatttttatgactactcagataaaacgaccattgatcacttacaaacatacaagtcataaacaatacagaaataatatgtgtatacaaaaacacagaaattattatattgggaatagacatatgactgattcatatgtaactttgtctccacgctgtcttaaagtgtacagagttgaatattgtcattcacaattgtcacacaaaataaaaactaaaaacacaattaactgatgtgacgtggcatactctaaaatatgaaacaaaaatgaaataaaattggctgggcatagtggctcacgcttgtaatcccagcactttgggaggctgaggcgggcagatcacgaggtcaggagaccgacaccatcctgactaacacggtgaaaccccatctctactaanaaatancaaaaa

SEQ ID NO: 10761 - DNA, 437 bp, Homo sapiens
gattcgaattcggcacgaggagagagagagagagagagagagagagagagagagagagagagagagagagagagagagagagagagagagagagagagagagagagagagagagagagagagagagagacacccctctctctctgtgtgggggggggggggggcccccccccccacaggggagagacacggcgcccccgctcgtggggagagatatatatgtggggtggggtgtgtttatacagagaggggggggtgtgtgtatacacgagacaaaggctctcccccgcgcggggggggaggcccccccccccccgtgtttttttttttgggggggggtatggggggcccccccaaaaacaagaaaacatctgtgtgttttttggggggggtcgtggggcgccaccggggggggcgagaggccccccccccctccca

SEQ ID NO: 10762 - DNA, 382 bp, Homo sapiens
ggcacgagggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaaatccagccacagtcggttctttaaagttttatcgaaacacaagcaatggaaatgcccatttccattgttgtctccagttgctctgctccgagggcagtgttaagttgtgcagcagaggcccctccatgcaaagctgaatatgtttactatttgaacttttttagaagttct

SEQ ID NO: 10763 - DNA, 389 bp, Homo sapiens
  misc_feature 312: n = A,T,C or G
gaattcggcacgaggagagagagagagagagagagagagagagagagagagagagagagagagagagagagagagagagagagagagagagagagagagagagagagagagagagagagagagagagagagagagagagagagagagagagagagagagagagagagagagagagatctctctctcttcccccccctctctgtgcgcgcccccccccccctcgagagctctctctctctgtgtgtgtcgcacacccacacctatctatatatagattgggagagggccttttttcccgcgcgcgcgctttancgcgcgctttaacatgtgtgtcttgagtgctctctctcactcacacacactatatatcactctctctttttttctct

SEQ ID NO: 10764 - DNA, 399 bp, Homo sapiens
ggcacgaggggattgtaaactaatcttacttagtcaatgtttcatagaatgctttggttacaatcaggttttttaaagactttaaaggttttttgtatgctataatatatgcttatgatttctaaaaattatgcagtatacacaaagggcataaagtcaaaaagtgtgtctccctctgtgactttattctcataccccagaggtatataatttcttgtattcttgtgtagtctttaagaaatgttatcggttattttatatatggctctctctctgtatgcctcttcctgttcttattttaaatgttcaagtttgtgacttggatcttgtttaacttggatgactttccatattgccaccttccagctctaacattaatgtctccaggattccattatg

SEQ ID NO: 10765 - DNA, 395 bp, Homo sapiens
  misc_feature 395: n = A,T,C or G
cgttgctgtcggattttcagctgttacagttttacagtttttagaggtaggtaagttggcttctgccagtcattcctgtacctaagtacatctacagactgtatggtaacagtgtatcatttggggaagaacattcttttctcctcccccaccccacaaaagaaaaacaacagcacatttattttctacttcaaattagcagttgctactgccctgggaggcttccctaagagttgttgctgaagattcaattaaaaacacacctgctttcgactgttgtctgctaaatgggaggagagaagtccgtatctcttctatggcttgctctgataggcctcatagccctccctttttcttgtctcctgaccagggcttataaggagttggcttagaan

SEQ ID NO: 10766 - DNA, 416 bp, Homo sapiens
aatgatgtaaaataagacttatcttccttccccatggtccttcattatttaaaaatagccattatgtcattcctaaacattctgttttccacctttaaaagctcctagttcctccatgtgtttacactaatgatgtttttcttgtaagcatctcaaagagtcttccaaacatattatatctttgtgacagatgaagaaattggagtacagagatgtggagtaacttttgagatgttgaagagcatgtcagggttcggttttagagtgttaggtctacatatactgtttccagattgttctttgccctggtcacggtgctctgcctagggtcccatttggacacacctctattaatgcagcaaccagaatgaaacacgttgttcacaggcttttctaaccatccgaagagcagcagg

SEQ ID NO: 10767 - DNA, 417 bp, Homo sapiens
  misc_feature 339: n = A,T,C or G
cgattcgaattcggcacgaggagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttgggcttcgcctcttggtcattcatcccaaacctggaaatggaaacaggcttcanacactcgtctcacgccgtgttgagatcaccgctcatcagatgatcatagatgaggtggttcagatggggggtgtgtgg

SEQ ID NO: 10768 - DNA, 370 bp, Homo sapiens
tacggctgcgagaagacgacagaagggaggaaaggatcttattatacacgaatgttgtcatacagtgcatgcaatgtccatccagcctttgaagatattcctatttccattaaaaatctttgtgtcttattagtattagtattaatcttattttccagaagtaggatcctagagaaaagaaagatataatttcaaaaagaccccagaagttatccaatctcattgccaatctgacgatgctaaaaccttggcatctcacatgaaagctgtgaaactagtattgtttccaaaattcttccatctctattgttattgccattacaatcattcacaaagtaattagatgtcaggatagtttgttttttaaagg

SEQ ID NO: 10769 - DNA, 384 bp, Homo sapiens
  misc_feature 36, 38, 40: n = A,T,C or G
cgttgctgtcggaagaattcgtggccgcaggagganantnttttttttttgttttttttttttttttattttttttttttttttttttttttttttctgttagaaaaaaaaaaaaccccccccccgggggctcgccctttttttttttgtgggggggggggtctcttttttccttccccacggggggggggggggggggggtccccacggggggggtttcctctctctttcctcttcttttaattgttttgtcccccactcccccccgcccgccgggggggggggggccaactcttctttctttccttccccccctcccttaaacaaatcaagcttttttcttttcttctcatggcctgcgccacttcttgagtggccctcccc

SEQ ID NO: 10770 - DNA, 390 bp, Homo sapiens
ggcacgaggggaatgttttctaatcttacatagtcaatgtttcatagaatgctttggttacaatcaggctttttagagactttaaaggctttttgtatgctataaatgatgcttatgatttctaaaaattatgcagtatacacaaagggcataaagtcaaaaagtgtgtctccctctgtgactttattctcataccccagaggtatataatttcttgtattcttgtgtagactttaagaaatgatatcgtttattttatatatggctctctctctgtatgcctcttcctgttcttattttaaatgttcaagtttgtgacttggatcttggttaacttggttggctttacatattgccaccttccagctgtaacattaatgtctcctggag

SEQ ID NO: 10771 - DNA, 393 bp, Homo sapiens
tcccatcgattcgaattcggcacgaggtgacctttaaaaagcaaaaaaaccaaaaaccaaccaaccaaacaaacacaaaaaaacaaacccacaaaaaatgaaaaaacagctacttctgaaacacataaaagtatcttgatcttttaaaaacaggtcctgaaactacagatccattgctgagactactcgaaaaactgtaaaacatgggcattattttaattcgtgaacaactgaaaagattcaatggagtgccatgtggtcattttagtatgtgagtcaaagcagaataatagggaaacattaaatctctcctttacagtttaagaggttgaaagcaaaaggaaagtctgaaaaaagaacaggggagggttggttggtaatgtttttggtaga

SEQ ID NO: 10772 - DNA, 384 bp, Homo sapiens
cgttgctgtcgcccatccctactaagaatacaaaaattggctgggcgtggtggtgcgtacctgtagtcccaacgacttgaaaagctggggtgggaggatcgcctgagcccaggaggtcgaggctgtggcagtgagctgaaattaaaccactgcactccagcgtgggcaacagagtgagaccctgactcataataaaaaaaaataggaaatgggccccccctgtttcccttttaaaaacgccaccgtttttttcttttttttaaggcccaaaaaattttttttcgggggggaggaaacccaaatgttgggaagtgtaccttatttttataaaaaaggaaggcgttggtttttaacttttcggataaaccggtgacgaaaaagagg

SEQ ID NO: 10773 - DNA, 382 bp, Homo sapiens
ggcacgaggagagagagagagtgatgttgagagagagagagagagagagagagagagagagagagagagagagagagagagagagagagagagagagagagagagagagagagagagagagagagagagagagagagagagagagagagagagagagagagtgtctctcccccccccccccagagcgagggggcgcacttttctctctctctctctttttatgtgtgttgtgtgtgtgtgttttttttagaggtgtgtgtttttctccccccactctccccacacagagcgcgctctctttctttttttctacaccccccccccctcgcgtgtgtgcgggtgtgggagcccccctcccccccctgtgttgtcccccccttcg

SEQ ID NO: 10774 - DNA, 391 bp, Homo sapiens
  misc_feature 391: n = A,T,C or G
ggcacgagcctcctcctcttcttccccctcctctccctcctcctcttcttctccctcctcttcctcttcctcctcttccacgtgctctcctttcctccccctcctcttgctccccttcttccccgtcctcttcctcctcctcctcttcttctccctcctcttcctcctcctctttcttcctgacctctttctttctcctcctcctccttctacctccccttctcatccctcctcttcctcttctctagctgcacacttcactactgcacatcttataacttgcacccctttcttctgaggaagagaacatcttgcaaggcagggcgagcagcggcagggctggcttaggagcagtgcaagagtccctgtgctccagttccacactgctggn

SEQ ID NO: 10775 - DNA, 383 bp, Homo sapiens
ggcacgagagatctcaacaaagcagtgtgaatgtccatggagctgtgcaggactggtgttcaacagtgccaccttgtggtgaagagaagcaggcacaatggaagctgattgcagtttttctctacatctggtatttcagaaataagactaagtaaggcctcagggggtattggaaaattcaaaagcaagatattaaactttataataacagtgtgtgagggggagagaggactcagtgattaattagaataaaacagagatatgactagatttcataccccaagctataggtcagaccagttgtacaggaaatgaatgtatctgcagagctgttaagctccttggtgataaaagcttttcagctgttcagattggctgatctt

SEQ ID NO: 10776 - DNA, 390 bp, Homo sapiens
  misc_feature 224, 335, 390: n = A,T,C or G
tacggctgcgagaagacgacagaagggatgaaatctacaaccttaattttataggtgagggaattttacctttggtagggtcacggtgttaggtcattatgataactttcaaggtgcctgggaataaaagttttataactttaatctgtctcctgcttttgagccttcgtgatctctccaggagctgctgtaatggcttcccaccctgcgtgggaacaagtggngtgctggtgggacaagtcgggggctggggatgtactctatgtgtttgtaggcagagctgaaaccacagagaacagcccagtggttcattaggctaggtgtgaggcactggngggcgcaggaagattgagatgaaggaactttggaggacaaccttaacatttaaan

SEQ ID NO: 10777 - DNA, 385 bp, Homo sapiens
  misc_feature 385: n = A,T,C or G
actacagctgcgagaagacgacagaagggcctgaagtctcacatcctctctaaatctgttctatgtttttcccacttgtacttggccctagaacttcggatcaagagacacaactcctcagatagcatctcaagcctcaacagcatcactagccattccagcatcggcagcagcaaggatgctgatgcgaaaaagaagaaaaaaaagagttgggtaggtaaaggtttggggggtggggaagtaggtagaaccgtggtggaccgccttcacctcagcatagggatcgaatccttccaggattaaccaaggtgtaggcccgtctaacactgagccctagtgtgatgtccgctcagagcatggactcccagattctcccttccctcan

SEQ ID NO: 10778 - DNA, 368 bp, Homo sapiens
  misc_feature 174, 175, 176, 177, 178, 179, 180, 181, 182, 183, 184, 185,186, 187, 188, 189, 190, 191, 192, 193, 194, 195: n = A,T,C or G
tacggctgcgagaagacgacagaagggaggcctagcacagtggtgtggagttccagctactcagaaggctgaggtgggaggattgcttgagcccaggagtttgaggctgcagtgagctatgattgtgccactgtactctagcctgggcgacagagtgagactctatcccttttnnnnnnnnnnnnnnnnnnnnnnaaaaagcggccgttttttcctctgggccccgaaggggaaaattctttgggagttttgggacaccccacaattaaaagggggggaaaaagggcttttttttggaaaatttggagactttgttttttttttcccccttttagcgggggaaaaaaaggtaaaaccaaaattttttt

SEQ ID NO: 10779 - DNA, 385 bp, Homo sapiens
cgttgctgtcgatgccatcatgtttttttaaaaagcttatgcagcattagaggaatttattttaatgcacatttatattcaacatagacattaattcagatttttacttgggataaaacaaattctagttttccctttgttttgaaattacttttaaaatatgtctttatagataaatataaaatatattaagcattttgaacagagcttagaagacaatatttagtactgtttctgaatatttctttatatctgaaggggaaaagccatcaaaatatgtgaattaaatacctaaaattctggttgtcaaaacgtcacacttaaccataactttaaagggagaaaaaccctttacagtgaccaccccactctttgatagctaagg

SEQ ID NO: 10780 - DNA, 370 bp, Homo sapiens
tacggctgcgagaagacgacagaaggggagccaccgcgcctggccagaagctcttaattttaatatagaccaatatctgtcattttttgtgtgtcctgtttaagaatttttcccctactccaaaagtaatttctatttattttctagaaattttattgttaagcctttaattttggatctgtaatccacatgaaattaattttctctggctgaggtggggcgaagattaatgtttttccatatggatatcccatggatcccaagccatgtgttgaacagatcatcacagctttgtgtacgtgtgtctgattctgggatctctgttctgctccattgggcttgatttgcattttcctgatgactgaaaatg

SEQ ID NO: 10781 - DNA, 380 bp, Homo sapiens
tacggccgccagaagacgacagaagggggaagctggcagatgaaccaggtttcaaacccaggtccacctgattccacagctaggccctgatgtgcaagagctgcttgcagcaatgatttgaaccttcttgttttctaccaaaaggctttcctttgtagactgtctctaacaggcaaattaggtaagcaccctgtgggacaggggatgaaaaaagaaagacatacagtatgttgcagaaaacttttaaaaattatatcataacatatttacatctgatatcaaccatattcaatgtactttcatatacatcatctcttagtgtcaccacatatctgtatatgggtaatgaggcgaatctgtaattatgctcattacacacg

SEQ ID NO: 10782 - DNA, 407 bp, Homo sapiens
cgttgctgtcgccagattattgatattgcttttttatagcaggctctttctcttgtagagatgcatactgcacaatttgactgaatacacgtgcctgtctcttttgggaacccttgaacttgctttttaacgctttacagactttggcttgcatagtcagaatgcaagctaataaatcttattttcttataacactaagtgctagctgatttatttaatctttattcattgggacaaaagaaaacataacactgtctcagctcaatacaaggtcacaacaaaaattaatgtataggcattttccctgtcgtaatcagcaatatttatacagcagaatttacataatcaatacagcgaataaagcgcggcattgtttaacgcatacagaacaagggctttggagtcat

SEQ ID NO: 10783 - DNA, 383 bp, Homo sapiens
ggcacgagcagaggagccccatctttttcagccccctcctgcctttggggtgcaaggttcctgaaggacttgagtgagatgtcaccaagcaacaggctgtcaggctcttggcagcaagtactggcccagcgactcgcggcagagtctctccttggggcgtctgtccttatcaggggtggatgctgtcagacttgctaatggtggaatttctggcatgtggcagggccaagtgcagtggctcacacctataatcccagcactttgggaggctgaggcacgaggattgcttgagcccaggagttcatcaccagcctgggcaatatagccagacccggtctccacaaaaaaatttttaaaaattagctgggcatggtggcctgtgg

SEQ ID NO: 10784 - DNA, 394 bp, Homo sapiens
tacggctgcgagaagacgacagaagggatgctggactaagaatccttgtggacaggaaaagtggtgtttgtatttattatcctcctaacctaacctctggctcaatgcctgacacaaagtaagaattgtttcaattaattaaaaatgaaaactggctgggtgctgtggctcacgcctgtaatcccagcactttgggaggccgaggcaggtggatcacgaggtcaggagatcgagaccatcctggctaacacagtgaaaccccgtctctactaaaaatacaaaaaaattatctgggcgtggtggcgtgtgactgtagtcccaactgcttgggagtctgaggcaggaaaatggcgtgaacccaggaggcagagcttgcagtgagccgagatcacac

SEQ ID NO: 10785 - DNA, 394 bp, Homo sapiens
tacggctgcgagatgacgacagaagggccttgtttactgtggtccctgaatcatgggggctgaatttgatgtcttcatccttgagatgagcctgctggcttagctgaggaatgtcctgctgaggtttcttaggtttccttgggttctaaggatatactggatataccatcttttagcaagagtatctggtagcatttacagatagcatagacattggtatgcacttctttccccagataggaagtaaaggaggatttagttgcatgaaaaaaggatgttaaacattgattacataggagtaaagatgaatgagctgcaatattcagtcggagctaaacaataagatcagggaaggtaaaaatacctatgtggaatattttgaatcgtaagcttt

SEQ ID NO: 10786 - DNA, 384 bp, Homo sapiens
  misc_feature 344: n = A,T,C or G
taccgctgcgagaagacgacagaagggcacccctttttggtattgctgtgaaatgtggttttactttgtatctcctgagatgaatttttagatagaaacttgtgaaaaaggcccaatttgaacttttcttctatgggatgtttcccttttaaaatacttcctgacaggcaaaggctacacagagtgcttcttaaaatgatatgactgattgcgaaggcaccgctcgatatcatcccaggtatcagtcccatcccagaaaggctcatggttgttcttcatagaaaacatttgtctttatcattatgcagctggcataccttaatatcattcttaaccctggattntaaaatgtatcaagtgaacagaaagctaattacacccttc

SEQ ID NO: 10787 - DNA, 378 bp, Homo sapiens
  misc_feature 28, 29, 30, 355: n = A,T,C or G
tacggctgcgataagacgacagaagggnnnaatggagccttcttatttggccctttgtggagtagacatgggattattttgcagtttttggatagcggggttgtcaacatgtgttttcaaatatcacaacaaaagtttgggactttgaggtggcaggggaagaaacttagtaattgtttttcttatttaaaaaaaattttttttcttttttcttttttcttttttttttattctaagttctcggatacatgtgcagaatgtgcaggtttgttacataggtatacatgtgccatgggggttatttaaaagtttttggagacacagtcccactctttcgcccaggctggaatgcagnggcacaatcttgactcactgcat

SEQ ID NO: 10788 - DNA, 374 bp, Homo sapiens
tacggttgcgagaagacgacagaagggagaacaagccttcacacccccacaggggcttgccagaagcaagtgctggaggagtcacctacacagcttcagagagaatcttttttcccctcccagttccaaccctgagagtgtttctgaagctatagaaatgctagtagctctgagcatcttcttgggctggctgtctctttttgtcagttgttgcattatttgcttctcacccagagcagccacccatcctgagattttatctgcagttagagaattctccctccatttctgttttgagggcatacttgttggtcaaagacatcctcttgtcttcagttaaacctgtttttctgaaataccaaaatcttgagaag

SEQ ID NO: 10789 - DNA, 372 bp, Homo sapiens
tacggctgcgagaagacgacagaagggctgcaattaacctatgaaaacacttttaacatttaaataataagcactcattgtatgagatctgtgagccacagtggatggaattaggaattcagtttattgtgtgtgtttttttagacgtttgtaaccaccagattaggaagttttaacaagtacttactatagggtgaatcttccgtccatcatcctttcaactgtccattcatccaaggtactatttgaacaccaactatgtacatgatggactggtttctggggcagacaatacaggccttttgtcttccaattcaaaatctagaagatgaactttgtgaggatggaaaacattctctggatggcttgtag

SEQ ID NO: 10790 - DNA, 373 bp, Homo sapiens
tacggctgcgagaagacgacagaagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacagacatttattcagaacagctggggatcaaccgtttaacctgtccacagtgtcgagtgccttcccaatggtcagccacccagtctttggtctacattcagccagctcacggcattcagaatttggtgg

SEQ ID NO: 10791 - DNA, 408 bp, Homo sapiens
ccctcgttcgaatcggcacgagggtggacatcacgctgctatttcgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcaca

SEQ ID NO: 10792 - DNA, 398 bp, Homo sapiens
cgaattcggcacgagggccgtcccagccaagaaaaggaagatgaacttctcagagcgggaggtggagatcatcgtggaggagctggagctgaagaagcacctgctggtgaaccacttcaacgccggggtacccctggccgccaagagtgcggcctggcacggcatcctgagaagggtcaacgccgtggccacctgccgcagagagctgcctgaggtcaagaagaagtggtctgacctcaagaccgaggtccgtcgcaaggttgcccaggtccgggccgccgtggagggtggtgaggcgccggggcccactgaggaggacggagctggggggcctgggacaggcggtggcagtggcggcggttgcccagctgtagccccagtgctgctgacccccatgc
